United States Patent 10,167,482 (GENES AND USES FOR PLANT ENHANCEMENT) - sequence listing, part 6

SEQ ID NO: 21265 - protein, 284 aa, Griffithsia japonica
  misc_feature (208)..(208): Xaa can be any naturally occurring amino acid
  misc_feature (224)..(224): Xaa can be any naturally occurring amino acid
  unsure (1)..(284): unsure at all Xaa locations
ARGVGILADDTDPMVSVMKVDKAPLESYADIGGLETQIQEIKEAVELPLTHPELYEDIGIKPPKGVILYGEPGTGKTLLAKAVANSTSATFLRVVGSELIQKYLGDGPKLVRELFRVAEDMAPSIVFIDEIDAVGTKRYDTTSGGEREIQRTMLELLNQLDGFDSRGDVKVLLATNRIETLDPALLRPGRIDRKIEFPLPDEKTKRRXFSIHTGRMTLAGDVNXEEFVMNKDELSGADIKAICTEAGLMALRERRMKVMHADFKKARENVLYKKNQGVPEGLYL

SEQ ID NO: 21266 - protein, 276 aa, Bacillus subtilis
  misc_feature (1)..(1): Xaa can be any naturally occurring amino acid
  misc_feature (39)..(39): Xaa can be any naturally occurring amino acid
  misc_feature (51)..(51): Xaa can be any naturally occurring amino acid
  misc_feature (156)..(156): Xaa can be any naturally occurring amino acid
  misc_feature (221)..(221): Xaa can be any naturally occurring amino acid
  misc_feature (225)..(225): Xaa can be any naturally occurring amino acid
  unsure (1)..(276): unsure at all Xaa locations
XNVPFWTEEHVRATLPERDAESHKGTYGTALLLAGSDDXPGAALLAGLGAXRSGLGKLVIGTSENVIPLIVPVLPEATYWRDGWKKAADAQLEETYRAIAIGPGLPQTESVQQAVDHVLTADCPVILDAGALAKRTYPKREGPVILTPHPGEFFRXTGVPVNELQKKRAEYAKEWAAQLQTVIVLKGNQTVIAFPDGDCWLNPTGNGALAKGGTGDTLTGXILGXLCCHEDPKHAVLNAVYLHGACAELWTDEHSAHTLLAHELSDILPRVWKRFE

SEQ ID NO: 21267 - protein, 462 aa, Mesorhizobium sp. BNC1
MATPTDLVAASFRPPAPSPRQTPPSTLQMMRIVYRNPLELWGEPSYNEPWVQLTGGIGGPLLIANDPGLIRHVLVDNARNYKMARVRQKILRPILRDGLLTAEGEVWRRSRKAMAPVFTPRHISGFAGPMLQKAEAFAERYEQAIGGTVDVSRDMTMLTFDILSETLFSGEVAGDPGGFAHQVDRLFETMGRVDPLDLLGAPDWLPRITRILGRNSLAFFRNIVARTMEMRKEKLAGGDAEVPEDFLTLLLRAEGPQGLSRGEIEDNIITFIGAGHETTARALGWTLYCLANLPEERERIEAEIDSVLSSEPDPVKWLDAMPLTRAAFEEAMRLYPPAPSINREAIENDSYSDLKIAAGTQVLVMPWTVHRHRKLWDDPDAYRPSRFHPENREKINRFQYLPFGAGPRVCIGATFAMQEAVIALAVLMSRYRFDLLPETKPWPVQKLTTQPQGGLPMGVSRR

SEQ ID NO: 21268 - protein, 285 aa, Ostreococcus tauri
MTCSTSRPQSPATRSNAAFGRRSRSTSSSPQRNRSHRHRHRVALRTRASSNDQETLTWDEIENIVNRDVVRSVMTSRVLSVGPNASVFEAMKLLVENRISAVPVVDEKGVVLGVVSEYDLMARVGKKETTRSVKDDGMFPRVGRCDEFNGNVKQMWNQFHNLQERMYKASGTKVLTAMHETPATCTPDTPLVEATELMLDKNLARLPVVDERGALLGILSRGDIMRRTFQAFLLAQQTTDRDEFAREVQKLDVSDPGINSEMNPSPSVVEFCEAAPDDDECKIFD

SEQ ID NO: 21269 - protein, 432 aa, Azotobacter vinelandii
MTHRIVIVGGGAGGVELATRLGKTMGRNFQAKITLVDANMTHLWKPLLHEVAAGSLNSTGDELNYVAQAKWNNFEFQYGRMCGLDRANKRIRLAAQPAQEDRAPLPERELEYDTLVLSVGSTTNDFGTPGAAENCIFLEGRDQAERFRRPLLSHYLRAHASNDDGHQVKVAIVGAGATGVELAAELRHASKELVAYGLERIPPENLSITLIESSPRVLAALPERISRSAHATLESLGVRVLVSTAVSEVTAEGVKTKDDQFIPADLMVWAAGVRAPAFLKELDGLETNRINQLQVRQTLQTTLDDDIFAFGDCASCPQPGTDRPVPPRAQAAHQQASLLAKSLHRKLQEDSLCWSIATANHGSLISLSSFSAIGNLMGNLTGNVTLEGWLARKFYISLYRMHQMALYGTFRTLMMMLGDRFRSSTEPRLKLH

SEQ ID NO: 21270 - protein, 740 aa, Escherichia coli B
GSAHINRAGEFDPEKWIASLGITSQKSCECLAETWAYCLQQTQGHPDASLLLWRGVEMVEILSTLSMDIDTLRAALLFPLADANVVSEDVLRESVGKSVVNLIHGVRDMAAIRQLKATHTDSVSSEQVDNVRRMLLAMVDDFRCVVIKLAERIAHLREVKDAPEDERVLAAKECTNIYAPLANRLGIGQLKWELEDYCFRYLHPTEYKRIAKLLHERRLDREHYIEEFVGHLRAEMKAEGVKAEVYGRPKHIYSIWRKMQKKNLAFDELFDVRAVRIVAERLQDCYAALGIVHTHYRHLPDEFDDYVANPKPNGYQSIHTVVLGPGGKTVEIQIRTKQMHEDAELGVAAHWKYKEGAAAGGARSGHEDRIAWLRKLIAWQEEMADSGEMLDEVRSQVFDDRVYVFTPKGDVVDLPAGSTPLDFAYHIHSDVGHRCIGAKIGGRIVPFTYQLQMGDQIEIITQKQPNPSRDWLNPNLGYVTTSRGRSKIHAWFRKQDRDKNILAGRQILDDELEHLGISLKEAEKHLLPRYNFNDVDELLAAIGGGDIRLNQMVNFLQSQFNKPSAEEQDAAALKQLQQKSYTPQNRSKDNGRVVVEGVGNLMHHIARCCQPIPGDEIVGFITQGRGISVHRADCEQLAELRSHAPERIVDAVWGESYSAGYSLVVRVVANDRSGLLRDITTILANEKVNVLGVASRSDTKQQLATIDMTIEIYNLQVLGRVLGKLNQVPDVIDARRLHGS

SEQ ID NO: 21271 - protein, 225 aa, Ralstonia metallidurans CH34
MRKLIMGIVEFREKMLPRYAEQFSKLALAQTPDALFITCSDSRVVPDLLASTHPGDLFTMRNVGNLIPPATAEGVSTGDLSEASAIEYAVLVLKVANIVVCGHSECGAMKAVYSRNPKLKAPNLDKWLYHASNAAFRLEHEGALDESLKPHDQLSQLNVLVQIEHLMTYPIVRRQVMAGALVLSGWWFDIATGDMYAYERASRSFEVIDRALAERLASRLASRAR

SEQ ID NO: 21272 - protein, 422 aa, Staphylococcus aureus subsp. aureus Mu50
MKNLILSVQHLLAMYAGAILVPIIVGTSLKFTPEQIAYLVTVDIFMCGVATFLQANKVTGTGLPIVLGCTFTAVAPMILIGQTKGIDVLYGSLFLSGILVIIIAPFFSHLVKFFPPVVTGSVVTIIGINLMPVAMNYLAGGQGAKDYGDVKNILLGLMTLIIILVLQRFTTGFIKSIAILIGLVLGTIGAGLLGMVDINQVNHAGWLGIPVPFRFSGFSFDVTSTLVFFILAIVSLIESTGVYHALSEITGKKLERKDFRKGYTAEGLAIVLGSIFNSFPYTAYSQNVGLVSLSGAKKNNVIYGMVVLLLICGCIPKLGALANIIPLPVLGGAMIAMFGMVMAYGVSILGHIDFKNQNNLLIIAVSVGLGTGISAVPQAFKGLGEQFAWLTQNGIVLGAISAIILNFFFNGIKYKQTEENVK

SEQ ID NO: 21273 - protein, 222 aa, Glycine max
GGYGDANQRIDYVFKVVLIGDSAVGKSQILARFARNEFSLDSKSTIGVEFQTRTLVIDHKTVKAQIWDTAGQERYRAVTSAYYRGAVGAMLVYDITKRQTFDHIPRWLEELRNHADKNIVIILTGNKCDLENQRDVPTEDAKEFAEKEGLFFLETSALEATNVETAFITVLTEIYNIVNKKNLTADENQGNGNSASLSGQKIIVPGPAQEIPAKRNMCCQSS

SEQ ID NO: 21274 - protein, 360 aa, uncultured gut microbe of Zootermopsis angusticollis
IGAANNLLAAMIDNHIYQGNKCNIDPRKIIWHRCIDMNDRQLRFVVDGLGGKANGESREDWFDITVASEVMAILCLSKDIDDLKARLGKIIVGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVNVALSEVWAKGGEGGKALAEQVVKLCDLNKENDFTFSYDEKASIKDKIEAIAKKIYHADGVIIQDNAKKQIAQLEKLGLDKMPI

SEQ ID NO: 21275 - protein, 360 aa, uncultured gut microbe of Zootermopsis angusticollis
IGAAFNLLAAMIDNHIYQGNKCNIDPRKIIWHRCIDMNDRQLRFVVDGLGGKANGESREDWFDITVASEVMAILCLSKDIDDLKARLGKIIIGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVTVALSEVWAKGGEGGKALAEQVVKLCDQGKENDFTFSYDEKDSIKDKIEAIAKKIYHADGVIIQDNAKKQIAQLEKLGLDKMPI

SEQ ID NO: 21276 - protein, 360 aa, uncultured gut microbe of Zootermopsis angusticollis
  misc_feature (5)..(5): Xaa can be any naturally occurring amino acid
  unsure (1)..(360): unsure at all Xaa locations
IGAAXNLLAAMIDNHIYQGNKCNIDPRKIIWHRCIDMNDRQLRFVVGGLGGKANGESREDWFDITVASEVMAILCLSKDIDDLKARLGKIIIGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVNVALSEVWAKGGEGGKALAEQVVKLCDLNKENDFTFSYDEKASIKDKIEAIAKKIYHADGVIIQDNAKKQIAQLEKLGLDKMPI

SEQ ID NO: 21277 - protein, 748 aa, Salmonella enterica subsp. enterica serovar Typhi str. CT18
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 21278 - protein, 540 aa, Methanococcoides burtonii DSM 6242
MPIITLQYEDLESLTKADKDTIIDRVPMIGADIERIEKEAIDIEFFPDRPDLYSVEGVARAMRGFMNIETGLCQYEVTPSGVHIELDEKIKEVRPVLGCAIVKGINFTSSSIKSLMDLQEDLHWGLGRNRKKVSIGVHDMTNIEPPFKYQAVSPDFEFVPLDFTEPMTMDEVLEKHPKGVRFANILEGMEKYPLITDSEGKVLSFPPIINGTLTRVEESTTDLFIDVTGLGDAVYTALSIVVSALAERGGKIESVKVVYPDGTEKVTPDMTPRTLNVPRSDIDSLIGIKLTDDEIINELKRMRFDASVLEDGDMFEISVPTYRADILHNFDIVEDIAIGYGFDKIKSEFPKSATIGCAHPISVTRGVMREIMVSLGYSEVMPFTLTSQKVHFEWMNREETDDVTFVLHPISEDQTMVRTTILPNLIEIFSLNQHHELPQRLFEVGEVVVNSKNRLHLAAASIHAQANFTEIREVLDAVMRERDIEYEVVVSEDPAFIEGRRADILVNGEKVGMMGELYPEVIINFGLGQPIVGFEIDLTE

SEQ ID NO: 21279 - protein, 432 aa, Psychrobacter arcticus 273-4
MNTDIAKNTNSLNDDKKSNSEQRPYGIVLYGATSFVGQITAHYLAEFLSTSKDASGTTVTWAIAGRDEKKLNELQSKLASKVNIIIANSDDATSLDELTEQTQVIISTVGPYLKYGEPLIKSCVDNGTDYVDLTGEAIFIKDMIDKYQEAAKQSGARIVNSCGFDSIPSDLGVYFTQKQAEAKFDSACDVIHMRVKAAKGGLSGGTIASMATIFEEVGQDKSRRKQVANPYLLNDDKDVPNVRQSNVSKPEYDSEHKRWLAPFVMASINTRIVHRSNQLLGYEYGRDFKYDEAMWMKDGIKGKLTSYALSAGLLGFATAMMITPSRELLSKHVLPKSGSGPSKEEQENGYFDIRLFGKTANKETIATKVTGDKDPGYGSTSRMLSQAALCLAQDISKEAVGGGFWTPASAMGDKLLARLKEHAGLSFDVIDR

SEQ ID NO: 21280 - protein, 360 aa, uncultured gut microbe of Zootermopsis angusticollis
  misc_feature (5)..(5): Xaa can be any naturally occurring amino acid
  unsure (1)..(360): unsure at all Xaa locations
IGAAXNLLAAMIDNHIYQGNKCNIDPRKIIWHRCIDMNDRQLRFVVDGLGGKANGESREDWFDITVASEVMAILCLSKDIDDLKARLGKIIIGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVNVALSEVWAKGGEGGKALAEQVVKLCDLNKENDFTFSYDEKASIKDKIEAIAKKIYHADGVIIQDNAKKQIAQLEKLGLDKMPI

SEQ ID NO: 21281 - protein, 420 aa, Burkholderia pseudomallei K96243
MKLHGFLIGQTEALLAEVLKFAGPADVTTSRFFRAHPKLGHAERGVIAEAVFAVLRRRMEYAHLAESGTGAPARRLALLGLMQTVGRSALKPFVSDAEWAWLDHVAKIDPASLPLRVRTNLPDWIHQALAERLGADELAQFAAAVNYPAPLDLRANALKATRDQVIDSLRAAGIDAGATPFAPFGVRVVGKPALTKLKLFEEGLIEVQDEGSQLLCSLVAPRRGEMIVDFCAGAGGKTLALGAMMRSTGRLYAFDVSEKRLAKLKPRLARSGLSNVNPVLIDSEHDAKIKRLAGKIDRVLVDAPCSGLGTLRRNPDLKWRQSRETVDELAPKQASILASAARLVKKGGRLVYATCSVLEAENEAIVSAFLAAHPAFELVPASRVLAEQRIALDTGDYLSLWPHRHATDGFFAAVLERRAQ

SEQ ID NO: 21282 - protein, 398 aa, Burkholderia pseudomallei K96243
MLNSLLDFLSNGLLRFSWWQIVLFTLAVTHVTIVGVTVYLHRCQAHRALDLHPIMSHFFRAWLWMTTGMLTGQWAAIHRKHHAKCETEEDPHSPQTRGIWKVLLEGAELYRAEAKNEETMRKYGHGTPNDWLERNVYSKYPILGVSLMMVIDVALFGLVGLTVWAVQMVWIPFWAAGVVNGLGHFWGYRNFNAADASTNLFPWGIVIGGEELHNNHHTFATSAKLSNKWYEFDIGWMYIRIMSAFGLAKVKKIAPTPRLAARKTVLDQETLQAVLSNRYEVMARYAKTLKRAYRQELAHLKELGAREKYQLMRGARKWFHKDEAGLDEPQKRMLPEIFANSQKLHTFFQLRAELTAIWERSNASREQLLTQLQDWCHRAEQSGIKALQEFATRLRRYA

SEQ ID NO: 21283 - protein, 230 aa, Triticum aestivum
MASGDPKPDENYSSDGGDTTDAESSDESPHQPRRGPRANPILTRLSVSRNPSPLSAATAAPGVCLLRFAWESAAGSLVGAVVGYGKGLVTTKGFKGSFADAASSAKIFAVLAGVQSLVSCSLRKLRGKDDVINAGVAGCCTGLALSFPGAPQTLIQSCLAFGTFSYIIEKLNRQQPALALPSAAGLKDLKAGPSVLPPFTLNMPHDAMEGFSSVSKLFVKVPRKLKDLGA

SEQ ID NO: 21284 - protein, 339 aa, Vibrio sp. Ex25
MLTLVGESTFMKTLDINDYYSISDEQKPVLASVAETFKHQANALNEMAKSIDFEQYQKAISYIIDCQGHVIVCGMGKSGHVGKKISATLASTGTPSFFLHPSEAFHGDLGMITKEDVIVLISNSGETDEVLQLIPSLKSFGNKVISITGRIDSTMSRNSDATLLLAQIQESCPNNLAPTTSTTLTIALGDALAVALMKMRQFMPNDFARFHPGGSLGRRLLTRVRDEMNAENLPLVDVSDSMTSVIIKMNEGRRGVAIVIENNGLKGIITDGDLRRALAKEAEFNSLKAGDVMTVEPKTCYDTEMLADAEEKMRQFSISSLVVLDDESKVVGLIQIFNM

SEQ ID NO: 21285 - protein, 513 aa, Staphylococcus aureus subsp. aureus Mu50
MEMAKEQELILVLDFGSQYNQLITRRIREMGVYSELHDHEISIEEIKKMNPKGIILSGGPNSVYEEGSFTIDPEIYNLGIPVLGICYGMQLTTKLLGGKVERANEREYGKAIINAKSDELFAGLPAEQTVWMSHSDKVIEIPEGFEVIADSPSTDYAAIEDKKRRIYGVQFHPEVRHTEYGNDLLNNFVRRVCDCKGQWTMENFIEIEIEKIRQRVGDRRVLCAMSGGVDSSVVAVLLHKAIGDQLTCIFVDHGLLRKGEGDMVMEQFGEGFNMNIIRVNAKDRFMNKLKGVSDPEQKRKIIGNEFVYVFDDEASKLKGVDFLAQGTLYTDVIESGTKTAQTIKSHHNVGGLPEDMEFELIEPINTLFKDEVRKLGIELGIPEHLVWRQPFPGPGLGIRVLGEITEDKLEIVRESDAILRQVIREEGLEREIWQYFTVLPNIQSVGVMGDYRTYDHTVGIRAVTSIDGMTSDFARIDWEVLQKISSRIVNEVDHVNRVVYDITSKPPSTIEWE

SEQ ID NO: 21286 - protein, 1099 aa, Oryza sativa (japonica cultivar-group)
MTTRRGGRGFMACDHKRQFLKAGVGNVLRASIVLHANALTTPIMIGTSCRVGRMGVFDKRATQKFLIRVKQEIGNLIDHFLQQQQQEEEEVLVPRQELPNGTQPMEAVVVPSEPAATVENQQIEDPPISRFTWTIENLSRVSTKKLYSEIFVVGGYKWRILIFPRGNNVEYLSMYLDVADSAVLPYGWTRYAQFSLSVVNQMHNKFTIRKETQHQFSARESDWGFTSFMPLGDLYNPSRGYLVNDTCIVEAEVAVCKVVDYWSYDSKKETGYVGLKNQVDSACQAVYHMPTTENDMPSGSIPLALQSLFYKLQYNDSSVSTKELTKSFGWDMHDSFMQHDVQELNRVLSEKLEDKMKKGILLWQVIVLSHHGHYVQTCPFDLIGVHSNADLQLDVKGCQDVYASFDKYVEVERLEGDNKYHAEQYGLQDAKKGVLFIDFPPVLQLQLKRFEYDFMRDTMVKINDRYEFPIQLDLDRDDGKYLSPDADRNVRNLYTLHSVLVHSGGVHGGHYYAFIRPTLSDQWFKFDDERVTKEDAKRALEEQYGGEEEIRLEKDREEKERRKKEKAEAHLYTIIKVARDDDLTTQIGKDIYFDLVDHDKVPSFRIQKQMPFTQFKEEVAKEFGIPTQFQRFWLWAKRQNHTYRPNRPLTPQEETHTVGQLKEAANKAHNAELKLFLEVELGLDLKPLPLPDKTREDILLFFKLYDPEKEQLRYVGRLFVKASGKPQDILPKLRKMAGFSQDEEIELYELEDGDIVCFQKSPKPDTADQYRYPDVPSFLVYIRNRQVVHFRSLEKPKEDDFCLEMSKAFTYDEVVEKVAQKLGVDDPTKIRLTSHNCYSQQPKPQPIKYRGVERLLDMLIHYNQTSDILYYEVLDIPLPELQALKTLKVTYHHGTKDEVSVHSIRLPKNSTVGDVLNDIKSKVELSHPNAELRLLEVFYHKIYKIFAPNEKIENINDQYWTLRAEEVPEEEKNLGPFDRLIHVYHFTKDTQNQTQVQNFGEPFFMVIREDETLSSIKERIQKKLKVPDEDFSKWKFAYISLGRPDYFEDSDTVASRFQRNMYGAWEQYLGLEHPDTAPRKTHNANQNRHSFERPVKIYN

SEQ ID NO: 21287 - protein, 529 aa, Oryza sativa (indica cultivar-group)
MAVKMRIGRRRAIQQGIAEGGFEWRRVWGCREADSRGALWELVWGERSVRERNAAGAAEEVIALFIMDEMCDLASNLEYVVEMAKCDVHRTSSAEEFFTEYGDANRYRIQEVIGKGSYGVVCSAIDLHTRQKVAIKKVHNIFEHVSDAARILREIKLLRLLRHPDIVEIKHIMLPPSRRDFKDIYVVFELMESDLHQVIKANDDLTKEHYQFFLYQLLRALTYIHTENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQMMCSQVIKDFASGEIKQASTLFDCDVTLDDYLLKSYYKTASLLASSTRSAAIFSGVSTTICEQMYEYGRNLGLSFQVVDDILDFTQSAEQLGKPAGSDLAKGNLTAPVIFALQDEPKLREIIDSEFSESDSLATAIDLVHRSGGIRRAQELAKEKGDLALQNLQCLPKSQFRSTLENVVKYNLQRID

SEQ ID NO: 21288 - protein, 498 aa, Triticum aestivum
  misc_feature (478)..(478): Xaa can be any naturally occurring amino acid
  unsure (1)..(498): unsure at all Xaa locations
MTKDVEMAARNGGNGAVAGEAYYPSPPAQGGDADVDDDGKQRRTGTVWTASAHIITAVIGSGVLSLAWATAQLGWVVGPITLMLFAAITYYTSGLLADCYRTGDPLTGKRNYTYMGRRSTHSVRPCVLDAVRSNLGGPKVIFCGVIQYANLVGVAIGYTIASSISMRAIRRADCFHANGHADPCKSSSNPYMILFGLVQIVFSQIPDFDQIWWLSIVAAVMSFTYSGIGLSLGITQTISNGGIKGSLTGISIGVGITATQKVWRSLQAFGDIAFAYSFSNILIEIQDTIRAPPPSEAKVMKQATRLSVATTTVFYMLCGCMGYAAFGDAAPDNLLTGFGFYEPFWLLDIANVAIVVHLVGAYQVFCQPIFAFVERWAASTWPDSVFISREFRVGPFALSVFRLTWRSAFVCLTTVFAMLLPFFGNVVGLLGAVSFWPLTVYFPVEMYIRQRGVPGRSMQGICLRMLSVGCLIVSIGRXAAGSIANVIEALKVYKPFSG

SEQ ID NO: 21289 - protein, 387 aa, Arabidopsis thaliana
MGSSMEEKVVAVIMVGGPTKGTRFRPLSLNIPKPLFPIAGQPMVHHPISACKRIPNLAQIYLVGFYEEREFALYVSAISNELKVPVRYLREDKPHGSAGGLYHFRNLIMEDSPSHIFLLNCDVCCSFPLPKMLEAHRGYGGIGTLLVIKVSPESASQFGELVADPVTNELLHYTEKPETFVSDRINCGVYVFTPEIFNAIGDVSTQRKDRATLKRVSSFEALQPATRIPTDFVRLDQDILSPLAGKKRLYTYETMDFWEQIKSPGMSLRCSGLYLSQFRLTSPQLLASGDGTRSAIVIGDVYIHPSAKVHPTAKIGPNVSISANARVGPGVRLMSCIILDDVEIMENAVVTNAIVGWKSSIGRWSRVQAWSLQFETRSYNSRRLGCS

SEQ ID NO: 21290 - protein, 355 aa, Gerbera hybrid cultivar
MVIQATTRVESLSTSGIHQIPKEYIRPQEELRSITNIFDEEANKQKPQVPTVDLTDIESDDPEKRHKCLEELKKAAMEWGVMHVVNHGVSGDLIGRVKAAGEGFFGLPVEEKEKYGNDPDGGRTQGYGSKLANNASGQLEWEDYFFHLVFPEEKRDLTIWPTTPSDYTDATTEYAKQLRALATKILPALSLGLGLEEGRLEKEVGGIEELILQLKINYYPKCPQPELALGVEAHTDVSALTFILHNMVPGLQLFYDGQWVSAQCVPDSIILHIGDALEILSNGEYKSILHRGLVNKEKVRISWAVFCEPPKEKIVLKPLPETVSEAEPPLFPPRTFRQHMEHKLFRKNKDEVMQN

SEQ ID NO: 21291 - protein, 295 aa, Oryza sativa (japonica cultivar-group)
MDYDELDSMERETTATPMARSLFLPSHHVAVTPYKLPDAATSTLITAVPRTERGFVVELLGELWVLVGPISSLEQEGFQDRNLEVEAIDPAGEMIAAVGRGPEGWGEDEMSVLPRHTKVVVTGNNRTKSVLVGLHGVVKKAVGLGGWHWLVLTNGIEVKLQRNALSVIEPPTGNEDDDKFDCENMQWNSSDLASDDAQSPKPQRSRSRQHRGFQTKSFSRSMSCDSHSKASFSSSSRAHTKVDLSKLEMTALWRYWRHFNLDASPNPSREQLVDAVQRHFVSQAAKRLKTNVKVA

SEQ ID NO: 21292 - protein, 355 aa, Gerbera hybrid cultivar
MVIQATTRVESLSTSGIHQIPKEYIRPQEELRSITNIFDEETNKQKPQVPTVDLTDIESDDPEKRHKCSEELKKAAMEWGVMHVVNHGVSGDLIGRVKAAGEGFFGLPVEEKEKYGNDPDGGRIQGYGSKLANNASGQLEWEDYFFHLVFPEEKRDLTIWPTTPSDYTDATTEYAKQLRALATKILSALSLGLGLEEGRLEKEVGGIEELILQLKINYYPKCPQPELALGVEAHTDVSALTFILHNMVPGLQLIYDGQWVSAQCVPDSIILRIGDTLEILSNGKYKSILHRGLVNKEKVRISWAVFCEPPKEKIVLKPLPETVSEAEPPLFPPRTFQQHMEHKLFRKNKDEVMQN

SEQ ID NO: 21293 - protein, 360 aa, uncultured gut microbe of Zootermopsis angusticollis
  misc_feature (9)..(9): Xaa can be any naturally occurring amino acid
  unsure (1)..(360): unsure at all Xaa locations
IGAAFHLLXAMIDNHIYQGNKCNIDPRKIIWHRCVDMNDRQLRFIVDGLGGKANGASREDWFDITVASEVMAILCLSKDIDDLKQRLGKIIVGYTYGKQSDGSEKPVTASQINAQGAMAALLKDALKPNLVQTLEGTPAFIHGGPFANIAHGCNSIMATRLALKMGDYVVTEGGFGADLGAEKFLDIKCRFAGLKPSAVVIVATVRALKSHGGVAKADLEKENLDALKKGLPNLLQHVENITKVYNLPAVVAINAFPKDTKAELDLVEAECKKLGVNVALSEVWARGGDGGVKLAEEVVKLCALNKENDFTFSYDEKSSIKDKTEAIAKKIYHADGVDIQSNAQKQIAQLEKFGMDKVPI

SEQ ID NO: 21294 - protein, 601 aa, Mycobacterium sp. MCS
MCGATGEVRLDGRTPDLAAVSAMAETLSPRGPDGAGAWSQGRVALGHRRLKIIDLSEAGAQPMVDSDLGLAIAWNGCIYNYQQLRDELRGHGYSFFSTSDTEVLLKAYHHWGDRFVDRLYGMFAFAIVERDSGRVLLGRDRLGIKPLYISEDAHRIRFASSLPALVAGGGVDTRIDPVALHHYLSFHSVVPPPLTILRGVKKVPPASLVAIEPDGRRTTTTYWTPDFTRHADRADWSEQDWEDAMLTALRRAVERRLVSDVPVGCLLSGGVDSSLIVGLLAEAGQTGLQTFSIGFESVNGVAGDEFKYSDIVAQRFGTDHHQIRIDTARMLPALDGAIGAMSEPMVSHDCVAFYLLSQEVAKYVKVVQSGQGADEVFAGYHWYPPMAEPGAASVEGSVASYRAAFFDRDPAALGGLVTPPYFADGDPSGRFVTEHFAREGAATGVDRALRLDTMVMLVDDPVKRVDNMTMAWGLEGRVPFLDHELVELAATCPPEYKTAQGGKGVLKEAARRVIPAEVIDRPKGYFPVPALTHLEGPYLDMVRDALSAPAAKERDLFRPEAVDRLLADPNGRLTPLRGNELWQMALLELWLQRHGITGPAA

SEQ ID NO: 21295 - protein, 525 aa, Legionella pneumophila str. Lens
MNDLKKSPLLILDFGSQYTQLIARRVREMGVYCEIYPYNINHEQFKKLNPCGVILSGGPSTVTHDANPRAPQWLFESDLPLLGICYGMQTMAVQLGGQVHSSTLREFGYAELRLHGHSQLLSNIEDRTAMDGSALLDVWMSHGDKVTELPPGFKVICETRNAPIAGMADESRQMYGLQFHPEVTHTLQGLRILQRFVVDICKASTDWTPEHIIDEAINKIREQVGTEKVLLGLSGGVDSSVVAALLHRAIGEQLVCVFVDTGLLRLNEAEQVLSMFGRHMGIRIIAVNAEDKFLTALKGVTCPEEKRKIIGRTFIEVFDEEAQKLTDIKWLAQGTIYPDVIESAATSTNDAAVVIKSHHNVGGLPDTLNLKLLEPIRELFKDEVRQVGLELGLPHDMVYRHPFPGPGLGVRILAEVKKEYADILRKADAIFIEELHNAQLYHKISQAFAVFLPVKSVGVMGDGRRYDYVICLRAVETVDFMTAHWSQLPWDFLGKVSNRIINEVEGVSRVTYDISGKPPATIEWE

SEQ ID NO: 21296 - protein, 358 aa, uncultured gut microbe of Zootermopsis angusticollis
  misc_feature (2)..(2): Xaa can be any naturally occurring amino acid
  unsure (1)..(358): unsure at all Xaa locations
IXAANNLLAAMIDNHIYQSNKCNIDPRKIIWHRCIDMNDRQLRFVVDGLGGKANGASREDWFDITVASEVKAILCLSKDIDDLKARLGKIIVGYTYGKQSDGSEKPVTAAQINAQGAMAALLKDALKPNLVQTLEGTPAFIHGGPFANIAHGCNSIMATRLALKMGDYVVTEGGFGADLGAEKFLDIKCRFAGLKPSAVVIVATVRALKSHGGVAKADLEKENLSALEKGLPNLLQHVENITKVYNLPAVVAINAFPKDTKAELDLVEKKCKELGVNVALSKVWELGGEGGMKLAEEVVKLCEQPNKFTFSYDEKSSIKDKIEAIAKKIYHADGVNILPVAQKQIAQLEKLGMDKVPI

SEQ ID NO: 21297 - protein, 142 aa, Wigglesworthia glossinidia endosymbiont of Glossina brevipalpis
MKIEQTLSIIKPNIISNNFIGNIINRLEQAKLYIIASKMIKLSWKEAVSFYIEHKNKSFFSDLINFMISHPIIVQILEGENAIKRNREIMGNTNPKIALAGTLRSDFSNDIIKNGVHGSDSEESADREIKFFFKKDRIFSRI

SEQ ID NO: 21298 - protein, 464 aa, Lactobacillus brevis
MKEGIDMRESVAEEPKHKFFQSTEGENKSLDEVNGSVKVPKNAGFWRTLFAYTGPGILIAVGYMDPGNWITSIAGGAQFKYSLLSVILISSLIAMLLQSMAARLGIVTGKDLAQLTRERTSKTMGIILWLITESAIMATDVAEIIGSGIAIKLLFNIPLVVGILITTADVLILLLLMKLGFRKIEAIVATLVAVILLVFTYEVFLAGPQLDQMFAGYMPTKDIVTNKSMLYLALGIVGATVMPHDLYLGSSISQTRAVDRHDRQDVAKAIKFTTIDSNLQLTIAFIVNSLLLILGAALFFGTNSTVGRFVDLFNSLNNSHIVGAIASPMLSMLFAVALLSSGQSSTITGTLSGQIIMEGFIHLRMPLWAQRLLTRLLSVTPVLIFAIYYHGNEAKIENLLTLSQVFLSVALPFAIVPLVKFTSSKELMGEFVNKAWVKYSAWVATVVLVSLNIYLILQTVGVIG

SEQ ID NO: 21299 - protein, 360 aa, uncultured gut microbe of Zootermopsis angusticollis
IGAANNLLAAMIDNHIYQGNKCNIDPRKIIWHRCIDMNDRQLRFVVDGLGGKANGESREDWFDITVASEVMAILCLSKDIDDLKARLGKIIIGYTRGKQSDGSEKPVTAAQINAQGAMAALLKDALKPNLVQTLEGCPSFIHGGPFANIAHGCNSIMATRLALKMGDYVVTEGGFGADLGAEKFLDIKCRFAGLKPSAVVIVATVRALKSHGGVAKADLGKENLKALEAGLPNLLQHVNNIKNVYHLPAVVAINAFPLDTKAELDLVEKKCNELGVNVALSEVWAKGGEGGKALAEQVVKLCDLNKENDFTFSYDEKASIKDKIEAIAKKIYHADGVIIQDNAKKQIAQLEKLGLDKMPI

SEQ ID NO: 21300 - protein, 420 aa, Salmonella enterica subsp. enterica serovar Typhi str. CT18
MSLPHYHAETDLNAENLLRLPAEFGCPVWVYDAHIIRRQIAALQQFDVVRFAQKACSNIHILRLMRAQGVKVDSVSLGEIERALAAGYDPQTCPDDIVFTADVIDAATLARVSELHIPVNAGSVDMLTQLGQVSPGHRVWLRVNPGFGHGHSQKTNTGGENSKHGIWHSDLPAALAVMQKYRLKLVGIHMHIGSGVDYGHLEQVCGAMVRQVLECGQDVEAISAGGGLSIPYHEGEEPVDTRHYYGLWNAAREQIARHLGHAVKLEIEPGRYLVAQSGVLVTQVRSVKQMGSRHFVLVDAGFNDLMRPAMYGSYHRISALAADGRALENGPWVETVVAGPLCESGDVFTQQEGGMVETRALPAVIPGDYLVLHDTGAYGASMSSNYNSRPLLPEVLFDNGQARLIRRRQTIEELLALEML

SEQ ID NO: 21301 - protein, 288 aa, Psychrobacter arcticus 273-4
MTQHFIVIGNPIAHSKSPEIHTLFGAHAGLDICYQCQYCPDDPASFTAVIEAFFHGGGVGANVTVPFKQVAYECCAARGGLSEHAKIAGAVNTLSLNQALLASGVSRAEALYGDNTDGQGLVNHMQRLGWPLNGARIAIIGAGGAARGVVLPLIEAGIEALTIANRTLSKATELVNELSTASVVIHNQQIQTCCTADLSGDFDIIVNATSIGLSGETLPLADELNCQYAYDMMYGRELPFLQHFAARGAQTSDGYGMLIGQAALSFECWTGHAIDVTQATAALEKSSI

SEQ ID NO: 21302 - protein, 355 aa, uncultured gut microbe of Zootermopsis angusticollis
ITSANNLLAAMLDNHIMQGNALRIDTKQIVWKRCLDMNDRALRNIIVGLGKKSDGVAREDHFIITVASEIMAILCLAENLADLKARLARVIVAYNADGQPVTADDLKATGAMAALLKEAIKPNLIQTVEHSPAIVHGGPFANIAHGCNSVRATRMALKLADYTVTEAGFGADLGAQKFFDIKCRIAGLSPACVVLVATVRALKYNGGVKKDNLSAPDVEAVKRGIVNLEKHIENIQKYNVPCVVTLNRFTSDSDEELAYVKSFCEGKGASFALSEVWGKGGDGGLELAAAVQASIASGEANGQKFHVLYKDDLPLKEKISIIAKEIYGAEGISFDSEAAKQLRRIEKLGFAHFPV

SEQ ID NO: 21303 - protein, 471 aa, Salmonella enterica subsp. enterica serovar Typhi str. CT18
MVSINDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 21304 - protein, 723 aa, Thermotoga naphthophila
MWLLFLIPLVALGFAAANFAAVVRKPEGTERMKEISSYIRSGADSFLTHETKAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQLDNLNIHTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKMGENLVHQIPKETIQALISYPIFFALVGLGCSMLGILYVIVKKPSDNPQRELNISLWTSALLTVVLTAFLTYFYLKDLQGLDVAGFRFGAISPWFSAIIGIFSGILIGFWAEYYTSYHYKPTQFLSKSSVEGTGMVISNGLSLGMKSVLPPTLTLVLGILFADYFAGLYGVAIAALGMLSFVATSVSVDSYGPIADNAGGISEMCELDPEVRKITDHLDAVGNTTAAIGKGFAIGSAIFAALSLFASYMFSQISPSDIGKSPSLVLLLNMLDARVIAGALLGAAITYYFSGYLISAVTEAAMKMVDEIRRQAREIPGLLEGKAKPDYNKCIEITSDNALKQMGYPAFIAILTPLVTGFLLGAEFVGGVLIGTVLSGAMLAILTANSGGAWDNAKKYLEAGNLEGYGKGSEPHKALVIGDTVGDPLKDTVGPSLDILMKIMSVVSVIAVSIFKHVHLF

SEQ ID NO: 21305 - protein, 301 aa, Psychrobacter arcticus 273-4
MSTAYDDIKTRLQGSMVALITPMLRDGTVDYKRLADLIDWQIEQGTHCLVAVGTTGESATLSMQEHSDVIRYFVQHVKGRVPVIAGTGANNTMEAIKLTQDAADAGADCALLVAPYYNKPPQEGLYQHYKAIAEAVNIPQMLYNVPGRTVVDIAQETVERLADLGNIVAIKDATGSVARGEQLIKVVGDRLVVLSGDDGSALELMKVGGKGNISVTANVVPKAMSETFTAALRGDFDAANQVHDVVKHLHRDLFIESSPIPAKYALHKMGMIDKGIRLPLVWLAEQHHATIDTALVRANLL

SEQ ID NO: 21306 - protein, 477 aa, Colwellia psychrerythraea 34H
MSNNIKTQVVVLGAGPGGYSAAFRAADLGLDVVLVESRETLGGVCLNVGCIPSKALLHVAKVIDDAAAMASHGVTFGKPEIDLDKIRGWKESVIAQLTGGLGSMSKARKVATVYGYGKFTSDKTIEVEGNDGEKTTITFDNAIIAAGSSVIDLPFIPNDDPRVIDSTGALELKDVPEELLVLGGGIIGLEMGTVYSALGSNVSVVEFADQLVPAADKDIVRVYNNYNKKKFNIMLSTKVVAVEAKDDGLYVTFEGKKAPKEQVRYDKILVAVGRKPNGHLVAADKAGVNVDERGFINVTNELRTNVPHIFAIGDVVGQPMLAHKAVHEAHCAAEVISGKKHTFEPRCIPSIAYTDPEMAWVGVTESEAKEQGLNIEIANFPWAASGRAIASARTEGKTKLIFEKETGRILGGAIVGINAGEMLGEICLAVEMGADAEDIGLTIHAHPTLNESIGLAAEIFEGSITDLPNAKAVKKKK

SEQ ID NO: 21307 - protein, 342 aa, Streptomyces coelicolor A3(2)
MKALVKENAEPGLWLADVPEPTIGSGDVLIKVLRTGICGTDLHIRAWDGWAQQAIRTPLVVGHEFVGEVVDTGRDVTDIKAGDRVSGEGHLVCGKCRNCLAGRRHLCRATVGLGVGRDGAFAEYVALPASNVWVHRVPVDLDVAAIFDPFGNAVHTALSFPLVGEDVLITGAGPIGLMAAAVARHAGARNVVITDVSEERLELARKVGATLALNVSDATIADGQRELGLREGFDIGLEMSGRPEAMRDMIANMTHGGRIAMLGLPAEEFPVDWARVVTSMITVKGIYGREMFETWYAMSVLLEGGLDLAPVITGRYSHRDFEAAFADAASGRGGKVILDWTA

SEQ ID NO: 21308 - protein, 487 aa, Ralstonia metallidurans CH34
MSLPSALYRNYVDGRFEEAANLFPNLSPVDGSIVGHVCEADASQVDRAVQAARAAMEGPWGNTSAAERARVLHAVADGIERRFDEFVAAEVADTGRTEQQARALDIRRGVLNFRTFADLASQAGGDYFDMRTAEGDVFSYTVRKPHGVVGIISPWNLPMLLMTWKVAPALACGNAVVVKPSEETPGSATLLAEVMHEAGVPAGVFNLVHGFGGGSAGEFLSRHPGIDALTFTGESRTGSTIMKAVADGVKEISFELGGKNAAVVFADCDFDKAVAGVMRSSFTNTGQVCLCSERVYVERPIFERFVAAMKARAEALRIGYPTVEGVEMGSLISRNHRDKVLSYYALAREEGATVVTGGGVPHFGDARDNGAYVQPTIWTGLPDSARCIQEEIFGPVCHIAPFDTDAEVVKRVNDSRYGLAASVWTRDLARAHRVTRQFDVGIVWVNTWFLRDLRTPFGGTRLSGIGREGGRHSLDFYSSLTTICVNP

SEQ ID NO: 21309 - protein, 344 aa, Bacteroides fragilis NCTC 9343
MPKYPLLGMTLTELQSVTKDLGMPAFAAKQIASWLYDKKVTSIDEMTNLSLKHRELLKGEYDLGISAPVDEMRSVDGTVKYLYQVSDNHFVEAVYIPDEDRATLCVSSQVGCKMNCKFCMTGKQGFTASLTANQILNQIAALPERDKLTNVVMMGMGEPLDNLDEVLKALHILTASYGYGWSPKRITLSSVGLRKGLQRFIEESECHLAISLHSPFPSQRSELMPAERAFSIKEMVDLLKNYDFSKQRRLSFEYIVFKGVNDSLIYAKELLKLLRGLDCRVNLIRFHAIPGVDLEGAGMETMTSFRDYLTSHGLFTTIRASRGEDIFAACGMLSTAKQEESNKN

SEQ ID NO: 21310 - protein, 475 aa, Glycine max
GFAHFPCSRDRTGVLHKALASLITATPMEPPTSYISTDELRKHNTRHDAWISIHGKIYDVSSWLHRHPGGPLPLLTLAGTDATDAFLAFHPPNTASLLLPAFSTSHRLSDHTVSAASSDYRKLFSDLSALNLFNRKGHTTSILLSLILTLFPLSVCGVLFSDSTFVHVLSAALIGFLWIQSGWIGHDSGHYNVMLSRRLNRAIQILSGNILAGISIGWWKWNHNAHHIACNSLDYDPDLQHLPFFVVSSRFFNSLTSRFYDRKLNFDSFARFLVSYQHWTFYPVMCFARVNLFAQSFFLLLSKRKVENRGSELLGLLAFWVWYPLLVSFLPNWWERLLFVFVSFSVTGIQHVQFCLNHFSSEVYLGPPSGGDWFEKQTKGTLGVDCSPWMDWFHGGLQFQVEHHLFPRLPRCHLRKIAPLVKDLCKKHSLPYNCVSFWKANVLTIQTLRNAALQARDGSNPVPKNLVWEAVNTHG

SEQ ID NO: 21311 - protein, 554 aa, Oryza sativa (indica cultivar-group)
MARPLPSQGKEVMVGSKGVIKRDEFVRIITKALYSLGYEKSGAVLEEESGITLHSPTVNLFRRQVLDGNWDSAVVTLKKVGLLDENIVKSAIFLILEQKFLELLRNDNVMGAIRTLQSEITPLGVNKKRVHELSGCIISSPQHVLLGFSKLGIESSNSRLKLLEELQKVLPPTVMVPERRLENLLEQALTVQREACYFHNSIDGLSLYTDHHCGKDQLPSCTVQVLRAHRDEVWFLQFSNNGKYLASASNDKSAIIWKVDEDGELLLKHTLTGHDKPVMMVAWSPDDCQLLTCGMEEVIRRWDVESGKCLHVYEKSGIGLISCGWFPDGKHILSGLTDHNFCLWDLDGKEVDCWKGQRSSKTSDFAVSNDGKLIISMNRESTIRLFDRETKQERLIEEDNTITSFSLSEDGDFLLVNLISEAIHLWNIRNCPIRVNRYAGHKRSRFVIRSCFGGSEQAFIASGSEDSQIYIWHRATGDLIETLPGHTGTVNCVSWNPANPHMLASASDDHTIRIWGLKKANLKRKDVGSSNGIYANGNTPSNGVVHQCNGNSSK

SEQ ID NO: 21312 - protein, 382 aa, Wigglesworthia glossinidia endosymbiont of Glossina brevipalpis
MCLPLILTIKIINIIINMFNKTNKKINILGKTREELYDFFIKIGEEKFRAEQIMKWIYKRYCDDVSLMTDFSKNLKNKLKNIIKIDHLDIESENISQDGTIKWVLKINDQNIETVYIPEINRATLCISSQIGCALNCKFCATSYQGFNRNLNSYEIISQIWYAMKIINDRNNFKLKKITNIVMMGMGEPLLNLKNLVPAIKIILDNYGFGLSKRRITISTAGISPVIKKLGKLIDVKLAISLHAPNDIIRNKIMPINKKYNIKSILLSAKKYISTSKANKGKISIEYIMLNEINDKTEHAYQLINCLKNIPCKINLIPWNPFPYVKYKCSNFNKINNFYKILIKHGITTTIRKQRGIDIKAACGQLSGNVINRINKRNIINF

SEQ ID NO: 21313 - protein, 352 aa, uncultured gut microbe of Zootermopsis angusticollis
  misc_feature (2)..(2): Xaa can be any naturally occurring amino acid
  misc_feature (126)..(126): Xaa can be any naturally occurring amino acid
  unsure (1)..(352): unsure at all Xaa locations
IXAANNLLAAMLDNHIQQGNALDIDTKSITWRRAVDMNDRQLRNIVDGLGGKMQGVPREDGFDITVASEVMAIFCLATSISNLKERLGKIIVAYNRDGRPITASDLKAQGSMPALLKDALKPNLVXTLEGTPAFIHGGPFANIAHGCNSIIATRMALKFGDYAITEAGFGADLGAEKFLDIKCRVADLKPDAVVIVATVRALKHHGGVAKADLNDENLAALEAGLPNLLQHVENITQVFKLPAVVAINAFPTDTAAELKLVEDKCRELGVNVALSEVWAKGGEGGVALAKEVIRLCEEPNGFEFSYSTDFSIAEKLEAIATKVYHADGIDLTATAKSQAAKLEELGFGNLPI

SEQ ID NO: 21314 - protein, 358 aa, uncultured gut microbe of Zootermopsis angusticollis
IGAANNLLAAMIDNHIYQGNKCNIDPRKIIWHRCIDMNDRQLRFVVDGLGGKANGASREDWFDITVASEVMAILCLSKDIDDLKARLGKIIVGYTYGKQSDGSEKPVTAAQINAQGAMAALLKDALKPNLVQTLEGTPAFIHGGPFANIAHGCNSIMATRLALKMGDYVVTEGGFGADLGAEKFLDIKCRFAGLKPSAVVIVATVRALKSHGGVAKADLEKENLSALEKGLPNLLQHVENITKVYNLPAVVAINAFPKDTKAELDLVEKKCKELGVNVALSEVWAKGGEGGVKLAEEVVKLCEQPNKFTFSYDEKASIKDKIEAIAKKIYHADGVNILPVAQKQIAQLEKLNMDKVPI

SEQ ID NO: 21315 - protein, 189 aa, Zea mays
  misc_feature (153)..(153): Xaa can be any naturally occurring amino acid
  unsure (1)..(189): unsure at all Xaa locations
MDLPYAITPPIFHPVSNLITTVPPVPRLALHREAKEEEEEVMASSMLSSVDVVTSPAQATMVAPFTGLKSSASFPVTRKANNDITSITSNGGRVSCMKVWPPIGKKKFETLSYLPDLTDNELAKEVDYLLRKKWIPWWIPCVEIRCGSRNFVXREHGNTPRNTKRARYWTKWETFPLFRKALNSWLQGV

SEQ ID NO: 21316 - protein, 348 aa, Pseudomonas putida
MLAIRKTKAGPGGLSVDDVAAPKEAHSTDVLVKVEAAGICGTDLLIYKWGEFAKRMKLPTILGHEVSGVIEQVGSDVKGLRPGMRVSLESHLPCGTCYTCRRGWAHVCPKTRYPGVDFDGGFASFVVVPESVCWPVPCGIPPLQAAMMEPFGLAVHASLEGSGVSGLNVLVSGCGPIGLMNIAAAKALGASKVIAPDIHPLRLTAAAKMGADECINATEESVYKTVRSLLGERGVDVAIDYSGQAAALKELIQSITHGGELRLMGVPSHDILLNLEEWLFKGLIVRGLHGRRLYERWERSTSLLVTGRVDLSSLVSHRLPLSAAEDAFEMALNGQSLKILFEPNGSCI

SEQ ID NO: 21317 - protein, 362 aa, Treponema primitia
IGAANNLLAAMIDNHIYQGNKLNVDPRKITWHRCVDMNDRQLRFIVDGLGGKANGASREDSYDITVASEIMAILCLSSDINDLKARLGRIVIGYTYGKQSDGSEKPVTASQLNAQGAMAALLKDALKPNLVQTLEGTPSFVHGGPFANIAHGCNSVMATRLALKLGDYVVTEAGFGADLGAEKFLDIKCRFANLKPSAVVIVATVRALKSHGGVAKADLGKENVEAVRKGLPNLLQHVENITKVYKLPAVVAINAFRKPGEADTEAELKLIADECKKLGVNVALSDVWEKGGEGGTALAEEVVKLCDVSNNFTFSYDEKASIKEKIEAIATKIYHADGVDIEPNAQKQIAQLEKLGLDKVPI

SEQ ID NO: 21318 - protein, 161 aa, Zea mays
  misc_feature (35)..(35): Xaa can be any naturally occurring amino acid
  unsure (1)..(161): unsure at all Xaa locations
WSEVANHSKRNHTDSYFSGKDRRRPRRRGHHASGXEFGSMSSKKPRNASPRLAPVSPKEKKDKIGERVAALQQLVSPFGKTDTASVLQEASGYIKFLHQQLEVLSSPYMRAPPAAGAAPEDPQRYSLRSRGLCLVPVDLTLQLTQSNGADLWAPAHTARRR

SEQ ID NO: 21319 - protein, 362 aa, Treponema azotonutricium
IGAANNLLAAILDNHIYQGDKLDIDPRKITWRRCVDMNDRQLRFVVDGLGGKANGLPREDGYDITVASEIMAIFCLASGIDDLKKRLASVIVGYTNGKDLDSKPVTAGQLNAQGAMAALLKDALKPNLVQTLEGTPSFVHGGPFANIAHGCNSVMATRLALKLGDYAVTEAGFGADLGAEKFLDIKCRFAGLKPSAVVIVAIVRALKSHGGVAKADLGKENVEAVRRGLPNLLQHVKNITEVYKLPAVVAINAFRKPGEADTEAELKLIADECKKLGVNVALSDVWEKGGEGGVALAEEVVKLCAQNKENDFTFSYDVNASIKDKIEAIAKKIYHADGINILPAAQKQITILEKLKLDKVPI

SEQ ID NO: 21320 - protein, 242 aa, Zea mays
MVSEQSVAELKQTLLATTLELEAAREELRRKEQSIAKLSDLVREVAKERDDARDQAQSLRLLAAQAAPPLVTSSVTDSDCSLASSPVDPFFDPVTSADNRRRCKLSPATPPAPPPKPQQQRHCQPGACGRGSAPAADAVLETLAGKRPLPQRGRLLAAVMEAGPLLQNLLVAGQLPRWRNPPTVRAPDTLAGSAASRAAGYADDAVTLAASGCTKRPMAAALPVLPAASCSPGFIAKRQRLH

SEQ ID NO: 21321 - protein, 538 aa, Ustilago maydis 521
MSKRPSSPSLEGKSALASAPSQLNRIKDADGDDDMGEFEDQFEDEFDEEDTDAVLATRDSEDSDDDDDDDDDAETMEVDGVKVDGKIQRPEDDEADAVEPETQVYIPGVSKLAEGQTLEADQSAYEMLHRLNVTWPCLSFDHLKDHLGNDRQSYPHTSYMVAGTQADTASRNEILVMKASSLHKTQNDDGLSDDEDEDDENDLDDDAILEYKSIPVVGGINRVRAAPTCTPVSDLEPCLDAYPVAAWSEVGDVKIFDVRPLLNSLDRPGTSYDARRVNTPMFTVKAHNGVEGYAMDWAGVVNGGSSAGGKASSLRLLTGDIHSKIFLTTANNAGFTTNPTPFTSHTSSVEDLQWSPKEPTVFASCSADRSIRVWDVRVKNRRSVISVENAHVQDVNVISWNRGTDYLLVSGGDEGALKVWDLRHFKPNSSTAPSAVAHFDWHKAPISSVEWHPTEDSIFAASGRDDQVTLWDLSVEHDDDEQAAAGVGVQGLKDVPPQLLFCHHGLTDCKELHWHPQIPGMLATTSLDGFNLFKTISV

SEQ ID NO: 21322 - protein, 143 aa, Acinetobacter sp. ADP1
MTNVAQVLNDKREHVVYTISPDASVLEAISLMADKGIGAIVVVEKESVVGILSERDYTRKVELMDRSSNSTVVSEIMTPKVFTVDKSYSVEDCLQLMTDRHLRHLPVVEHDKLLGLISIGDLVKAAMEEQRQLIEQLKQYISG

SEQ ID NO: 21323 - protein, 204 aa, Oryza sativa (japonica cultivar-group)
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAVAKSGTTPLSPAIAFILEKVAPFVPKEEPKPEPEAEAAAETTSREVAVEEEKKEEEAAPAEPAAAAAEAAAPSTEVVEEKKEEEKPAEAAAPAAEPEKQ

SEQ ID NO: 21324 - protein, 145 aa, Ralstonia metallidurans CH34
MQANSASSVVAGKATPRGTFPHVRRAGDFLFVSGTSSRRADNTFEGVEVDAMGTTALDIRRQTRAVIENIRDILRSVGADLEDVVEITSFLVDMNDFGGYNAVYAEYFGYEGPTRTTVAVHQLPHPHLRIEIKAIAYRPLTSQAT

SEQ ID NO: 21325 - protein, 83 aa, Hordeum vulgare
MEFQGQHDNPANRVDEYGNPFPLAGGMGGAHAAPGTGGQFQARREEHKTRGILHRSGSSSSSSSSEDDGMGGRRKKGMKEKIK

SEQ ID NO: 21326 - protein, 143 aa, Colwellia psychrerythraea 34H
MAIERTFSIVKPDAVAKNFIGQIYNRFETAGLKIVASKMIHLSQEKAEGFYAEHSERPFFGALVEFMTSGPVMVQVLEGENAVLKNREIMGATNPAEALAGTIRADLADSIDENAAHGSDALESAAREIAYFFSDDEICARTR

SEQ ID NO: 21327 - protein, 732 aa, Polaromonas sp. JS666
MTGNSALILALVCGLIAVGYGFWARSWILSQDAGNARMQEIAAAIQTGAAAYLARQYKTIAIVGVVLALLIGFFLDGKTAIGFCVGAVLSGACGFIGMNVSVRANVRTAQAATRGIGPALDVAFRGGAITGMLVVGLGLLGVTSFYWFLVGNGNYTPDRKLAELLNPLIGLAFGASLISIFARLGGGIFTKGADVGADLVGKVEAGIPEDDPRNPAVIADNVGDNVGDCAGMAADLFETYAVTLIATMVLGALLVAAAPLNAVVYPLALGAVSIVASIIGCFFVKASPVMKNVMPALYRGLAVAGVLSLIAFYFVTMWLMPDNAIAASGTQIRLFGACAVGLILTGALVWITEFYTGTQYSPVQHIAQASTTGHGTNIIAGLGVSMRSTAWPVLCVCIAIMTAYSLAGLYGIATAATAMLSMAGIVVALDAYGPITDNAGGIAEMSKLPASVREITDPLDAVGNTTKAVTKGYAIGSAGLAALVLFADYTHKLEGYGNAISFDLSDPMVIVGLFIGGLIPYLFGAMAMEAVGRAAGSVVVEVRRQFREIKGIMEGTAKPEYGKAVDMLTTAAIKEMVIPSLLPVVVPIVVGLVLGPKALGGMLMGTIVTGLFVAISMCTGGGAWDNAKKYIEDGNHGGKGSEAHKAAVTGDTVGDPYKDTAGPAVNPLIKIINIVALLIVPLMMKFHGGPASAAPVMPMAAPAAVSAPAPAMPAPAVATPMAPAAPAASASK

SEQ ID NO: 21328 - protein, 503 aa, Bacteroides fragilis NCTC 9343
MKIFPSSSIKKLDAYTIEHEPIASIDLMERAAQALTKAITERWDITTPVTVFAGPGNNGGDALAVARMLAEKEYKVEAYLFNPKGELSADCQTNKELVEMMDNVKFSEVSTQFVPPTLTMDHLVVDGLFGSGLNKPLSGGFAAVVKYINASPATVVAIDIPSGLMGEENTFNVKANIIRAQLTLSLQLPKLAFLFAENSEFVGEWKLLDINLSREAIEETESNYALLEAEEIHALIKPRNTFSHKGNFGHALLIAGSYGMAGASILAARACMRSGVGLLTVHAPIRNNDILQISVPEAIIESDASDTYFACPTDTDDYQAVGIGPGIGRSEETEAALLEQLSGCQTPLVLDADALNILANHRHALTTLPKGSILTPHPKELERMVGKCQNSYERLMKACELARTAKVHIILKGAYSAIITPSGKCYFNSTGNPGMATAGSGDVLTGVVLALLAQGYPAEEAAKIGTYVHGLAGDFARKKQGVISMTAGDIISNLPLAWRLVSE

SEQ ID NO: 21329 - protein, 669 aa, Wigglesworthia glossinidia endosymbiont of Glossina brevipalpis
MKISRKILANAVRILSMDIVENAKSGHPGAPMGMSDIAEVLWRNYFNHNPNNPKWVNRDRFVLSNGHASSLMYSILHLTGYDLSIEDLKKFRKINSKTPGHPEIGVTEGVDMTTGPLGQGISSAVGLAISEKVLSHQFNKPDCEIINHYTYVFLGDGCMMEGVSHESCSLAGTMKLGKLIAFYDSNKISIDGKVQDWFDEDTYNRFTSYGWHVIKDIDGHDHKKIDLAIKEAINKKDKPSLLICNTIIAFGSPNKSGNCISHGSPLGKKEVICTRKELKWKHPPFFIPEKIYEYWNHKYKGNLLENKWKKKFDIYSARYPGLSKDLTRRLNNLLPKDWSKKINNIITSMNLKIKNISTRQASNNLLEKIGPILPELLGGSADLTPSNLTKWSKSISIKSDFSGNYIHYGAREFGMTSIANGIYTHGGFIPYTSTFLVFSEYARSAIRTAALMNSKHIMIYTHDSIGLGEDGPTHQPIEQLSCLRMIPNLSVWRPCDQLETAISWKYAIERNGPTAIILSRQDLVQQNRCIDKIDDICKGGYIIKDCKSIPDLILISTGSEVQIAIDACSILSKNKYKIRVVSMPSSDLFDSQLESYKNFVLPIKVPKIVIEAGSSVFWNKYIGYNDKIIGIDEFGKSGSCEDLFKFFKITKNNVVNKSKDLINKTKIMF

SEQ ID NO: 21330 - protein, 265 aa, Oryza sativa (indica cultivar-group)
MASESDSFVRMMSEETHVEAYSLPMQNEDLHTSTNGAKGRAKRSCNFSRTEDIQLCISWQSISSDPIIGNEQPRKAYWQRIAEHYHANRDFESDRNANSLEHRWGNIQKEVRKFQGCYDQIERRHPSGIPHQELVLEVETLYSSNAPKNRAFQFNHCWLKLRNSPKFQTLESHKRPRFRKSSTPIEIAGEEDEEGDDARKSTTPDLSQPSAKKRPIGADGIRRGPAPVIGGGGFRGEQWCRLLRGEAAANLQGGGGDGPVSVGCS

SEQ ID NO: 21331 - protein, 319 aa, Wigglesworthia glossinidia endosymbiont of Glossina brevipalpis
MNQLDYIKKFTNVVIDSGNIKYIKKYSPKDVTTNPSLILRESKSKHYYPLLMDAISYAKKKGGNLNSYIINANDKLLVNIGREILKIIDGRISIEIDVRLSFSYLDLIIRAKKIISLYNSYGIENNRILIKIAATWEGIQAAKFLEKSGINCNLTLIFSLVQAIACAESNVYLISPFVGRVNDWYIKNFKLNKNSKIDPGVKLVYKIFYFYQKYGYKTFVMGASFRNIDQIISIIGCDAITISPDFVNKLNNLKLKKIKNFIRVNLESKIKKNKLLEKEFRWKFNQNFMAVEKLSEGIRLFLRDQKKIDSFFLKKFKSG

SEQ ID NO: 21332 - protein, 229 aa, Spiroplasma citri
MALSPELLEKTNNTAPEITFCDASDRARILDLLTNKVNVVAYGMGKGKTERTYNTLNYILDNYKGSIVVDVDVINVLDAPLLRKLCGRVILTPHALELSRLINKSVPEILNSRINIAKEFANKYKIIVVLKGYQSIIITDGNRVYINGAGNPYMTVAGMGDTLTGLIASLVGRGYELFEAAIVGTYLHGLAGDEISQYKKPVLPTDIIDQIGFVLAELIGNEDSINFKK

SEQ ID NO: 21333 - protein, 795 aa, Kluyveromyces lactis
MLPVVPVFNAVNALKEKTYLYLSSQLVLDGKDMTKDDILEFVQNSHGQNISVLLKDAKFEDDDLIVLLNNGVVTLFIDSDDYAAHLVEIGVPSIRLTLLKDGAYQFSFGQIQEIQQSQLVKASEISLETFTNSVLSGMKTDRPDGLYTTLVVDENERSLGLDISNKESVSLAIETQTGIYFSRSRNEIWRKGATSGNVQKLLSIELDCDGDALKFVVRQGGSGSFCHLETESCFGNFRHGLYGLQKLLQERLLNAPEGSYTKRLFNDSDLLTAKIKEEAEELTEAVDKKDIAWECADLFYFAMARLVANGVSLEDVERNLNTKHLKITRRKGDAKPKFLKKEPVAVHEEDGKIVLNVVSASDKAAVEKAVTRPIQKTAEIMNLVNPIIENVIKNGDKALVELTAKFDGVQLETPVLEAPYPEEYLDGLTDELRDALDLSIENVKKFHAAQMQSETLDVETQPGVVCSRFPRPIEKVGLYIPGGTAILPSTALMLGVPAQVAGCKEIVFASPPRKSDGRVSPEVVYVASKVGASKIVLAGGAQAIAAMAYGTESVPKVDKILGPGNQFVTAAKMYVQNDTLAICSIDMPAGPSEVLVICDEEADVDFVASDLLSQAEHGIDSQVILVGVSLSDSKIEALQNAVHEQAMQLPRVDIVRKCIAHSSIILCDSYEEAFKMSNQYAPEHLILQISNAEDYVKDVDHAGSIFVGAYTPESCGDYSSGTNHTLPTYGYARQYSGVNTATFQKFITSQVVTPVGLEHIGHAVMSVAKVEGLDAHRNAVKIRMSKLGLLPSGFE

SEQ ID NO: 21334 - protein, 545 aa, Wigglesworthia glossinidia endosymbiont of Glossina brevipalpis
MCSIFGILNIKNNSISLRKKALKCSNLMKHRGPDSNGIYCDEDVILVHERLSIIDVKSGNQPLFNNSKTNVLIMNGEIYNYEEIKKNLIHDYSFNTNSDNEVVLALYKKFGLNFLNKLNGMFAFILYDIEKKIYLIGRDHIGMIPLYMGYDCDNNLYISSEMKALIPVCNYIKEFPIGSYLCNLNKKIIKYYKRNWFEFDSIKNCLLSYKKIKHSLKKSVLNHLKSEVPFGILLSGGLDSSIIASIASKELNYKNLNKKLKSFSIGLENSPDLHSSRICARYLNTDHCEVKFTEQDGLDVIKKVIYYVETYDITTIRASIPMYLISQKIKSSGIKMILSGEGADEIFGGYLYFHNAPSEKDLHDELVRKLKSLHIYDCARANKSMLAFGIEARFPFLDKKFLDVAMRINPKHKMCNKNRIEKYILRKSFINYLPNNILWRQKEQFSDGVGYKWIDSIKNFSKKIISDKKFNNAIHKFPYNTPLSKEEYLYREIFENFFPLPSAAECVPQEKSIACSSEIASKWSKYRNLNFDPSGRSLDIHISKN

SEQ ID NO: 21335 - protein, 144 aa, Glycine max
MNNRNTKKAKLIIKEEEDETRGGSVYLDDNVLSEVLRHVDARSLAMAGCVSKQWQKMARDERLWELICTKQWVNTGCAEQQLRSLILALGGFRRLHALYLWPLSKPHAPPKPLWGKDEVHLSLSLLSIRYFEKMNNFLSTKKNT

SEQ ID NO: 21336 - protein, 121 aa, Glycine max
GFGDLIFSSHMIFTLVFVNTYHRYGTRRCIKQLGWTLAVCQSLLIIASRKHYTVDVVVAWYTVNLVVFFVEKKLEELPDRTNAAAALLLPLSTKDNKDGRTKEENHKLLNGNGVDPADWVC

SEQ ID NO: 21337 - protein, 467 aa, Wigglesworthia glossinidia endosymbiont of Glossina brevipalpis
MSINEIINIIEKNNIKFIDFRFTDMVGKEQHITVPFLKKEKINKILKNGKIFDGSSILGWKKIQNSDVLLIPDLTTAVLDPFYNDSTLIIKCDIFESNKSESYNKDPRSIAKNAEKYLQYSKIGDKMYFGPELEFFLFDDIRFYTAIHGSQVIINDIESSWNSGKYYSQGNKGYRPSVKSGYLPVPPVDSSQNIRSSMCLFMEKMGIEVEAHHHEVATSGQNEISTKYNTLTKKADEVQIYKYIVHNTAYFFKKTATFMPKPIRGDNGSGMHCHISIEKEGKNIFFGKEYGNLSKYALFSIGGIIKHAKSINAFANPTTNSYKRLIPGFEAPVSLSYSLNNRSAAIRIPTFNDDKSCRFEIRFPDSSSNPYLLFSAILMASIDGINNKIFPGNPIEKNLYKFKEKNLNKMSSSLEESIYHLDKDREFLTKNNVFTNDFIDSYIELKQKEINIVKSTPHPVEFELYYM

SEQ ID NO: 21338 - protein, 433 aa, Psychrobacter arcticus 273-4
MSTKNEQLFAQACKHIPGGVNSPVRAFAGVGGTPIFMHRANGSKIYDTEDNAYIDYVGSWGPMILGHAHPKVIDAVKKAADDGLSFGTPTPFETTVADKICEIVPSVEMIRMTSSGTEATMSAIRLARGYTQRDKIVKFEGCYHGHSDSLLVKAGSGMLDIGEPTSKGVPADFAKHTITIPYNDSQAIKDCFEKWGEEIACVILEPIAGNMNMVIPSQEFHDTLREQCTANNSVLIFDEVMTGFRVGLGGAQAHFGIDPDLTCFGKIIGAGLPVGAFGGKKEVMSCIAPLGGVYQAGTLSGNPLAMRAGIAMFEDLTAEGFYDELAVKVDRLVDGFQAAADKHGINLRTNKLGGMFGMFFVTDGDTAVPQNFDEVTECDMEVFNTFFHGMLDRGIYLAPSAYEAGFMSIKHSDEDIDTSIKAADEIFAEMAKA

SEQ ID NO: 21339 - protein, 341 aa, Streptococcus suis 89/1591
MKAVVVNPESTGVVVVDKELRSLEAGEALVQIEYCGVCHTDLHVANGDFGKVPGRVLGHEGIGIVTEIAPGVTSLKVGDRVSVAWFFQGCGMCEYCTTGRETLCRTVKNAGYSVDGGMAEQCIVTADYAVKVPEGLDPAQASSITCAGVTCYKAIKEAHLEPGQWIAIYGAGGLGNLAVQYAKKVFNAHVIAVDINNNKLELAKEVGADVTINGLEVEDVPGYIKEITGGGVHSTVVTAVSKVAFNQAIDSVRAGGYVVAVGLPSEYMDLSIVKTVLDGIKVVGSLVGTRKDLEEAFHFGAMGLVVPVVQKRPVEDAEAVFNEMVAGTIQGRMVLDFCHSH

SEQ ID NO: 21340 - protein, 386 aa, Cucurbita maxima
MALNGKVATESAPSNLNEEMKGEYRPPFGGSDESKVPEDFIWSEKFEASELLPVLDVPTIDLEKFMSGDKSYVEEATRLVDEACRQHGIFFVVNHGVDIEMMGRVHDCMNEFFTMPLDVKQRAKRKVGESYGYTNSFFGRFASNLPWKETFSLRCVAAQNSSAAHDYVLDTLGSSFSHHGKAYQECGIALNELGTKIVELLGLSLGISREYFKNFYKDNDSILRLNYYPTCDKPEVVLGTGPHTDPTSVTILHQDPVSGLQVCSNDQWYSIPPNPEAFVINIGDTFTSLTNGIYKGCIHRAVVNSMNARKSLAFFLCPSHDKVVRAPEELVEKSPPRKYPDYKWPMLLEMTQKRYRPACNTLEAFKTWVQEGKALDTGSTITAPSA

SEQ ID NO: 21341 - protein, 314 aa, Cucurbita maxima
MANTGIPTVDVSLFLSEGENEAKKQAIQTITEACSSYGFFQIVNHGIPIEFLKEALQLSKTFFHYPDEIKLQYSPKPGAPLLAGFNKQKTNCVDKNEYVLVFPPGSKFNIYPQEPPQFKETLEEMFLKLSDVSLVIESILNVCLGLPPGFLKQFNNDRSWDFMTNLYYYPAADVGENGLIHHEDANCITLVIQDDAGGLQVQKDSEWIPVTPVEGAIVVNVGDIIQVLSNKKFKSATHRVVRQKGKERYSFAFFRSLHGDKWVEPLPEFTKEIGEKPKYKGFEFNEYLALRLKNKTHPPSRVEDEISIKHYEIN

SEQ ID NO: 21342 - protein, 308 aa, Oryza sativa (japonica cultivar-group)
MAEKEVGRIFVGGLSWDTTERTLERAFSEYGKVIETQVVLERDTGRSRGFGFVTFSEPRAVDAAIRGMHNGELDGRTISVNKAQPRMNTDDGYGYGGGGGGGGTYSSGARGGYRGGGDAVPSANDDCFKCGRAGHWARECPYSSGGGGGRTGRYSPPSRYGSGTGGGRGDRFGGSDRFANRYVDDRYDGGRYVDDRYGGGGRDRYATDRYPPTADRFTGDRYGGSDRYASSGFTRERSYERDGGRSGGSYYRDEPRGSGGYDRGGMRMGSGDRYGTGGPARFAGSYRDRPAPYDRPSRAAARTYDDRY

SEQ ID NO: 21343 - protein, 394 aa, Streptococcus thermophilus LMG 18311
MTVMDLTQRFNKNLDKIEVSMIRQFDQSISDVPGIKKLTLGEPDFTTPDHVKEAAKTAIDANQSHYTGMAGLPDLRQAAANFVKEKYNLTYNPDNEILVTIGATEALSASLTAILEPGDTILLPAPAYPGYEPIANLVGAKIVEIDTTANDFVLTPEMLEKAILEQGDKLKAVLLNYPTNPTGVTYSRQQIEDIAEVLKKYDIFVVSDEVYSELTYVDQHVSIAEYLPEQTILINGLSKSHAMTGWRIGLIFAPASLTAQLIKSHQYLVTAAATMAQFAAIEALSAGKDDAQPMKVEYLKRRDYILEKMTELGFKIIKPDGAFYIFAKIPEGYNQDSFKFCQDFAREKAIAIIPGVAFGKYGEGYVRLSYAASMDTIETAMTRLKEFMEEHAEA

SEQ ID NO: 21344 - protein, 222 aa, Brassica napus
MASMLARRSLDTLRARHLVLSGQALQGSHLSRLQSRAISYGSKKDDEEEEQLAKEISKDWNTVFERSINTLFLTEMVRGLSLTLKYFFDPKVTINYPFEKGPLSPRFRGEHALRRYPTGEERCIACKLCEAVCPAQAITIEAEEREDGSRRTTRYDIDMTKCIYCGFCQEACPVDAIVEGPNFEFATETHEELLYDKEKLLENGDRWETEIAENLKSESLYR

SEQ ID NO: 21345 - protein, 365 aa, Dehalococcoides sp. BAV1
MDFKLTVLPGDGIGPEVMDEGLKVLNAVAKKYKHTFKYQYGLIGGCCIDKEGVALSPAALAMCKKSDAVLLAAVGDPRFDDPKLPVHPEDGLLALRKGLGLFANIRPVKVAPSLVNSTPIKAEIVKGTDFIFIRELTGGVYFAKPKKRWTTPAGIRKATDSMTYSENEIERIVRVGFELAKNRKKKLVSVDKANVLLSSRLWRQIVIEVAKDYPEVKVEHVLVDACAMKLILAPTYFDVIVTENLFGDILTDEASMLAGSMGMLPSASLAGIPAKGTKTFGLYEPIHGSAPTIAKQNIANPIATILSIAMMLRYSCGLETEAVEIESAVDKVLAAGYATIDIFKEGNTKLGTAEMGNQITKMIGG

SEQ ID NO: 21346 - protein, 699 aa, Oryza sativa (japonica cultivar-group)
MLRALNTPTPPLRLRPACRVASQCGGRPSTRRRGAGGGPRRAVPQPPVRRPSGDRACTPWRGGVGAAAPAPVTPVAAAGARDELEAFLEVVPARMRRGLARHPEVRELVEVVMDLGRRPLARFPSGDWVISEQAVTADDLHQAVSKVGDFSEDNRSGINHSLHRISAIRNRKAHIIGLTCRVGRAISGSAEMIRDLVVGGGSILVIGPPGVGKTTLIREIARILADEGKKRVIIVDTSNEIGGDGDVPHSGIGRSRRMQVPKVSMQHNVMIEAVENHMPEVIVIDEIGTELEAMAASTIAQRGVQLVGTAHGVTIESIIKNPCLQVLVGGIESVTLGDEEAKKRKVQKTILERKGPPTFSCAVEMISKTECRVHHKLEATVDAILAGKPPKFEARKMDYKATESGRSLVIPEREYETEPLPSYQEHHFAKAMPSEDNFDDDFSTRRTESKSVPSNDNFNDDFGSTRKTKGKTSVPGKSPVHVYTYQISEADILQVATVMGFDDELDVTDDIGAANVILASSSEMKQNHWIRNVAKYHKLPIFVVKTNTMAQIVKAVRMIVGRDKLNAPTRKQPKVVVGEIEIEDDAPKRKPSLEEIDALEEARLAIEYIVIPGGEPVELLPRCSEIVARQLELVESYQLLAETFGTDSNSRLQILPVKITKKSSSKGSAGSMPKQGSSDLIVSDNGGGSSFSRLPFLPK

SEQ ID NO: 21347 - protein, 367 aa, Beta vulgaris
MQALLTVPTPVPEFNTSILKHEHNIPTQFIWPDDEKPGSQTPPELQVPPIDLGGFLSGDPVAVSNSTRLANEACKKHGFFLVFNHGVDSKLLAKAHEAMDVFFEQPFSQKQRALRKQGDHCGYASSFVGRFATKLPWKETLSFPYSADHKSSNMVEDYFFNKMGSEFQEFGKVYQEYCKAMSNLSLGIMELLGMSLGVERSHFRDFFEENESIMRLNYYPPCLKPDLTLGTGPHCDPTSLTILHQDHVGGLEVFVDQKWYSIRPNSEAFVVNIGDTFMALSNGIYKSCLHRAVVNSETPRKSLAFFLCPRGDKVISPPNELMEDLKSLRVYPDFTWQLFLEFTQKHYRADMKTLDTFTKWLQNRREQ

SEQ ID NO: 21348 - protein, 501 aa, Oryza sativa (indica cultivar-group)
MGKKHAAAGSGGGWLAAVRKVFRPSKDAADKKGGGGGDREEEAAAEVLLLEHFPAGGTSPSAEGTGNDQGGTVVGKGEGEEEDGEDGYGEVERARALAAAAEAAVAAAEAAARVVRMSALRRASREERAAVRIQAFYRGYLLKYNEFDVKILTLGVIQLKARRALRALRGLVRLQALVRGHQVRRQVHLTMRCMQALVRAQARVRARRLITDHLHAGVAPLRLPPLPPATAAATYSSRRREGGYSWHPLLNNSYHAQLGERDESDDDVDGDGGKVGEHARQQQQRQRGNDVRSRSPFRSWDGSSRTPEEDRAEGARRHDAAARRERARAYAYGYQQQRQWQEKAGGFQWLDRWMAAQAQQHAPEPDKSRRRAALTAAADGTTMPERTVEMDTTSYRSPLNSHSAAVQGRPPAVPGYMAATQAARARARTAPPATPAHARSRSGAVLAGDTSSSGQSGSGSGGGGAHVQKPCAVYSPESRGTGDWTPPRLAVSSRATRLVYA

SEQ ID NO: 21349 - protein, 313 aa, Triticum aestivum
  misc_feature (48)..(48): Xaa can be any naturally occurring amino acid
  misc_feature (257)..(257): Xaa can be any naturally occurring amino acid
  misc_feature (269)..(269): Xaa can be any naturally occurring amino acid
  unsure (1)..(313): unsure at all Xaa locations
MASQQPSLAILVREPDGFTVWPGPPYPPGSSPPQRLPKTACSATSFSXDGSRLLATVASASATVYDCSSLSVIRSFDLPGLTAAALSPTGSYLQTFQKSSSPQVKNVTVWHVDTATALYQHYQKNLSKANWPMVQFSADESVACRMATNEMQFFDTNDFTKGIVYKVRLPGIAAMQLASAPGSHVAGFVPEAKGVPASVQIFSCDKDAQNQVVARRSFFRCSTVQFHWNKGSTGLLIVSQADVDKTNQSYYGENPVXHYLTTDRALEGXIVPLKKEGPVHDVQGVSLQVQSCCGCGLWIYAAKHHINKKASSS

SEQ ID NO: 21350 - protein, 609 aa, Glycine max
ENKLYGEFLINAQGEDVVAGIRTPEDLEVMKTCMPEAYKELEENCEILEKHYKDMMDIEFTVQENRLWMLQCRSGKRTGKGAFKIAVDMVDEGLVDIRSAIKMVEPQHLDQLLHPQFEDPSTYKDKVIAIGLPASPGAAVGQVVFTADDAEEWHAQGKSVILVRNETSPEDVGGMHAATGILTARGGMTSHAAVVARGWGKCCVSGCSDILVNDAEKVFVVGDKVITEGEWVSLNGSTGEVILGKQPLSPPALSDDLETFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVSELTSETGMKEEEIFSRIEKLSEVNPMLGFRGCRLGISYPELTEMQARAIFQAAVSVSNHGITVLPEIMVPLIGTPQELRHQVNLIRNVADKVLSEMGSSLSYKVGTMIEVPRAALVADEIAKEAEFFSFGTNDLTQMTFGYSRDDVGKFLPIYLSSGILQHDPFEVLDQKGVGQLIKICTEKGRAARPNLKVGICGEHGGEPSSVAFFAEIGLDYVSCSPFRVPIARLAAAQVAV

SEQ ID NO: 21351 - protein, 194 aa, Oryza sativa (japonica cultivar-group)
MAARRGRGRGREWEDDDLGVGGGQPPHLAAPVVCLARSAGDLAAGAFVGSLVGYGQGLLTNKGMKGSLSSAGSSAKTFAALSGVQSFILCLLRRLRGKDDMINAGVAGCCTGLALSFPGAPQAMFHSCVTFAAFSCIMDGLNKQQAAMAATLASKPSTIKHQEGDVLPPFTLPPLLNASDALASCCQAFLKPKD

SEQ ID NO: 21352 - protein, 548 aa, Wigglesworthia glossinidia endosymbiont of Glossina brevipalpis
MKNINPTKTKSWNLLKKHFNNMKKVNIKDLFEKDKNRFSSFSICFDDIILIDYSKNIITKETIKKLIQLAKECDLNNAILSMFCGKKINYTENRAVLHTALRNHKNISIEIDGINIIPKIKKVLNKMKNFCSDLIDGNWKGFTGERITHIVNIGIGGSDLGPYMVTEALKFYKNHLNVYFVSNIDGTHITEILKYLSPKNTLFLIASKTFTTQETITNAYSAKDWFLKYAKDKKYLSRHFIALSSNIDEVKKFGINTENIFELWNWVGGRYSLWSCMGLSIALSIGFNNFEKLLRGAYAMDQHFLKQPFEKNIPIILGLISIWYNNFFNFETESILVYDQYMHLFSSYFQQVNMESNGKSIDRNGNLVNYQTGSILWGGYGTNSQHAFYQLMHQGTKIVPCDFIVPIISHNPVSDHHQKLLANFFAQTKALAFGKKSENNHIKLYKYDSNKIKILPFKILPGNRPTNSILIKEINPYNLGSLIAMYEHKIFTQGVVLNINSFDQWGVELGKQLSKKLFSILRKEKILNTSSYDSSTNGLINFYKLWKK

SEQ ID NO: 21353 - protein, 376 aa, Solibacter usitatus Ellin6076
MKKLDFIYFDAGGGHRAAANALRQVMEQQGRPCEIRMVNLQELLDEMDVFRKFTGLRLQDIYNLLLKKGWTLGSPQLTVGMHAVIRLFHGKAVRLLEAFWQKSRPDMVVSLVPNFDRALCESVGRALPGVPFVTILTDIADYPPHFWIEEKQDQHFICGSAKAVEQARAMGHPESKVHRVSGMILNPRFYEIPPLSKEDRDAARRGLGFAPAQPVGLVMFGGEGSAVMRQIARSLEDRQLILICGKNTKLRERLQATPHRAPIFVEGFTKEVPRYMQLADYFIGKPGPGSVSEALAMKLPVIVEKNAWTLPQERYNGDWLREMGAGMVLPDFRGIARAVEELLEPAAYERYREAAERYNNRAIFEIPDILERIVAG

SEQ ID NO: 21354 - protein, 452 aa, Triticum aestivum
QAGVRFRTIVLAAVLPFVSMGMLTLSSALPVFHSDGCTSFTSLSGACSPSPVQVTIFYVSLYLVALAEAGHKPCAQAFGADQFDQHHPEESVSRSSFFNWWYFGMCSGTAATTMVSSYIQDNIGWGLGFGIPCLVMVFALAMFLLGTRRYRYYTSTQSSPFARLARAFVALLKGSKSSQCANTLAGEDGEFNAEHREEVRGLLRLFPIWATCIIYAVIFSQSSTFFTKQAETLDRWIGATFRVPTAALQTFISLTIITFIPVYDRLFVPAARRFTRLSSGITMLQRIGTGLVLALVAMVVAALVEARRLGVARDAGLVDDPKAALPMSLWWMVPQYVLFGLSDVFAMIGLQEFFYDQVPDALRSLGLAFFLSIFGVGHFLSSFLISAIDGATKKGGASWFSNNLNRAHLDYFYWLLAGLCAAELAAFVVVSRVYVYKKRVAHHDHGDGGAVM

SEQ ID NO: 21355 - protein, 174 aa, Zea mays
  misc_feature (24)..(24): Xaa can be any naturally occurring amino acid
  misc_feature (55)..(55): Xaa can be any naturally occurring amino acid
  unsure (1)..(174): unsure at all Xaa locations
MTSLGGVSVKPGAIKGLAGSSISXRKLGLARASDRCIPMPRAAAVVAKYRNKSVXLDLDDVGNTSGQWDLYGSDATVPYNPVQSKFFDTFAAPCTKRGLLLKFLVLGGGSLMAYVSESASPDLLPIKKGPQYPPSDVPARQDLSSTSPFAWSSSLLCTARAGRSVAIVMDHLSI

SEQ ID NO: 21356 - protein, 284 aa, Triticum aestivum
  misc_feature (171)..(171): Xaa can be any naturally occurring amino acid
  unsure (1)..(284): unsure at all Xaa locations
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRASLQRMQAQLVVRAMSLNMGMLXASYDQSVELFRDKLGAGEYQTVIGASAISGFCAAACSLPFDYVKTQIQKMQPDATGKYPYTGSLDCAMQTLKTGGPFKFYSGFPVYCVRIAPHVMMTWLFLNQIQKYQKKIGI

SEQ ID NO: 21357 - protein, 314 aa, Cryptococcus neoformans var. neoformans JEC21
MAFGDRGGRGGGRGGPRGGGRGGAGGRGGFGGGRGGGAARGGAGGRGRGAPRGRGAPGGRGGGRGGKAGLGRSGPGAVTLEPHKHEGVYIAKGKEHLLVTRNMTPGESVYGEKRISIATTNADGEEEKVEYRVWNPFRSKLAAGILGGLDNIHIKPGAKVLYLGAASGSSVSHVSDIVGPDGVVYAVEFSHRPGRELIGMAKKRTNVVPIVDDARHPQKYRMLVQMVDVIFADVAQPDQARIIALNAHHFLKNGGAIVISIKANCIDSTAPAAQVFASEVNNMRKEGIKPKEQLTLEPYERDHAMVVGIYQRHT

SEQ ID NO: 21358 - protein, 258 aa, Glycine max
  misc_feature (110)..(110): Xaa can be any naturally occurring amino acid
  unsure (1)..(258): unsure at all Xaa locations
TLGIRLELKETLKALHYLHRHGHIHRDVKAGNILLDTSGAVKLSDFGVATCLYDAVDRQRCRNTFVGTPCWMAPEVLQPAGSGYNSKADIWSFGITALELAHGHAPFSKXIRLEVLLMTMQNAPPGLDDRDKKFSKSFKEMVAMCLVKDQTKRPSAEKLLKHSFFKHAKPPELSVKKLFADLPPLWNCVKSLKLKDAAQLAVKKMPSADEEAISQSQYQRGVSAWNFDIDDLKAQASLVMDDNDNAKMKDDENKFFTN

SEQ ID NO: 21359 - protein, 225 aa, Triticum aestivum
  misc_feature (208)..(208): Xaa can be any naturally occurring amino acid
  unsure (1)..(225): unsure at all Xaa locations
MASSQPTRWAALARDTNETKIQLALNLDGGDFPPDTDSRLLDNDDSHASQASKSQKIAVNTGIGFLDHMLHALAKHAGWSLALNCKGDLHIDDHHTAEDVCIALGYAFAQALGTPAGLARFGYAYAPLDEALSRAVIDLSNRPYAVVDLGLKREWLGQLSTEMVPHCLQSFAQGARVTLHVHCLHGDNDHHRAESAFKALAIAVKAAXHRIPGKEGEVPSTKGTL

SEQ ID NO: 21360 - protein, 525 aa, Cucumis sativus
MRNPSTVVQENGSVSDFISQLGYFAFSSRFLNLNSEGCSGSSSHSLYLNGFENYRCVKRPPRSGASLSLSSRGSSSLRRFVNEFNNVIKFHCHKPPLGFASLGGVSDETNGIRDDGFGVSQDGALPLNKIEAENPKRVLILMSDTGGGHRASAEAIKAAFNEEFGNNYQVFITDLWTDHTPWPFNQLPRSYNFLVKHGTLWKMTYYVTAPKVIHQSNFAATSTFIAREVAKGLMKYRPDIIISVHPLMQHVPIRILRSKGLLNKIVFTTVVTDLSTCHPTWFHKLVTRCYCPSTEVAKRALTAGLQPSKLKVFGLPVRPSFVKPIRPKIELRKELGMDENLPAVLLMGGGEGMGPIEATAKALSKALYDENHGEPIGQVLVICGHNKKLAGRLRSIDWKVPVQVKGFVTKMEECMGACDCIITKAGPGTIAEAMIRGLPIILNDYIAGQEAGNVPYVVENGCGKFSKSPKEIANIVAKWFGPKADELLIMSQNALRLARPDAVFKIVHDLHELVKQRSFVPQYSG

SEQ ID NO: 21361 - protein, 356 aa, Arabidopsis thaliana
MVAVERVESLAKSGIISIPKEYIRPKEELESINDVFLEEKKEDGPQVPTIDLKNIESDDEKIRENCIEELKKASLDWGVMHLINHGIPADLMERVKKAGEEFFSLSVEEKEKYANDQATGKIQGYGSKLANNASGQLEWEDYFFHLAYPEEKRDLSIWPKTPSDYIEATSEYAKCLRLLATKVFKALSVGLGLEPDRLEKEVGGLEELLLQMKINYYPKCPQPELALGVEAHTDVSALTFILHNMVPGLQLFYEGKWVTAKCVPDSIVMHIGDTLEILSNGKYKSILHRGLVNKEKVRISWAVFCEPPKDKIVLKPLPEMVSVESPAKFPPRTFAQHIEHKLFGKEQEELVSEKND

SEQ ID NO: 21362 - protein, 559 aa, Burkholderia pseudomallei K96243
MYQYDQYDQTIVDERVAQYRDQVRRRLSGELSEDEFRPLRLQNGLYMQRHAYMHRIAIPYGNLRSVQLRMLARIAREHDRGYGHFSTRSNIQYNWVKLEETPEILAKLASVQMHAIQTSGNCIRNITADQFAGVAQDEELDPRPWAEILRQWSTFHPEFAWLPRKFKIAVSGSKADRAAVQIHDLGVYLKKNDAGEVVASILAGGGLGRTPIVGAIIRENLPWQHLLTYCEAVLRVYNRYGRRDNLYKARIKILVKALSPAKFAQQVEAEWQHLKDGPSTLTQAELERVSQFFQPPAYEKLADTDASFEQHLLENRAFARWVERNVAPHKVPGYAAVTLSLKNHRVAPGDASAEQMEQVADWADAYSFGELRVSHEQNLILANVKKRDLFAVWEKAKAAGFATPNVGLLTDIIACPGGDFCSLANAKSIPIALAIQQRFDDLDYVYDLGDVSLNISGCMNSCGHHHVGNIGILGVDKDGAEWYQVSLGGEQGTGAGGARLGRVIGPSFSAEEVPDVISKLIDTFVESRIDGERFIDTYERIGIAPFKERVYAARQTAHA

SEQ ID NO: 21363 - protein, 560 aa, Dehalococcoides sp. BAV1
MMSEMNNKQSAESLRVSTTGDIEVSTYLEIAREKSGAKSECIDSGEETLRESIVIFDFGSQYSLLIARRIREMHVYCELVSHDTPWEKIAHLNPRGFILSGGPSSVYEPEAPLAPAYIFESKLPVLGICYGMQAITQQLGGVVEHSDKREYGHALLHSNVINTELLADMPEPSPVWMSHGDRIEKLPAGFKSLAYTENCPVAVMGNESDIYGLQFHPEVVHSPHGKIILKNFVFNICKCHANWTMGNYIQESIQNIREQVGDGQVICALSGGVDSAVVASLIHKAIGDQLTCIYVNNGLLRREEADRTLHVFKNHMGMKIIYVDAIDRFLESLGGITDPEQKRKVIGSEFIKVFEDEACKLGQIDFLAQGTLYPDVIESVSSVSKASAKIKSHHNVGGLPAHMKLKLIEPLRYLFKDEVRLLGKELGLPDEMIWRQPFPGPGLAIRIIGEVTREKLEILRSADWIVMSEIKKAKMYHQVWQSFAILTDVKSVGVMGDFRTYGYLVAIRAVTSEDAMTADWAKLPYDLLSIISNRIVNEVKEVNRVVYDISSKPPSTIEWE

SEQ ID NO: 21364 - protein, 1053 aa, Musa acuminata
MAFLIVLALSFSLLAPSSPSPGPASTDQAALLAFKSSVALDPASLLSGWSPVARRHCTWRGVTCDAVSGRVTALNLTGTPSSPLSGRLAAALGNLTELRVLSLPHNAFSGDIPAAAIGSLCRLEVLDLRRNNFSGKIPDEISRLPSLSVLDLSHNSLSGAIPESLIGSSNLQSVDLSFNQLSGKITVDPLGSCSCLTHLRLSSNLLVGRIPPAIGRCTKIQTLLLDRNILEGRIPAAIGQLLDLRVLDVSRNSLTDRIPRELALCQKLSVLRLTNLMDFDSTGGSSNVEEFNAFIGSMPAEIFSIPSLEILWAPRANLDGSLPDSRNGSCSLGILNLGQNYIAGVIPEWLGTCRNLSFLDLSSNYLQGLLPASLGIPCMAYFNISQNSVTGSLPGFLDLDCSYNLASLSKSGDLLVEDNLLIAYSADLLQSTQRDNPFALVLDNSFVVLHDFSQNRFIGPLPSFVMPLDDSFPYGLSLNNNGFNGSISGKLFGSCQVGSGFAVNLTVNKMSGGVNDILTDCWLLKSFEAANNRLHGSIPSEIRNLNLLRHLDLRNNYFNGSTPDKLRGLKSLGQVLLGGNNFSGGIPTQFDGLSSLTVLDLSRNSFTGSIPPSLANATNLEVLLLNNNQLSGTIPPSFSALHRLIELDVSFNNLSGDIPHLEHSTDCKFFLGNSFLKPCQDPSMSAPSGIPFKTEIPDQGHRKSRLKYFTIAAVASASVLVSVLLVLTFVLVSGRRKFVRITSLRKKLVVTFTDVPAELTYENVVRATGNFSIQNLIGTGGFGATYKGELVPGFLVAVKRLSIGRFQGLQQFDAEIRTLGRVRHKNLVTLIGYHMGEIDTFLIYNYLSGGNLETFIRHMSNRNVTWYEVHKIALDVAQALSYLHYSCVPRIVHRDIKPSNILLDEKLNAYLSDFGLARLLEVSQTHATTDVAGTFGYVAPEYATTCRVSDKADVYSFGVVLLELMSGKRSLDPSFSEYGNGFTIVAWGRLLIQENRAGELFSQLLWENGPKDKLVSMLKLALSCTVESLSVRPSMKQTYTENGWHGLMLAGCQ

SEQ ID NO: 21365 - protein, 354 aa, Oryza sativa (japonica cultivar-group)
MCMTLIMPGAPDVGSYYGEQWAPLAMSSLSSLFSYSPPGTAKYAAALASPSQQVSTTMPELETEGELKTLPAPMTIETTAAAAAAARSPEIVKVRSVWAHNLDEEANLIESLFPSFRLAAVDTEFPGTVHRPSAPAYTLTRKQKYALLKKNVDELHLVQLGLTLFDAGGRLPDLGTGGAARYVWEFNFREFDLRRHAHAPESIALLRSKGVDFDRTRRGGVDAAAFGPRLRSGAYDLAYMLKMLYGGGGGGYRLPGDAATFEFVVRAVIGRTLYDVGKMARHCPGDMRGGLERVAGKLGVRRAVGEAHQAGSDSLLTSQMFMRMRERYFDDQDALTAVAGINFGYLNFTSCEYT

SEQ ID NO: 21366 - protein, 176 aa, Glycine max
MAIKSETYKSLELGAPSKSHASGTPLVLLNLSSNWERSILKNEKLLLTTRKKNDPVTIFHGSKAPNLSVTHYMERILKYSHCSPSCFVIAQIYMDRFFQKKGGYLTSFNAHRLLITSVMVAVKFLDDKYYSNAYYAKVGGVSTEEMNRMELEFLFNLEFRLFVTTELFLKYCEKLG

SEQ ID NO: 21367 - protein, 544 aa, Medicago truncatula
MTIQTMEQELIFKSKLPDIYIPKHLPLHSYCFENLSKYGSRPCLINAPTAEIYTYYDVQLTAQKVASGLNKLGIQQGDVIMVLLPNCPEFVFAFLGASFRGAIMTAANPFFTSAEIAKQAKASNTKLLVTQACYYDKVKDLENVKLVFVDSSPEEDNHMHFSELIQADQNEMEEVKVNIKPDDVVALPYSSGTTGLPKGVMLTHKGLVTSIAQQVDGENPNLYYHSEDVILCVLPMFHIYSLNSVLLCGLRAKASILLMPKFDINAFFGLVTKYKVTIAPVVPPIVLAIAKSPELDKYDLSSIRVLKSGGAPLGKELEDTVRAKFPKAKLGQGYGMTEAGPVLTMCLSFAKEPIDVKSGACGTVVRNAEMKIVDPQNDSSLPRNQPGEICIRGDQIMKGYLNNPEATRETIDKEGWLHTGDIGFIDDDDELFIVDRLKELIKYKGFQVAPAELEAIILSHPQISDVAVVPMLDEAAGEVPVAFVVRSNGSIDTTEDDIKKFVSKQVVFYKRINRVFFIDAIPKSPSGKILRKDLRAKLAAGVPN

SEQ ID NO: 21368 - protein, 595 aa, Taxus x media
MEVVGLRKSTKGVRNGAETDFSSDFKMVKKMDDGGSKQNSNNVSGNGTNGNSKLLASDALLLPLGVTNKFFFVLFFVSSYFLMRRWGGKIRKSIPLHAVSFWELVAILAQLSSFIYLLGFFGIDYVQNFISKNNDGPWDDFVEEDLNTTPTPDREIVVKKPEAQLKGTVLGENEDEDIAAAVCDGTVASYSLESSLGDCKRAAFVRRSALELMTGRSLDGLPLEGFDYQSILGQCCEMPIGYVQIPVGVAGPLLLNGFEYMVPVATTEGCLVASTNSGCKAIHMCGGATSILLRDGMTRAPVVRFQSAKRAADLKYYIEDPTNAENLSHIFNRTTRFGRLQGMQCAIAGKNLYMRFCCFTGDAMGMNMVSKGVQNVLDYLQTVFPDMNLISVSGNFCADKKPTAVNWIEGRGKSIVCEAVITEEVVKKVLKTTVPALLELNMLKNLTGSAMAGAMGGFNAHAANIVSAVFIATGQDPAQNVESSHCITMMEPANGGKDLHVSVTMPCIEVGTVGGGTHLASQAACLNMLGVKGANAASPGANAQNLARIVAGAVLAGELSLMSALAAGQLVKSHMKYNRSSKDIKAAGEAAALSP

SEQ ID NO: 21369 - protein, 522 aa, Wigglesworthia glossinidia endosymbiont of Glossina brevipalpis
MNNQYILIIDFGSQYTKLVARRMKDIGAKFIISSWEIKKKELLKKNIKGILLSGSPMSVLDDKSPYVSKDILNMKVPILGICYGMHTLVKQLGGKVERKSVREFGYASIKILKNHSNLFYDNFEVSEKNYTKRQKVWMSHEDSVINIPKGFSIIASTKNCKYAAIFNKKNKFYGVQFHPEVTHSEKGYLILNRFVKNICNYTNVIKYSLSIRKIILKIKNKVNDEKVILGLSGGIDSFTSAILIHKAIGNNLFCICIDNGLLRNDEILKIKNLIKKVGKINVIYINHKKRFLKSLNGITDPEKKRKTIGNLFFKIFQEQADILKAKWLAQGTIYPDIIESSQNNLLKKDNFIKSHHNVCPLPKGIKLKILEPLKHLFKDEVKKIAKKIGIPKEIIFRHPFPGPGLAVRIIGEIKEEYCNILRMADEIFISELKSENLYFNISQAFSVLLPIKSVAVMGDMRKYEWVISLRAIETLDFMSANWANIPYKILNNVSNRIINEVRGISRVVYDISNKPPSTIEWE

SEQ ID NO: 21370 - protein, 554 aa, Psychrobacter arcticus 273-4
MTDFHTGLGKNAANHQPLTPIDFIIRSAQVYPDRTAIIYDDLEHNNLTQTWQQTYDRCRQLADGLRKLGVDKNDTVAVMMPNTPAMVECAFGVPMSGGVLCTLNTRLDINALSFCLQHSEAKVLILDSEFAEHAEMIDETFPNLIVIHATDAAVDIERFGQMSYEELIASADSLDNWEKPTDEWDAIALNYTSGTTGKPKGVVYHHRGATLNAVSNILDWDMPKHPMYLWTLPLFHCNGWCFPWTIAERAGVNVCLRKIDADLILQLIAKHKVSHYCSAPVVHNMIAGGKPEYKEAINHEVKGWVAGAPPSETMLAAMEAMGFHISHVYGLTEVYGPVTICAEQQEWATLDVAGRAQKKSRQGVTSHLMSGFELFKQGTTEPVAADGKEMGELALRGNMVMKGYLKSRKATEEAFTDGWFRTGDLGVKYPDGYIKIMDRLKDIIISGGENISSIEVENVLYKMPEIQSCAVVAAPHDKWGEVPVAFIEIHAGSTLQRDNVMAHCKQHLASFKMPKYIIFAEIPKTSTGKVQKFELRQAAKSLAHETPKVTASAK

SEQ ID NO: 21371 - protein, 263 aa, Candida albicans SC5314
MFIRSLYHRISNTKTITNLIIRNMSSTSKVESAKKLAAYKAVDENFPKDAKVIGIGSGSTVIYAAERIGQLDNKDSFICIPTGFQSKQLIIDNGLRLGTIEQYPDIDIAFDGADEVDPQLNLIKGGGACLFQEKLVAASAKKFVVVADYRKKSDKLGQSWRQGVPIEIVPNSYSKIIQELSKKLGAKNVDLRQGGKAKAGPIITDNNNFLLDADFGEIEIDNVGKLHEQIKLLVGVVETGLFTNMANKAYFGEEDGSVSVWSK

SEQ ID NO: 21372 - protein, 503 aa, Acinetobacter sp. ADP1
MQQATINATQTTKIAIIGAGFGGLAMAIRLLQHHIRDFVIFEKAQDIGGTWRENQYPGAACDVQSHMYSLSFAPKTNWSKRYAEAGEIFSYIQDISEQFQLRQYCKFEHEVTRAEYDEQNFIWNLEFKNHPAVQAQFVIFASGPLHVPQIPHIKGIENFKGKVFHSSQWDHGYDLSNKVVASIGTGGSAIQYIPEIAQQVKQLYVLQRTAAWVIPRDERAYSGLSKLLFKKSDFYRQIHRIRLYWSNESRVVPIVQPQIMKYGQKLAEAFIRFQVKDKTLAKKLTPDFVMGCKRILISNKYFPTFNRKNVELVTDGIQEITENAIVTKDGKQRHIDCLIYGTGFITDPRIYLKHFECFGKNHQELKEAWKNGPESYYGITTAGFPNLFQLLGPNTVLGHNSVIFMIESQVNYILQLIKLVDTTKTQAVEVKVQVQNNFNETIQKQLQGTVWQAGGCVSWYQTSEGKNFSLWPTYTWKYWLETRKINVSDYHFLGDIQAKKIAV

SEQ ID NO: 21373 - protein, 196 aa, Dehalococcoides sp. BAV1
MTKRTASIKRQTTETTISLSLNLDGTGQADMCTGVRLFDHMLSQLAKHGLFDINISANGDDIHHLVEDVALTLGKAFNEALGERKGIVRMADATVPMDDSLASVALDLSGRGYAVMDLSFAKNDLTGFPTDLVRHFLETFAIEGRFNLHARILYGSNDHHKAEALFKALARALDKATSIDPRREGVAPSTKGMLEN

SEQ ID NO: 21374 - protein, 391 aa, Oryza sativa (japonica cultivar-group)
MAAKSLREIRRAAAAGIGSRRCFSGDAAAAAAAAAGVAEGKVGGGAGKEVNLFTAINQALHIALDTDPRSYVFGEDVGFGGVFRCTTGLADRFGRNRVFNTPLCEQGIAGFAVGLAAMGNRAIAEIQFADYIFPAFDQACLRLDQCFVPTYLYIQLLVQIVNEAAKFRYRSGNEFNCGGLTIRSPYGAVGHGGHYHSQSPEAFFCHVPGLKVIIPRSPREAKGLLLASIRDPNPVVFFEPKWLYRLAVEEVPEEDYMLPLSEAEVIRKGSDITLIGWGAQLAVLEEACEDAAKDGISCELIDLRTLIPWDKETVEASVSKTGKLLVSHEAPITGGFGAEIAASITERCFQRLEAPVARVCGLDTPFPLVYETFYMPTKNKVLDAIKATVNY

SEQ ID NO: 21375 - protein, 250 aa, Oryza sativa (indica cultivar-group)
MDAPLLWSLPSLGRALLSSSPTPARMLSAAASDALVKIKPGEISMVSGIPKEHLRRKVLLWTYSDLCSVDRFASPRRSVWESLEMSWFGGFLWLLLGLGIEPGELGRNVLVHARPRRSAGSSPQNTLFASARPCNDVMLKKLGGISLVRLFCDKANMRSAGRCDKPSGMELPRRFWSNSSCTIFVRFASDGGMWPKSELWLSWSTVRFGNASSHRGMPPTIEVVVFEVRDVKGGAIVERIRYLAGKRVVA

SEQ ID NO: 21376 - protein, 411 aa, Theobroma cacao
MGSSPRTLQAIVGAPGVRGKKVAALSKDGLTAFIQSIVSTKQEMKEPFYVLDLGVVMALFDKWARNLPMAQPFYAVKCNPNPALLGALATLGSGFDCASKAEIESVLSLGVSPGRIIFANPCKAESHIKYAATVGVNLTTFDSKEELEKIKKWHPKCALLIRVKAPDDGGARCPLGPKYGALPEEVTPLLQAAQTARLTVTGVSFHIGSGAMQFRAYREAIAAAKTVFETAARLGMPKMHVLNIGGGFTAGPQFAEAASTVKAALQAYFPNEPSLTVIAEPGRFFAESAFTLATNIIGKRVRGDLREYWINDGIYGSMNCILYDHAVVTCMPLARASSPRCKGARTYDSTVFGPTCDALDTVLKVYPLPELQVNDWLVFPNMGAYTAAAGSNFNGFNTSAILTYLAYSNPN

SEQ ID NO: 21377 - protein, 366 aa, Medicago truncatula
MRPIQLPPPTSTGSATASGSPNNNNSRPQRRRRDHLTLPLPQRDTNLAVPLPLPPSGGSGGGGNGSGSGSGGASQQLVIPFSELERLNRIGSGSGGTVYKVVHRINGRAYALKVIYGHHEESVRRQIHREIQILRDVDDVNVVKCHEMYDHNAEIQVLLEYMDGGSLEGKHIPQENQLADVARQILRGLAYLHRRHIVHRDIKPSNLLINSRKQVKIADFGVGRILNQTMDPCNSSVGTIAYMSPERINTDINDGQYDAYAGDIWSLGVSILEFYMGRFPFAVGRQGDWASLMCAICMSQPPEAPTTASPEFRDFVSRCLQRDPSRRWTASRLLSHPFLVRNGSNHNQSPPNMHQLLPPPPRSQSS

SEQ ID NO: 21378 - protein, 456 aa, Brucella suis 1330
MTAQPNSLEARDIRYHLHSYTDAVRLEAEGPLVIERGDGIYVEDIAGKRYIEAMSGLWSVGVGFSEQRLAEAAARQMKKLPFYHTFSYRSHGPVIDLAEKLVAMAPVPMNKAYFTNSGSEANDTVVKLIWYRSNALGEPERKKIISRKRGYHGVTIASASLTGLPNNHRSFDLPIDRILHTGCPHHYHDALPGESEEQFATRLANELEQLILAEGPHTIAAFIGEPVMGAGGVVVPPKTYWEKVQAVLGRYNILLVADEVICGFGRTGNLFGCQTFDIKPDILVMSKQLSSSYLPISAFLINERVYAPIAEESHKIGTLGTGFTASGHPVAAAVALENLAIIEERDLVANARERGARMQKRLRELQDHPLVGEVRGVGLIAGVELVIDKEAKTGLEQPGALGARANAALQERGVISRAMGDTLAFCPPLIINDQQVDTMVSALEAALNDVQASLGK

SEQ ID NO: 21379 - protein, 455 aa, Mycoplasma mobile 163K
MSAIMRIHAREVLDSRGNPTIQIEVESEYGYGSAMVPSGASTGEKEAKELRDKGTKYEKNWYGGKGVQTAVDNVNNIIAPKIEGYDVLDQRAIDYEMIKLDGTEFKEKLGANAILGVSLAVAKAAADELNIPLYRYVGGTNGFKLPVPMLNVINGGEHASNTVDFQEFLIMPIGAKTFKEAMQVANKVFHNLKDLLASQGHSTAVGDEGGFAPDLKSHEEVLDFIVSAIKKAGYEPSKKGDKAVAIAIDAASSELFDKKSKTYTFKKLKKAILTKQPGFENLGKVKVEYSSDELVEYFKDLFKKYPIISLEDGFSEHDWDAFTKLNNSVGATHQIMGDDLVTTNPKFIKKAIETKAINSVLIKLNQIGTLSETMDAIEMAHKAGMTCVVSHRSGETEDTTIADLAVALNTGQIKTGSISRTDRVAKYNRLLVIEEELGIVASYEGIQVFHNLKVK

SEQ ID NO: 21380 - protein, 319 aa, Medicago truncatula
MAANGIHPYHQQWPPAAAPPPPQPTAIPSPSSEEVRTIFITGLPEDVKERELQNLCRWLPGFEASQLNFKAEKPMGFALFNSPHQAIAAKDILQDMLFDPEAKSVLHTEMAKKNLFVKRGIGADAVAFDQSKRLRTAGDYNHTGYVTPSPFHPPPPPVWGPHGYMAPPPPPPYDPYAGYPVAQVPMPAPVSIAPSSYVPIQNTKDNPPCNTLFIGNLGENINEEEVRGLFSVQPGFKQMKIIRQERHTVCFIEFEDVNSATNVHHNLQGAVIPSSGSIGMRIQYPFLLYSKNPFGKRKDGTYPMAVPGANGAPVAMTYQ

SEQ ID NO: 21381 - protein, 124 aa, Oryza sativa (japonica cultivar-group)
MNIRRPRFLEVPRRGRASAAAMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 21382 - protein, 181 aa, Physcomitrella patens subsp. patens
MFTMVNGFRNYSEQAIQAARYIGQGFMVTLDHMNRLPMTIQYPYEKLIPSERFRGRIHFEFDKCIACEVCVRVCPINLPVVDWELKKDVKKKQLKSYSIDFGVCIFCGNCVEYCPTNCLSMTEEYELSIYDRHDLNYDQIALGRLPISVIEDSTIKTISNLSYLSKGSIEGHSNSRNVTNF

SEQ ID NO: 21383 - protein, 391 aa, Physcomitrella patens subsp. patens
MLATKTKPMIVSMGPHHPSMHGVLRLIVTLDGENVIDCEPILGYLHRGMEKIAENRTIVQYLPYVTRWDYLATMFTEAITVNAPEKLTNIQVPKRASYIRMIMLELSRVASHLLWLGPFMADIGAQTPFFYILREREMIYDLFEAATGMRMMHNYFRIGGVAVDLPYGWIDKCLDFCDYFLPKVNEYERLITNNPIFLKRVEGIGIIGKEEAINWGLSGPMLRASGVQWDLRKVDHYECYDELDWQIQWQKEGDSLARYLVRIGEMKESIKIIQQALKSIPGGPYENLEARRLQRGKKSEWNNFEYQFISKKPSPTFKLPKQEHYIRVEAPKGELGVFLIGDDSVFPWRWKIRPPGFINLQILPQLVKGMKLADIMTILGSIDIIMGEVDR

SEQ ID NO: 21384 - protein, 387 aa, Candida albicans SC5314
MALPSSKKTHSEQHKQILKQLLKEDANRTCADCKVSKNPRWASWNLGCFICIRCSGIHRSMGTHISKVKSVDLDAWTDDQIENMVKWGNANVNQYWEDKLPSGYIPDQSKIENFIRTKYDLRKWTMSKNLPDPLSLNKNKAATTATIQQPKHESKSHSNTTLSNDINLLDDNSGNKSNDEEFGSFTATRSPHKRSNKLAPPPTKTVLPAAPTTSSSPQQQHQHQPLQSAQNTGGSVSSMGRPDLKKSILSLYASPSSSNSFIQQQPQQQQQPQQPLGMNSLSNSLSSLNIQGGNSTTNNNNVYRSSTTVNTQNNHTQRHPLVNSTPSLNNNQPKQNWNNEWTTDTFTSSPSIPSSSASSLAGTSNYKTTSSLNVNGLDDDLFKNVWG

SEQ ID NO: 21385 - protein, 443 aa, Psychrobacter arcticus 273-4
MSQSVTTQTEQGLYINPEALTAHLPALHYQNDALHMEQVSITEVVKHYGTPCYVYSKQAILAVYQAYTDSFASLNHQICYAVKANSNLAVLGVLAQAGAGFDIVSRGELMRVLAAGGEASRVVFSGVGKTYSDIEYALNQSIGCFNVESISELTLINDVAKALDKSAPISLRVNPDVDAKTHPYISTGLKDNKFGIAHEDALVVYQQAAKLSHINIVGIDCHIGSQLTEVEPFVAALDKVIELVHSLGKVGIELRHIDLGGGLGVRYIDETPVSIDEFANALLPKLSKLGLTVFFEPGRSIVANAGILLTQVDVLKPTEHKNFAIVDAAMNDLIRPALYQAEMAVIPSALPNNGIDTEGTQPWDIVGAICETGDFLAKDRLLSLATGDVLAITGAGAYGFTMSSNYNSRPRASEVMVADDRHQLIRKRESIEALYADEVLWQG

SEQ ID NO: 21386 - protein, 124 aa, Cucumis sativus
GRGQFGTTYLCTYRPTGDLYACKSIPKRKLLCKEDYEDVWREIQIMHHLSEHPNVVQIKGTYEDSVFVHLVMELCAGGELFDRILLKGHYSEREAAQLIKTIVGVVETCHSLGVMHRDLKPENF

SEQ ID NO: 21387 - protein, 124 aa, Cucumis sativus
GRGQFGTTYLCTEITTGIEYACKSISKRKLIAKEDVEDVRREIQIMHHLAGHKNIVTIKGAYEDSLYVHIVMELCSGGELFDRIIQRGHYSERKAAELTRIIVGVVETCHSLGVMHRDLKPENF

SEQ ID NO: 21388 - protein, 265 aa, Arabidopsis thaliana
MYQDSGLMLRYMQNCPPDIQQFEDLFKSYKLSDEMNNTFVESSNISEYDIGEESDLFRAPDPILEEPILTVDPLSAALTMISCGEDTSQGLCELPDLGSLQSGQQLLDKAFYECEQDLMMKSAMESPFSDVLDIKNISVVTTINENQDMQKSVSSGNLSSMDWSHAQQETVMIQNFPDFDFGYGMRRAFSEGDIQQKLGAGLVQSPLDRIIVSCTSEDRREKLSRYKNKKSRRNFGRKIKYACRKALADSQPRVRGRFAKTEERK

SEQ ID NO: 21389 - protein, 413 aa, Glycine max
  misc_feature (148)..(148): Xaa can be any naturally occurring amino acid
  misc_feature (349)..(349): Xaa can be any naturally occurring amino acid
  unsure (1)..(413): unsure at all Xaa locations
MKISDENSSKPINPTSFQGGIECVGNRKMGQNRRALSVINQDLVAEGRPYPCVVNKRALAEKHNVCEKKQADPGHRPITRRFAAQIASTQKNRAEGTKKSNLGNSNSNGFGEHIFVDEEHKSTTDDQPVPMSLEKTEPMHSESDQMEXEMEDIIEEETVLDIDTCDANNPLAVVDYIEDLYAHYRKLEGTSCVSSDYMAQQSDINERMRAILIDWLIEVHDKFDLLHETLFLTVNLIDRFLAKQTVARKKLQLVGLVAMLLACKYEEVSVPVVGDLILISDKAYTRKEVLEMEKLMVNTLQFNMSVPTAYVFMKRFLKAAQADRKLELLAFFLVELSLVEYEMLKFPPXLVKTCEWHSNYSEDQLLECSTLMADFHQKAGNGKLTGVHRKYCSSKFSYTAKCEPARFLLEKPL

SEQ ID NO: 21390 - protein, 910 aa, Deinococcus radiodurans R1
MKTDWKKLGFIVHKGDDKDPGPDGTLTREQGNQLWIVSGNPTPSTTRPDTRVRTVGDLKQQQAIMLSRDLIVVKPALAQPGAWLTLHVSPTATLKLGADGVSGGDTLALEEVEGGLTPALQAKAPYLAGYKLLQIRAADRAKLPTALSGQLAVSSVLPGGKVLDATGVQTAWALDDLYAYAGPLGVTWQGNKPTVRLWAPTAQDVKLHVSRPDGTQERTLPMTRDTQGVWTASGDQSWKGLAYRFEVRVFAPSTGNIETNLVTDPYSVALTRNSTHSVFADLSDNSQKPAGWNALKKPALRSFADLSFYELHLRDFSAADASVPAAERGTYLAFTRPGSDGMTHLRALAGAGLKAVHLLPTFDIATINEDKGQWQTPGDLTQFGPNSEEQQKAVNAVKDADAYNWGYDPYHSMVPEGSYAVNPAERTKEYRQMVMSLNAAGLRVVQDVVFNHTAASGQAERSVLDKIVPGYYHRLNVNGGVENSTCCSNTATEHTMMRRLMVDTLVLMAREYKVDGFRFDLMGHHMVADMQAARRALDALTPAKDGVDGKQIYLYGEGWDFGEVQGNRRGANATQLNLYGAGIGTFNDRVRDALRGGSPFGGLQEQGVATGLATVPNGQAGNDSAEKWGQLADLVKLGLAGNLRDYRFTDHSGKPVTGGQLRYGDAPAGYAASPRETINYASAHDNQTLWDAVLLKTPANMNSAARVRFQNLAHSYLLLGQGLPFVPAGDELLRSKSFDTDSYNSGDWFNALDWTGHTNGFGKGLPPAEKNEANWALYRTLLGDAALKVTPADITRASDHFRELLRVRSSSSLFRLDTAAQVQQSLSFLPAPTGVIAMKLSGGVSATNPYRDLLVIFNGSADAVTLNDASASGMKLHPVLAASSDPIVRTSKVSGTQASVPALTTAVFVR

SEQ ID NO: 21391 - protein, 804 aa, Bacillus subtilis
MFVSYKWLEDYVDLKGMDPAVLAEKITRAGIEVEGIEYKGEGIKGVVIGHVLEREQHPNADKLNKCLVDIGAEAPVQIICGAPNVDKGQKVAVATVGAVLPGNFKIKKANVRGEESNGMICSLQELGIESKLVAKEYAEGIFVFPNDAETGSDALAALQLDDAILELGLTPNRADAMNMLGVAYEVAAILDTEVKLPQTDYPAASEQASDYISVKIEDQEANPLYTAKIIKNVTIAPSPLWMQTKLMNAGIRPHNNVVDITNFVLLEYGQPLHAFDYDRFGSKEVVVRKAAENEMIVTLDDQERKLSADHLVITNGTKAQAVAGVMGGAESEVQEDTKTILLEAAYFNGQKVRKASKDLGLRSESSVRFEKGIDPARVRLAAERAAQLIHLYAGGEVLAGTVEEDHLTIEANNIHVSADKVSSVLGLTISKEELISIYKRLGFTVGEADDLLVVTVPSRRGDITIEEDLIEEAARLYGYDNIPSTLPETAGTTGGLTPYQAKRRKVRRFLEGAGLSQAITYSLTNEKKATAFAIEKSLNTVLALPMSEERSILRHSLVPNLLDSVSYNLARQTDSVALYEVGSVFLTKEEDTKPVETERVAGAVTGLWRKQLWQGEKKPVDFFVVKGIVEGLLDKLNVLDSIEFVQSERKQLHPGRTANILLNGSLIGFIGQVHPSLEKELDIKETYVFELDLHALLAAETAPLVYTAIPKYPSVTRDIALVTDKTVTSGQLESVIKEAGGKLLKEVTVFDVYEGEHMEEGKKSVAFSLQYVNPEQTLTEEEVTKAHSKVLKALEDTYQAVLRG

SEQ ID NO: 21392 - protein, 505 aa, Brucella suis 1330
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMKKALKRVEAIVQGDPLDPATMIGAQASSEQLEKILSYLDIGRQEGAEVLAGGERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENYLKMLDHYQNTKNMLVSYSPKKLGFF

SEQ ID NO: 21393 - protein, 303 aa, Mycobacterium sp. MCS
MSPVSISGFDVTARLGTVLTAMVTPFKPDGTLDTDAAARLANHLVDSGCDGLVLSGTTGESPTTTDDEKLTLLRTVLEAVGDRARVVAGAGTYDTAHSVHLAKSCAAEGAHGLLVVTPYYSRPPQAGLLAHFTAVADATDLPVVLYDIPPRSVVPIAWDTIRTLAEHPNIVAIKDAKGDLHGGGQIIAETGLAYYSGDDALNLPWLAMGAVGFISVWGHFAASQLREMLSAFNSGDIATARKISVALGPLSDAQARLGGVTMSKAGLGLLGFDVGLPRLPQIPPTPDELTALAEDMRAAAVLR

SEQ ID NO: 21394 - protein, 710 aa, Arabidopsis thaliana
MVVATTIALYASPPSSVCSTPHQISCDLDLTSRSSSTSSSMASSPQKPIVGGLSSLFSSASVKSSSSSSCSYSTAVDEFSSLRYDRSDDLKDLSFSSSFGYSPAKFVNSFRRDHQSPISVLHGPVSCSCSPPMRMSRDRNLDGSFRLGASRLFNGFVRKALGSCVDYELGSDSGLVDELTFPMEVDTIKPYARDLLRRAQLRHKIFNDESVIKAFYEAEKAHRGQMRASRDPYLQHCVETAMLLANIGANSTVVVAGLLHDTVDDSFMSYDYILRNFGAGVADLVEGVSKLSQLSKLARENNTACKTVEADRLHPMFLAMADARAVLIKLADRLHNMKTLYALSPVKQQRFAKETLEIFAPLANCLGISTWKVQLENLCFKHLYPNQHNEMSTMLEDSFDEAMITSAIEKLDQALKKAGISYHVLCGRHKSLYSIYSKMLKKKLTVDEIHDIHGLRLIVDNEGDCYKALGVVHSLWSEVPGKLKDYITHPKFNGYQSLHTVVMDNGTVPLEVQIRTQEMHLQAEFGFAAHWRYKEGGCKYSSFVLQMVEWARWVVTWHCEAMSKDRSSISSSDSIKPPLQVFRLTLEDCPASYKPNSSQDGPVYVIVIENDKMSVQEFPASSTVSDLLSRAGPGSSRWSMYGIPAKEELRPRLNQIPVSDLKWKLKMGDVVELTPKIPDESLTEYREEIQRMYDRGLAFSRPGTMVGWGS

SEQ ID NO: 21395 - protein, 280 aa, Zea mays
HEDKVVVKGKKAAADPMRVVERVQKKTGRKVELLSPIPPPPPPEEEKKAEEEPEPPKAEEKKEPPVIAVVLKVHMHCEACAQGIRKRILKMKGVQSAEPDLKASEVAVKGVFEESKLAEYVYKRTGKHAAVVKSEPVPAPPPESGAGDNTGAKEEEKGQEEEKEKEGGGDGGGEEKKKEGGKEEEKKDGEKQEEEKEGGGGGEKVEEKEGDKDAAAAAAASMYMHYPRFPFPGGYYAPPPGYVYQPVYPAPAYAAYAPPHHQPMAPQIFSDENPNACSVM

SEQ ID NO: 21396 - protein, 261 aa, Saccharopolyspora hirsuta
MAANTKPVALVTGATSGIGLAIARRLGQLGARVYICARRAEELATTIKTLQAEGLEVDGSTCDVSVPGQIPELVAAAVDRFGPIDVLVNNAGRSGGGVTVEVDDETWFDVINTNLNSVFLMTKQVLTKGGMLEQERGRIINIASTGGKQGVIWGSPYSASKHGVVGFSKSLGLELAKTGITVNAVCPGFVETPMAERVRAHYSKIWSVSEAEAHDRVTTRVPLGRYVEPEEVAAMVEYLVSDGAAAVTAQALNVCGGLGNY

SEQ ID NO: 21397 - protein, 712 aa, Arabidopsis thaliana
MVVATTIALYASPASTVCSTAHQINAHISCDLDLNSRSSSASSSTSSPTIGGLSLLFSGASVKSSSSSSSSHPSVGEELASIRHDRSEDRTLSGSFCYSPSKFIGSSYLKRDHQSPVSVLHGPISSGNSPPMRISRDRNLDGGSALRVGSSRLFNGFVRKAIGSCVDYDTDSVLVDEQLPFTMDDGFEGERRQPYARDLLRRAQLKHKIFEDESVIKAFYEAEKAHRGQMRATGDPYLQHCVETAMLLADIGANSTVVVAGILHDTLDDSFMSYDYILRTFGSGVADLVEGVSQLSKLARENNTACKTVEADRLHTMFLAMADARAVLIKLADRLHNMMTLYALPPVKRQRFAKETLEIFAPLANRLGISSWKVKLENLCFKHLHPDQHHEMSDMLEDSFDEAMITSAIEKLEQALKKEGISYHVVSGRHKSLYSIYCKMLKKKLTMDEIHDIHGLRLIVDNEKDCYKALGVVHKLWSEVPGKLKDYISHPKFNGYQSLHTVVMGDGTIPLEVQIRTKEMHLQAEFGFAAHWRYKEGDCKHSSFVLQMVEWARWVVTWHFETMSKDGSSICSSEPLCSFPSHAEDCPFSYKPSGNQEGPVYVIVIENEKMSVQEFPENSTVSDLLRRAGPGSSRWSMYSIPAKEELRPRLNQTPVSDLKCKLKMGDVVELTPAIPDKSLTEYREEIQRMYDRGLAFSRPHRAATGTMVGWGS

SEQ ID NO: 21398 - protein, 477 aa, Brucella suis 1330
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAVTFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 21399 - protein, 382 aa, Pseudomonas aeruginosa UCBPP-PA14
MIQSKLPNVGTTIFTRMSQLAAECGAINLSQGFPDFDGPPELREAVGRHIAAGHNQYAPMTGLPALREQVAKKIEQFYGRRVSADSEVTITPGATEAIFSAIQALVHPGDEVVVLDPSYDSYEPSVQLAGGRCVHVPLALPDFSIDWQRMAEAIGPRTRLVIINTPHNPSGALISREELDRLAALIRDRDIYLISDEVYEHLVFDGVAHTSVLSHEELYPRSFVVSSFGKTYHVTGWKTGYVVAPPALSAELRKVHQYVNFCGVTPLQWALADYMAGHPEHLRQLPGFYQAKRDLFCDLLLDSRFRFTRAPGTYFQCVDYSAVRPDLDDVAMAEWLTREHGVAAIPVSVFYEKAPDAMRLVRFCYAKREETLRQAAEKLCAI

SEQ ID NO: 21400 - protein, 279 aa, Candida albicans SC5314
MISRALLKRSLPTVQFLRPFTGSSIRRSAHEEDLVNLNELPRQKSLEENYVPLINPTEKYKVQIEELHKFGTYIMACLPKYVHQFSVWKDELTIYVAPSAILPTMLFLKNNTACQFKQVSDVTAADYPSRTNRFDVVYNLLSVRHNSRIRVKTYANETTPVPSITPLFNGANWFERETYDLFGVFFEGHPDLRRILTDYGFEGHPLRKDFPTTGYTEVRYDEEKKRIIYEPLELTQAWRNFTVGSSVWEPVGEGKDFTPESFKLPTPEPEPEKESDEKK

SEQ ID NO: 21401 - protein, 647 aa, Oryza sativa
  misc_feature (447)..(447): Xaa can be any naturally occurring amino acid
  unsure (1)..(647): unsure at all Xaa locations
MHLGVSLVPPLPLHFPRRAPYGFRSAAPRRIAVCPLLSVGRRRRLGAPPRAARGGGEGPEEEMRRLLELLPGELRRRVEGHPELPALVEVVMDLGRPPLARFPSGDFLLSQSPISFDDLRHATSQVGDFGADNRAGISRTLHRISAIRNRKGAIIGLTCRVGRAVPGSANLLQDLVKDGGSLLLIGPPGVGKTTVIREIARMLADDYRKRVMIVDTSNEIGGDGDIPHPGIGNARRLQVPNQDMQHKVLIEAVENHMPQAIVIDEIGTKLEAMAASTIAQRGIQLVATAHGITIENLIMNPSLDMLVGGVQSVTLGDEEANRRGVQKTVLERKGPSTFTCAAEIVSKIELRVHRSLEDTVDALLAGKMPNVEIRKVGSKGPVQEVYVQKERLDLGPSEGATQLDTDSLSNARRSLDSAFNLDPAEGHIGRSTEAEPDLNLYAYGAIXISESTALQAIKQLELEDIVTLTYNISEADAVIALQSKLKKNTQIQAVVKSQDIPVFFTKTNSLVQIRRALRALVDDHTDGLMDFEDTEEVRSSEETDALEEARLAIEQVVIPKGESVQLLPRPPSIIASQVDLVESFKLKWESIGQEPNACLRILPQFVGVEEGGKSVKQEAATELTDSDNSDDMDYKQNGVSRLPFLPE

SEQ ID NO: 21402 - protein, 1121 aa, Candida albicans SC5314
MKVSQILPLAGAISVASGFWIPDFSNKQNSNSYPGQYKGKGGYQDDCGDDYKKGYKSKTYSKVKPITSTDCTTPIQPTGTTTGYTKDVVESTSYTTDTAYTTTVITVTKCDGGSCSHTAVTTGVTIITVTTNDVITEYTTYCPLTSTPATESTPATESTPAIESTPCTTSTETTPATESTPATESTPATESTPCTTSTESTPATESTPATESTPATESTPATESTPATESTPATESTPATKSTPATESTPATESTPATESTPCTTSTESTPATESTPATESTPATESTPATESTPATESTPATESTPATESTPATESTPATESTPATESTPCTTSTESTPATESTPATESTPATESTPATESTPATESTPCTTSTESTPATESTPATESTPATESTPATESTPATESTPATESTPCTTSTESTPATESTPATESTPATESTPATESTPATESTPATESTPCTTSTESTPATESTPATESTPATESTPATESTPATESTPATESTPCTTSTESTPATESTPATESTPATESTPATESTPATESTPATESTPATESTPATESTPATESTPATESTPATESTPATESTPATESTPATESTPATESTPCTTSTETTPATESTPATESTPATESTPATESTPATESTPATESTPATESTPATESTPCTTSTETTPATESTASTETASSTPVESTVIVPSTTVITVSSCYEDKCSVSSVTTGVVTISSEETIYTTYCPITSSITIPVPNTSTPAAPGTPVESQPVIPGTETTPAAPGTPVESQPVIPGTETTPAAPGTPVESQPVIPGTETTPAAPGTPVESQPATTPVAPGTETTPAAPGTPVESQPATTPVAPGTETTPAAPGTPVESQPVIPGTETTPAAPGTPVESQPATTPVAPGTETTPAAPGTPVESQPATTPVAPGTETTPAAPGTPVESQPATTPVAPGTETTPAAPGTPVESQPATTPVTPGTETTPAAPGTPVDSQPVTPGTETTPAAPGTPGTEATPVTTQPVSVLSTSQVVTASGEFSTVTAHSTSIVASCPEGGCVPEGQQTETSPSVPTNGPEVEASSSVLSIPVSSVTTSTIASSSETSVPPAQVSTFEGSGSALKKPYYGLAVAALVYFM

SEQ ID NO: 21403 - protein, 546 aa, Aspergillus oryzae
MGVETSAEHGEMISPAGAPQYSSQESVAANKPMEIGVDTPVPRITLRAFVMGAFVSMGGLLFGYDTGQISGFQEMDNYLERYGQLNDEGKYYFSHVRSGLIVSLLSIGTLIGALVAAPIADKLGRKWSITFWCIILNVGLIIQISSPAGKWVQMVMGRWVTGLGVGGCSLLVPMYQGESAPRQVRGAMISCYQLFVTLGIFLSYCINLGTEHLEGTEQWRITLGLTFLFALILGGGMACFPESPRFEFRHGRVDSARNTMSKLYGVPENHRVILQEIEEIQQQLDAESQEQVWHEFITAPRMLYRIALGMVLQSLQQLTGANYFFYYGTTIFQGAGISNSFITQVILGAVNFGTTFGGLYIVENFGRRKSLIAGAAFMFVCFMIFASIGHFMLDVQNPENTPGPGKGMVVVACFFITAYAMTWGPMIWAICAELFPSKYRAKGMALATASNWLWNFLIGFFTPFITGAIDFAYGYVFAGCLAVAALVVYFFVIEGKGRTLEELDWMYVNKVAPWKSSNFEMPSLHDQQYGNQHGRKESRSYHAENA

SEQ ID NO: 21404 - protein, 526 aa, Candida albicans SC5314
MSVQIFNDQATEERAENARMSAFIGAIAVGDLVKSTLGPKGMDKLLQSSSNADHALVTNDGATILKSIPFDNPAAKVLVNISKVQDDEVGDGTTSVTVLSAELLREAEKLIDQKIHPQTIIEGFRIACNVAIQALNKAAVNNGDNPTLFRNDLLNIAQTTLSSKILSQDKLLFSNLAVDAILRLKGSTNLNHIQIIKKVGGKLSDSYLDQGFILEKKFGIGQPKKITDAKILIANTSMDTDKVKIFGAKFKVDSTSKLAELEKAEKLKMKNKVDKIAKFGINVFINRQLIYDYPEQLFTDAKINSIEHADFDGVERLALVTGGEVVSTFDSPDNVKLGHCESIEEIIIGEDTFLKFSGVAAGEACTIVLRGATEQVLDEAERSLHDALSVLSQTTRETKTVLGGGCSEMLMAKAVDQAAANETGKSALAIEAFSRALRQLPTILADNAGYDSSDLVTKLRSAIYNGMSTSGLDLNHGIVADMREMGIVESYKLKKAVVSSAAEAAEVLLRVDNIIRAKPRTADRNH

SEQ ID NO: 21405 - protein, 728 aa, Zea mays
  misc_feature (559)..(559): Xaa can be any naturally occurring amino acid
  unsure (1)..(728): unsure at all Xaa locations
MAYQVTFFVDAEFGTPGAVVVKNGLRNDQFFLRHVQLNLPEDGRSVHFECNSWVYPYKKTNADRVFFINTSYLPDRTPQALRLLRDEELRSLRGNGRGERKDWERVYDYDLYNDLGDPDKEDRARPALGGTATHPPTKLAEVLALAVQAVTHFVVPESNALFHGNVNSFRSFDQLKDDLYGRRPPVAVDGQVMDKLKTSVPSHKTYKQVSKMVKETPVKFPIPQVIEHDQEAWRSDEEFAREMLAGLNPVVISRLEVFPPVSRGGKKSSITEAHIESQLQGRTVQKALDDKRLYLLDHHDYLMPYLRRINTQQGVCVYASRTLLFLRDDGALKPLAIELSLPGDGAEVSSRVILPATPGTTDGHLWWLAKAHVSVNDSGYHQLISHWLFTHATVEPFIIATKRQMSAMHPIHKLLEPHFKDNMQINTLARSILLSAGGILERTMYPGKYAMEMSSAIYSEWRFTEQSLPNELVKRGMASKMGGGAIALHVEDYPYAVDGMDVWRAIEGWVRTYCAHFYHSDAAVAADAELQAWWDDVRRVGHGDRQRDPACWLDLELRXANLAESLSTLIWIASALHAAVNFGQYGYAGYMPNRPTRCRRFVPLPDSPEMAQLEADPDRFFLDTVPDRFTATLGLTLIEVLSNHTSDELYLGQRATAAWTDDGEVLQLLDRFREELRRVEKRITERNRDPRLKNRKGPAKVPYTLLFPDVGGKEKGITGKGIPNSVSI

SEQ ID NO: 21406 - protein, 297 aa, Escherichia coli CFT073
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPALSGVKLTLDQIDTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 21407 - protein, 378 aa, Triticum aestivum
  misc_feature (309)..(309): Xaa can be any naturally occurring amino acid
  unsure (1)..(378): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDYDQEMETSKTSSSVEKSYELPDGQVITIGAERFRCPEVLFQPSFIGMEAAGIHETTYNSIMKCDVDIRKDLYGNIVLSGGTTMFXPGIADRMSKEITALAPSSMKIKVVAPPERKYSVWIGGSILASLSTFQQMWIAKAEYDESGPSIVHRKCF

SEQ ID NO: 21408 - protein, 496 aa, Bacteroides fragilis NCTC 9343
MKANNLLSQFGDHRQRVQSAITAVCEGRGILLVDDENRENEGDLIFSAQSMTEADMAIMIRHCSGIVCLCITEEKARQLNLPLMVEQNTSKYGTAFTISIEAAEGVTTGVSAADRIQTIRTAIAPNATPESLHHPGHIFPLIARSGGIKERSGHTEGSIDLMKLAGLAPCAVLCELTNDDGTMARLPEIIKFGLEHKYPVVTINDLKEYQTAPDFLPKLVGSFSCPAAENPTTAIMEAAFRHHYMHYRYINCEVGPENLAAAIQGAKAMGWRGFNCSLPNKVEIIRYLDELGESAKIIGAVNTVVIGDDQRATGENTDGKGFVKAISEIITIQDKKIALLGAGGAARAIAVEMALAGVKEITILNRNRDKGQALADLLNSQTVATARFVLWDHPYRFSTDIDIVINATSVGLYSNVDQRLNIDTDTLLPHMVVADCIPNPVYTQLLRDAVRRGCCHVLPGMKMLVYQAVIAIKYWSGVDVDPDIMLEKLKEVVKPA

SEQ ID NO: 21409 - protein, 199 aa, Vibrio sp. Ex25
MSKKILVPIAPGTEEMEAVTVIDMMVRAGYDVTVASAAFDGSLTMKASRGVTLTADCKLVDIADDEFDAIALSGGVGGAEIFRDSTVMIEILKQHIYEGKLVAAICAAPALVLQHHDLFPQSLMTCHPSFQSHIPEEKWRSKRVTFDINHNLITSQGPGTALEFAMEVIIQLSGKKHAWSVAEPMIPLPTLHYHKLGEE

SEQ ID NO: 21410 - protein, 714 aa, Prochlorococcus marinus str. NATL1A
MPKIIEIPGRSGFYLRVAVPRGKLRDAFGTCDVVKKIGNTREEAEENISSAEIAIQQKFDEKLREEDAKQINKSLPKGIRLEAIKNSNSKEPPKNIEKDLKDAGFSNAAIEALMNFDEKESTNIEEIEQTVPSPCIANNSPRAKFEQFKADSNYLNEPLHSELLNESDHFTNDAVQLLKFHGSYQQDDREHRKRGGTGKDWQMMLRLRNPAGYVPGPLFVALDELSDRLGNQTLRATTRQCFQMHGIKKRNIKEVIGTIVKSMGSTLAACGDVNRNVMAPAAPYEQGSYPAARKLANDIADVLSPKKAEKTYIDLWVDGEMKYAIKPSSEVKKNRKLQLKPGVFSGDKKEPLYGATYLPRKFKCATTVPGDNSVDILTHDIGLVTFTNKKGVLEGCNVYVGGGMGRTHNLDTTFARIADPIGYVEGEHILELVQSILALQRDYGDRKTRRHSRLKYVLHDMGVDWFKKQLTSKYFTRKIENLKHEGDTILEDYLGWHQQSEKLWFVGLPLLSGRLTGRVKKELRNIVEKFALDVRLTPNQDLLLCNIGNYQKASVKRALINIGFMNPGAPDPLARNAMACPALPLCGLAMTEAERFLPELLERINNQLEILEINKSILIRVTGCPNGCARPYMAELALVGSGLNQYQLWLGGSTNLKRLATPYLQKMPIDDLEKTLEPLFLSWKDTGASSSLGDHVTKLGSESVMSLLTSSAAP

SEQ ID NO: 21411 - protein, 286 aa, Yarrowia lipolytica CLIB122
MLVLAIGDLHIPDRAIDVPTKFKKLLVAGKISQVLCLGNLTDKQTLDWLGSISPDLQLIRGDQDSQPSSLIYNSLPRSLDLEVPGGTNASKIYAGLSLFKTVQHGELKIGITAAHNTLSLHDPDTQLIIARQLDVDILICGGAHRVEAFELDGKFFVSPGSATGAFSVEKYTDDGVEEDEEEEVNGKEENDNENEDGKNDEDGKNKEKEESKGDKDDKDKDEDGKDESENKEESETNGEETKITEPSEAIPSFCLLDIQGSVCVLYVYMYIDGDVKVDKISYRKLQ

SEQ ID NO: 21412 - protein, 454 aa, Escherichia coli CFT073
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAALVILNGLFQGMGVGPSFITIANWFPRRERGRVGAFWNISHNIGGGIVAPIVGAAFALLGSEHWQSASYIVPACVAIVFAVIVLILGKGSPHQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 21413 - protein, 415 aa, Solibacter usitatus Ellin6076
MENVLAILLAGGAGERLYPLTRDIAKPAVPFGGAYRIIDFTLSNCINSDVRRILILTQYKSLELVRHIRDGWNILSPEMGEYVEVLPPMKRVHSDWYQGTADAVFQNFQSIEAESPEVTLILSADHIYKMNYREMIDWHRRHGADITLATLQAPPEEAPRFGVLEIDADYRVTGFEEKPQHGNPKRSQFDPNMVSVSMGVYVFNTEVLLRLLHEDAQDPNSSHDFGKDIIPRHLESTRVVAYDFRDINAKQSRYWRDVGTLDAFYEANMDLVSVTPEFNLYDQRWPIRTKATQQPPAKFVFAQEGRRMGLAVDSIVSAGCIVSGGRVLHCVLSPGVRVNSYCEVEYSILMPNVEVGRYSRIRRAIVSTGAKIPESSSIGFDVETDRANGYQVTEGGVTVVGNFEEGRTKALPYLA

SEQ ID NO: 21414 - protein, 384 aa, Arabidopsis thaliana
MDLVDKRDVLIGDFRPSLGFYGGVRVGVYLDTTEPKHAKIKGFAMETLKRSSKVWLQELRSNLNIFWGTIESEISKNGAASYIFPLQRCIFSFLCASLAGVDASVSPDIAENGWKTINTWLALQVIPTAKLGVVPQPLEEILLHTWPYPSLLIAGNYKKLYNFIDENAGDCLRLGQEEFGLTRDEAIQNLLFVLGFNAYGGFSVFLPSLIGRITGDNSGLQERIRTEVRRVCGSGSDLNFKTVNEMELVKSVVYETLRFSPPVPLQFARARKDFQISSHDAVFEVKKGELLCGYQPLVMRDANVFDEPEEFKPDRYVGETGSELLNYLYWSNGPQTGTPSASNKQCAAKDIVTLTASLLVADLFLRYDTITGDSGSIKAVVKAK

SEQ ID NO: 21415 - protein, 283 aa, Cryptococcus neoformans var. neoformans JEC21
MGVSQNEKSVILTHESGCSAEIYFYGATVVSWKQGGKERMFVSSKSAMDGSKAIRGGIPVVFPIFGPPPPSPPEYASLGQHGFARTSTWKFDSVVMDRPEGVSVRFVLPSAPPTFLHEFKLSYVVTLAPHQLSTDLHVVNSGKEKFSFQALLHNYLAVPDSSKIKITGIDKGTTYKDKVLGGKMDEWDGSTLVIDREIDRVYQKVPSREITVDDGAGSGYKVRFRGFEDCTIWNPQEATGSKMADMEDKGWDKYVCIEPGYVREFKTLSPSQELILAQTITVL

SEQ ID NO: 21416 - protein, 427 aa, Solibacter usitatus Ellin6076
MTTIVRIFGREILDSRGNPTVEADVYLADGSMGRAAVPSGASTGEHEAVELRDGDKGRYLGKGCLNAAKHINGEIATALHGKDATQQGEIDGAMIALDGTPNKGRLGANAILAVSMATARAAAAAQRTPLYRYLGGVGANTLPVPMMNIINGGAHADNSVDLQEFMVAPFGAKSFSEALRMGVEVFHTLKKVLSKKGYSTAVGDEGGFAPMLKSNEEAIESCLEAITQAGFKPGENVGICLDPASSEFFKGGKYVFKKSDKSERTSEQMVEFWANWVRQYPAILSIEDGMAEDDWAGWKLLTDTVGSKIQLVGDDLFVTNSTRLKQGIEGGVANSILVKVNQIGTLTETLEAMQMAANAGYTAVVSHRSGETEDPFIADLAVATNAGQIKTGSASRTDRICKYNQLLRIEERLGSSAVFPGRKAYSR

SEQ ID NO: 21417 - protein, 248 aa, Solibacter usitatus Ellin6076
MKKLVLIRHGESTWNKENRFTGWTDVDLSDEGRQQATEAAEVLKREGYVFDVAYTSVLKRAIRTLWTVLDGMDLMWIPVHRSWRLNERHYGALQGLNKAETAAKFGEDQVKIWRRSYDIPPPVLTADDPRFPGHDPRYQSLTKEELPLTECLKDTVARFLPLWHDTIAPAIRSGQRVIIAAHGNSLRALVKYLDGVSEADIVELNIPTGMPLVYELDDDLKPLNRYYLGDPEKVKAAMEAVAAQGKKK

SEQ ID NO: 21418 - protein, 78 aa, Glycine max
  misc_feature (36)..(36): Xaa can be any naturally occurring amino acid
  misc_feature (52)..(52): Xaa can be any naturally occurring amino acid
  unsure (1)..(78): unsure at all Xaa locations
LDVEENDYKTAYSYLSEAFESFNTLDEPKAEVGLAXMLLCEIMVSQADDVAXIIFSIAGVQYLGPDLDAMKVIADADS

SEQ ID NO: 21419 - protein, 235 aa, Fragaria x ananassa
MKLRSQSNSSPSFVFFFVLFFSFIALSEMATLGGIRDSPAGSENSLETEALGRFAVDDHNQKQNGMLEFVRVVKAKEQVVAGTLHHLVVEAIDGGKKKLYEAKVWVKPWLNFKQVQEFKHAGEPETVSGTPSFTSSDLGVKQGGHAPGWQDVHPQDPQVQDAANHAVKSLQQKSNSLFPYELQEVVHAKSEVMEEHAKFNMLLKLKRGDKEEKYKVEVHKNNEGAYNLNQMEVEH

SEQ ID NO: 21420 - protein, 171 aa, Mycoplasma mobile 163K
MNDLNELKKYIQDVKDFPIKGIVFKDISPLLANGEIFRIVVEKMAEKVREVDVIIGPDARGFIFGAAVASYLKKPFVMIRKEGKLPHNTIKIDYKLEYGMGSLEIQKDLIKPGQSVAILDDVLATGGTTKASVELVKKLGAKVTKAVFLMELEFLNGKEKINAEVISLLKY

SEQ ID NO: 21421 - protein, 113 aa, Hyacinthus orientalis
GVTPPSTKPPCAPTPVKPKPKPKPCPPTPSPKKCPANTLKLGTCLDVLGGIIHAGDPAVDCCPLIAGLTSVQAAACLCTAIKLKAGGVNLYVPIAVELLVTCGKKPPPGYKCK

SEQ ID NO: 21422 - protein, 314 aa, Haemophilus influenzae Rd KW20
MKKIAFIGECMIELNGKPFAEMWQSYGGDTLNSATYLSRVSSSKEIQVHYVSALGTDNLSKQMLKYWQADGIQTNWVLQDEQHQPGLYLIQLDAQGERTFLYWRNQSAARYMVQHPDFAKVIAELQQVDVIYLSGISLAILPKNDRTFLIEQLSSLAKKGTEIVFDSNYRPKLWDSLEEAQDCYLQLLPSVNIALVTFDDEQALWKDKTSRDTLERLHKIGIPKVIVKCGKNGAIFSDRYLSQYGQVIPEPILNVVDTTSAGDSFNAGFLNGYLRNKSLEICCQQGNRIAGIVIQHKGAIIDKVAISHLQSEFN

SEQ ID NO: 21423 - protein, 454 aa, Escherichia coli
MLSIFKTGQAADSVPAEKIQVTYRRYRMQALLSVFLGYLAYYIVRNNFTLSTPYLKEQLDLSATQIGVLSSCMLIAYGISKGVMSSLADKASPKVFMACGLVLCAIVNVGLGFSTAFWIFAALVILNGLFQGMGVGPSFITIANWFPRRERGRVGAFWNISHNVGGGIVAPIVGAAFALLGSEHWQSASYIVPACVAIVFAVIVLILGKGSPRQEGLPSLEEMMPEEKVVLNTRQTVKAPENMSAFQIFCTYVLRNKNAWYVSLVDVFVYMVRFGMISWLPIYLLTVKHFSKEQMSVAFLFFEWAAIPSTLLAGWLSDKLFKGRRMPLAMICMALIFICLIGYWKSESLFMVTIFAAIVGCLIYVPQFLASVQTMEIVPSFAVGSAVGLRGFMSYIFGASLGTSLFGIMVDHIGWHGGFYLLGCGIICCIIFCWLSHRGAIELERHRAAYIKEH

SEQ ID NO: 21424 - protein, 295 aa, Bacillus licheniformis ATCC 14580
MTMSKICVIGSSSMDLVVTSPKRPAAGETVLGESFKTVPGGKGANQAVAAARLGAEVHMIGCVGDDHYGKAILDNFQANGVLTDYVEPVTGQESGTAHIVLADGDNSIIVVKGANDHVTPEYVQKALPAIKQADIVLIQQEIPEETVDYVSGLCSSLGIPLLLNPAPARPLRPETVEHAAYITPNEHEASVLFQGMSREEALKRYPEKLFITEGKNGVRYHNGLEERVVPSFPVNAIDTTGAGDTFNAGFAVALSEGQSIESALRFANRAASLSVLKFGAQGGMPKRDEVERELS

SEQ ID NO: 21425 - protein, 189 aa, Brassica napus
  misc_feature (107)..(107): Xaa can be any naturally occurring amino acid
  unsure (1)..(189): unsure at all Xaa locations
HNSKSIIRFQFGLFCVCDGHGGAGAAQSAVKIIPEVLANILSDSLEKEKVLSQRDASDVLKDVLAKTEARLEDHLYEGCTATVLLVWKDGEENLFAQCANLGDSACXGGRYIQMTEDHRVASLTERRRIQEAGLSLRENETRIFGINLARMLGDKFPKQQDGRFSAQPYISEPLRIDQSNKHVFAVLHR

SEQ ID NO: 21426 - protein, 216 aa, Oryza sativa
  misc_feature (71)..(71): Xaa can be any naturally occurring amino acid
  unsure (1)..(216): unsure at all Xaa locations
MTGLGSPCGACKFLRRKCVKGCVFAPYFCHEQGAAHFAAIHKVFGASNASKILMHLPVSDRCEAAVTMSYXEAQARLRDPIYGCVAHIFSLQQQVVSLQAQLESLKAQATQGYGDGCSISSPQNDSCGNMLTSIVQDEQQFVGPTMASNSSVKNENHSYIANGHLAPMSAQSSQGFEAELCMAEYSNTNPCCSVQGNWYHDMEDLQSVAFAYLNQA

SEQ ID NO: 21427 - protein, 357 aa, Prochlorococcus marinus str. MIT 9313
MRQHRIVLLPGDGIGPEITAVAKLLLDALGHQHGFKLNFEQHPIGGVAIDASGSPLPASTLEACQASDAVLLAAIGSPRFDALPREQRPETGLLSLRAGLKLFANLRPVTILPALIDASSLKANVIKGVDLMVVRELTGGIYFGQPKGRIEADGDERAFNTMTYSRTEVDRIAKVAFELARDRSGKLCSVDKANVLDVSQLWRDRVDALAANYGDVELSHMYVDNAAMQLVRNPRQFDVLLTGNLFGDILSDEAAMLTGSIGMLPSASLGSEGPGLFEPVHGSAPDIAGQDLANPMAMVLCAAMMLRIGLKENDAARALEGSVERVLAAGFRTGDLMSEGCTQLGCAEMGEQLLQAL

SEQ ID NO: 21428 - protein, 174 aa, Acinetobacter sp. ADP1
MSKGQTLQDPFLNSLRKERIPVSIFLVNGIKLQGHIESFDQYVVLLKNTVSQMVYKHAISTVVPARNPRPAGAPTGAPQGGGFGGQGGGFGGQGGGFGGQGGGFGGQGGGFGGQGTGFGGQGGGFGGQGGFGGQGGFGGQGGFGGQGGFGGQGGSGFDNDTKFEDGQEDDSNNR

SEQ ID NO: 21429 - protein, 431 aa, Prochlorococcus marinus str. NATL1A
MKRVLAIILGGGKGSRLYPLTKMRAKPAVPLAGKYRLIDIPISNCINSDISKMYVLTQFNSASLNRHIAQTYNLSGPFGQGFVEVLAAQQTPETPSWFEGTADAVRKYQWLFQEWDVDEYLILSGDQLYRMDYSLFVEQHRKTGADLTVAALPVDSAQAEAFGLMRTDEAGNIKEFREKPTGDSLKAMAVDTSRFGLEANEAKEKPYLASMGIYVFSRSTLFDLLNKFPSYTDFGKEIIPEALGRGDKLKSYVFNDYWEDIGTIGAFFESNLALTQQPTPPFSFYDEKFPIYTRPRYLPPSKIVDTQITDSIVSEGSILKSCSIHHCVLGVRSRIESDVVLNETLVMGSDFYESYEERIALRNGGGIPLGVGQGTTVKRAILDKNARIGDNVTIVNKDNVEEADRADQGFYIRNGIVVIVKNATIPDGTII

SEQ ID NO: 21430 - protein, 244 aa, Deinococcus radiodurans R1
MIKGKWRGVRGGPCLLCRPAFGRVGPGSGALTRARPSRAALHRRLYLRPMPRTAAVTRTTKETDITVRLDLDAAPYEQPATGHGFFDHMLDALARHSRLGISISGTGDLHIEPHHLIEDTGITLGQALSQALGDRKGIERYGSAFVPMDETLAHVVLDLSGRAHLAFEPETLDVYGDAGGMTHYHLREFLRGFCNHAGATLHVRLLAGREAHHVIEAVMKAFARALRDAVAVTSDALPSTKGSL

SEQ ID NO: 21431 - protein, 315 aa, Pyrococcus horikoshii
  misc_feature (7)..(7): Xaa can be any naturally occurring amino acid
  misc_feature (39)..(39): Xaa can be any naturally occurring amino acid
  misc_feature (108)..(108): Xaa can be any naturally occurring amino acid
  misc_feature (125)..(125): Xaa can be any naturally occurring amino acid
  misc_feature (140)..(140): Xaa can be any naturally occurring amino acid
  misc_feature (215)..(215): Xaa can be any naturally occurring amino acid
  misc_feature (226)..(226): Xaa can be any naturally occurring amino acid
  unsure (1)..(315): unsure at all Xaa locations
MKLSPSXLDKLLRLGYSKLFADRYFQLWGERAIRIAEAXEKPLPRCFRVNTLKISVQDLVKRLNKKGFQFKRVPWAKEGFCLTREPFSITSTPEFLTGLIYIQEASSXYPPVALDPKPGEIVADXAAAPGGKTSYLAQLXRNDGVIYAFDVDENRLRETRLNLSRLGVLNVILFHSSSLHIGELNVEFDKILLDAPCTGSGTIHKNPERKWNRTXDDIKFCQGLQXRLLEKGLEVLKPGGILVYSTCSLEPEENEFVIQWALDNFDVELLPLKYGEPALTNPFGIELSEEIKNARRLYPDVHETSGFFIAKIRKL

SEQ ID NO: 21432 - protein, 385 aa, Medicago truncatula
MDENNNRRNLSSLSTVSKRFLSITGRLRFSLTLVNPTPPFLLSLFKRFTHLNFLDLSRYLGNNLDDLLCQISDFPSFKIISLKLPNVGNRFPANGLRAFSQNITTLTSFTCSGFVNLFLIAECFPLLDDLDLRLKYPLNYISMIETRTRSYNNGVEALSLSLHKLRKVNLSSFPINNQSLFHLFSNCKLLQEVNIDGYKQLLTDAGIASALRERPTLMSFSLSSYSISRPPFMTSHIIDSLVSFKGLTCLGLYYFNISDELLYTIARGGLPLIKLVLKNRWGYSYDGLFCLLSKCRRQGFRHLYIGLSKFLNDQHVIQLSSFLGDLMSINLSNCDKLTESSLFALARNCPLLDHLLSLVIVVDERAALKALSSRLILQATYWPYI

SEQ ID NO: 21433 - protein, 195 aa, Hyacinthus orientalis
PGLQFSLSSSPSFISLSPSHCPLQQPPVCCYLNRSSADSVRMSAGRVSNGGGSGRGVRRSVAVRSSLDTTAAPTVGQVTDVEDSLDTTAGPTVGQVTDVNQDTFWPLVKAAGTKIVVLDMYTQWCGPCKVIAPKFQELSEKYLDVVFMKLDCNNENKALAKELGIKVVPTFKILKDSTVVKEVTGAKFDDFGLCY

SEQ ID NO: 21434 - protein, 384 aa, Glycine max
MKRRKRSHSEGRNEEDRLSDLPECVLLHILTFLNAKHAVRTCVLSTRWKDLWKRLPTLILHSSDFWTFKGFTKFVSRLLSLRDASLALLKLDFERHGCIEPQLLKRIVKYAVSHNVRQLGISVKCDIRYVPQCVFSCQTLTSLKLSVCPRGYIYGSTLFPKSLNLTALTTLHLQHFTFCKGDDDDDDMAEPFYACRRLCDLTIDYCTVKDARILCISSATLVSLTMRSDQSGDFYKIVLSTPNLCAFAFTGAPYQQLLGSNLSSLERVSIDAEIWSTSLESPLILLSWLLELANVKSLTVSASTLQVLFLIPELLKIKLPCLGNLKSLKVELKPLSPIFSMRLKAAKSWKAALKPSPPPMPDGIVDFLLQNSPSAKVDMIDFAR

SEQ ID NO: 21435 - protein, 421 aa, Brucella suis 1330
MTTENLLESALVRLDEAASHINIDADVIEKLKFARETMKVRLMIRMDDGSRKSFIAWRCRYDDTRGPTKGGIRYHPDSTVEEVETLAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHASNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 21436 - protein, 91 aa, Hyacinthus orientalis
MKFVMEFAENLILRMMEDPKERDKRAREHVYAIKDQCKKTKEMWSLPIRPYGFWTFDRFNAQLAWDSQISQVPGRRDPYDDLLADEPPTRP

SEQ ID NO: 21437 - protein, 379 aa, Clostridium acetobutylicum ATCC 824
MKSTKILILGAGPAGFSAAKAALGKCDDITMINSEKYLPYYRPRLNEIIAKNKSIDDILIKKNDWYEKNNIKVITSEFATSIDPNNKLVTLKSGEKIKYEKLIIASGSIANKIKVPHADEIFSLYSYDDALKIKDECKNKGKAFIIGGGILGIELAQAIIDSGTPASIGIILEYPLERQLDRDGGLFLKDKLDRLGIKIYTNSNFEEMGDLIRSSCVITAVGVKPNLDFIKDTEIASKRGILVNDHMETSIKDIYACGDVAEFYGKNPGLINIANKQGEVAGLNACGEDASYSEIIPSPILKVSGISIISCGDIENNKPSKVFRSTQEDKYIVCMLKENKIDAAAVIGDVSLGTKLKKAIDSSKSFDNISSLDAILNNL

SEQ ID NO: 21438 - protein, 372 aa, Arabidopsis thaliana
MGWLRKKKKPKSDIASERGAKLLEELIECCDGKSNPIKFFSADEILKATNDFSDSNFVLRLEVPFKWYSGKNENHPMILIKKDVGWWSGLRVDRLCRDIAVSSMVSGHKNFMKLVGCCLELDYPVMVYHSVKKHYKLEISEQPWKKRMKIAEDIATALAYLHTAFPRPFVYRILSHWNILLDEDGVAKLTDFSHCVSIPEGETFVRVDRDVGLYSYFADNYVRSGLVSDKTDVFAFVIFMGHRLLLGYEYYFEHYRGEEEESEDGFDSLMKRHARNLLSTLKEDRPMEEIADSKMIEKMGQISEQERCQMKAFLKLSLRCTGPSEEVPTMVEVAKELNKIQRSLFNDSSSLSSGQTQLDSAQDISSTVVLSN

SEQ ID NO: 21439 - protein, 103 aa, Phanerochaete chrysosporium
MSGRGKGGKGLGKGGAKRHRKILRDNIQGITKPAIRRLARRGGVKRISGLIYEETRGVLKIFLENVIRDSVTYTEHAKRKTVTALDVVYALKRSGRTLYGFGA

SEQ ID NO: 21440 - protein, 859 aa, Legionella pneumophila str. Lens
MSGILIMQQVVIKFGGTSVSTRATWNNIAAITQKHLNTGVQPVIVCSALTQISNKLEKAIEAALLDEHHSLFNDIQSSHLNLAEQLEVNHQLIANDLHQLQQWLTGISLLKQAPAKTHAQILSLGELMMTRMGHAFLERHEIKVKWYDARELLTSTPTLGGETMNYLSARCESEYDPGLVEKFLSSGAQAIITQGFFAANPHGETVLLGRGGSDTSAALLAGKLQAASCEIWTDVPGIYTANPHQLPHARLLKQLNYDEAQEIASMGAKVLHPNCIPPVRKANIPMVVKYTHLPEHSGTLITKDIDESAPLIKSIQVKHSILLISIDTLNMWQQVGFLADVFAAFKKHGFSVDLLSSSEFNVTLSLDVNAKIHDRPAINALLDDLNQFGRAKLIEPCSAVSLVGHHIRTVLPHLGPALEVFEAKQVYLMSLASNDLNLTFVVDESHADKLCQRLHHLLIESNPQIFYYSKSWHEEFGKPNVRPTPWWEIERDRLLTTSAIHSPCYVYHSPTQAIRARQLSALESIDSLFYAVKANPFPSILKTLEKEGIGFECVSIQELELVLKLFPNIKKERILFTPNFAPKSEYEFALQTGCYVTIDSLYPLENWPELFKNREVIVRIDPGTGAGHHKHVSTGGNESKFGITQNDISKILSLTKSNHIKVIGLHAHSGSGILSTDLWQQTAVMLASLTDQFPEVRSINLGGGLGIVEKPGQHPIDFAALDAQLMAVKSQYPGLAIWLEPGRFFVAESGVILAKVTQCKEKGKVKFIGIETGMNSLIRPSLYGAYHEIVNLTRLHEEKAGFAHIVGPICESGDTLGYDRLLPVTKEGDVILIANTGAYGHCMSSHYNLRPPAQEIVLE

SEQ ID NO: 21441 - protein, 184 aa, Pisum sativum
MGSKLPVLFVFVMLFALSSAIPNKRKPYKPCKNLVLYFHDILYNGKNAANATSAIVAAPEGVSLTKLAPQSHFGNIIVFDDPITLSHSLSSKQVGRAQGFYIYDTKNTYTSWLSFTFVLNSTHHQGTITFAGADPIVAKTRDISVTGGTGDFFMHRGIATITTDAFEGEAYFRLGVYIKFFECW

SEQ ID NO: 21442 - protein, 224 aa, Lactuca sativa
  misc_feature (222)..(222): Xaa can be any naturally occurring amino acid
  unsure (1)..(224): unsure at all Xaa locations
LWIHKEDVLICVLPLFHIYSLNSILLWGLRAGAAILIMQKFDIVPFLQLIEKYKVTIGPFVPPIVLTIANNEELVDKYDLSSIRTVMSGAAPLGKELEDTVRMKFPNAKLGQGYGMTEAGPVLAMCLAFAKEPFDIKSGACGTVVRNAEMKIIDPETGASLPKNQRGEICIRGDQIMKGYLNDPEATKSTIDSEGWLHTGDIGYIDDDDELTIVDRLKELIXYK

SEQ ID NO: 21443 - protein, 223 aa, Lactuca sativa
LWIHSEDVLMCVLPLFHIYSLNSILLCGLRAGAAILIMQKFDIVPFLELIQKYKVTIGPFVPPIVLAIAKNADVVDKYDVSSIRTVMSGAAPLGKELEDTVRMKFPNAKLGQGYGMTEAGPVLAMCLAFAKEPFEIKSGACGTVVRNAEMKIVDPDTNASLPRNQRGEICIRGDQIMKGYLNDPEATKRTIVDGWLHTGDIGFIDDDDELFIVDRLKELIKYK

SEQ ID NO: 21444 - protein, 283 aa, Acinetobacter sp. ADP1
MHIATIDYSASNAGQLFAQSLHDTGFAVIVNHPLDWPLIQLIYTEWLAFFKSDAKNQYRVRPEQKGGFFPTDLSETAKGETVKDLKEFFHIFPSGVFPHELSTNTHHYYEQALILAKQLLQWIQDFSPSNVQNAYHEPLPAMIEGSESLLRVLRYTPVDVDHDYIRAAAHEDINLITILPAATAPGLQVKDATGEWYDVPVEPNSLIINIGDMLQEASQFYYPSTTHRVVKYKDQDRLQERISMPFFLQPRGDVVLSARYTAGSYHAERMRELKVIQDGKILL

SEQ ID NO: 21445 - protein, 796 aa, Silicibacter pomeroyi DSS-3
MSTPQDLSHLKTIEQRILWLSHWMIHHANHIRPKVDGIKIGGHQASSASMVSIMTALYFSTLRPEDRVAVKPHASPVFHAIQYLMGNLDRARMENFRGYGGVQSYPSRTKDVDDVDFSTGSVGLGVAVTAFAALVQDYIAAKDWGQGAPMGRMVALVGDAELDEGNVYETLQEGWKNDLRNCWWIIDYNRQSLDGIVREGLFERVEKIFDAFGWDVVRIKYGALQRAAFQEPGGDALRDWIDACPNQQYSALTFMGGAVWRKRLMEDLGDQGPVSALLDRRSDDELAELMENLGGNCVATMAETFAAIDHDRPTCFLAYTVKGWGTPIAGHKDNHGGLMNKTQFAAWQAHMGVPEGQEWEPLATVADPAALRAFLDGVPFFAKGRRRFSDARLAVPGIEIASDREISTQAAFGKVLDDLSKGDSELAARIVTTSPDVTGTTNLGPWVNRRKLFARKDQADAFIEHKIPSTAKWEFTPKGQHIELGIAEMNLMLLLGAAGLSHSLFGKRLIPVGTVYDPFVARGLDALNYACYQDARFLLVGTPSGVTLAPEGGAHQSIGSPLIGMSQDGLAAFEPAFADELAVIMEWAFDYLQRDGEGDPDERTWLRDETGGSVYLRLSTNPIEQPGKRVDDAFRQGAIDGAYWLRKPGPNAEVVIAYQGAVAPEAIRAAGLLGEARRDVGVLAVTSADRLNAGWSAAQRARARDNPAALSHIERLMGELPPHCRLVTVIDGHPATLGWLGSVAGHRTIPLGVEHFGQTGTIGDLYRHFGIDAGAIVERVEGLTSGRPGQPARLVG

SEQ ID NO: 21446 - protein, 312 aa, Acinetobacter sp. ADP1
MSSTPPLLTVIGSINVDHILGLEHFPHPGQTLNGQSYQVAFGGKGANQAVAAGRSGANTSFIACVGSDAVGEQIRHQLIKDNIDTQAVRAVEGFTTGVALIFVNQHAENFIGIHAGANAALDIAYIDQHAELIQRSSAILLQLETPLATILHAAKLAKAAGVKVILNPAPACELPEELLRLVDIITPNETEALSLTNVIVHDDHDAAEAANVLHQKGIKTVVITMGSRGVWLSEYGQGKMIEGFKVSAIDTIAAGDTFNGAFVTALLEGKTAQDAARFANAAAAIAVTRSGAQPSVPWRQEIDLFLSAQTAL

SEQ ID NO: 21447 - protein, 327 aa, Oryza sativa (japonica cultivar-group)
MALILDVARFKYPPHWVPLPLLWEAMNTTDDATGLLRGFMLISRHTAAPSLLYTVSCRDESWKSMAKYCMEDVPDLLKDESVDNVPALLSRLVKSLPANAGNLIKWVIEVRRQEEGGSGLSKEEEERLILKEMILQQVRDTELFRLVRELQFTKQPCCSCSYSSDDDSFTRIAASVCCQGAALLTGNLSSKDGFCCRETCFKCVQVDGDGPKTVVTGTAVSGVNEQSVDMLLPISTLETSVCNSNSSNEVVKYPSRTDILTVLLLALHPSTWVGIKDERLKAEFQSLISTDILHDDLKREILHLRRQLHYVRSCKEEEYGDPVPQSH

SEQ ID NO: 21448 - protein, 355 aa, Prochlorococcus marinus str. NATL1A
MALSYYAEELKKTASAIAQPGKGILAVDESTKTVGKRLASIGVENTEDNRKAYRGMLFTTEGLGNFISGAILFEETLFQNHPDGEPMVKKLEKLGIIPGIKVDKGLRPLAGGHDVETFCSGLDGLVERAADYYEQGARFAKWRAVLQITDDGCPSKLSIRENAWGLARYARSVQESGLVPIIEPEILMDGSHSIEKTAAVQEEVIKEVYLACQVNGVLLEGTLLKPSMTVQGADSSTKADPQQVAEMTIRTMERCVPASVPGITFLSGGLSEEAASVYLNLMNKIDRKAKWNVSFSYGRALQHSCLKAWKGSNTSDGQKALIARAQANSEASKGLYVAGSQPSSDEQLFVAGYKY

SEQ ID NO: 21449 - protein, 305 aa, Pyrobaculum aerophilum str. IM2
MIVASIGNLNFDIYLKVSELPGPDENVEALDLYTGGGGSAANFAVAIAKMGLSARFIGAVGEDPLGEISLRELRAEGVDVSFVKRVRGVRSGVVVVLVHPDGVKRMVSYRGANLGLTPADLTVDKFAGVKHIHLATGRTELILKAKEIAREIGASISVDGGTALARKGLEIVRAAVEGVDVVFMNHVEAQLVANAGDHKSAVEKLARELKVGELVVTLGPIGAVAFKNGRLLHVDAFKVNAVDTTGAGDCFAAAYITMYLRGRDLYERLLFANAAAAIKVTRPSARASPRYDEVVAFLESLGYKI

SEQ ID NO: 21450 - protein, 333 aa, Zea mays
  misc_feature (287)..(287): Xaa can be any naturally occurring amino acid
  unsure (1)..(333): unsure at all Xaa locations
MEKHMAETMIEFDRRIPDALRAAFGIYRASRPTTGQQDDAANLAAVLLAPLDDDGASDPKAIDCDKNPMAMDCASDPIAMGCDLAMELGSCYIKKHDEDDHFGHAEACVIGVADGVGGYRSQGVDASAFSRGLMNNAYAEVAKAPVPGTRFCPRALLERAHQMTAAAHTPGASTAAIVSLVGSTLKWAFVGDSGFAVLRGGRILRRSPTQQHYFNCPYQLSSRQDRTRVADALVGEVAAKEGDIVILGTDGLFDNVFDDEIEGIVRMGTTLGFAPLNMAEVLAGFRXEAAGCDYRDSPYSYLGRRQLGKSLMTGGKPDDITVVVAYIVSPSKI

SEQ ID NO: 21451 - protein, 175 aa, Cryptococcus neoformans var. neoformans B-3501A
MSFARRFVSTASTMSQVYFDIAINNAPAGRITFKLFDDVVPKTARNFRELCTGQNGFGYAGSGFHRVIPQFMLQGGDFTNHNGTGGKSIYGNKFADENFKLRHDRPFLLSMANAGPNTNGSQFFITTVVTSWLDGKHCVFGEVSSGQDLVRKIESYGSDSGKPKAKITITASGTV

SEQ ID NO: 21452 - protein, 251 aa, Arabidopsis thaliana
MPTLYKKAGSMFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 21453 - protein, 328 aa, delta proteobacterium MLMS-1
MSTSREQAREVLRLEAEGIEAVRERIDDAFERAVELIMACPTRLIVSGIGKSGIIGQKIAATMNSTGTPALFLHPVEAMHGDLGIVDPRDVVLAISYSGETAELNLLLPTLKSRGARIIAMTGRPDSGLAAAADAVLNVAVPCEACPLGLAPTASTTATLALGDALAVVLLRRKNFAAGDFRRNHPGGSLGERLKIRVSEVMLTGAEIPTVAEDASLPEAVAELNRKNLGAVLVMAADGETMVGILTDGDLRRMVADGRQADFAELSLTAVMGRDPKCITPELLAADALSIMQRHEVTVLPVTDARRRLFGILHLQDMFGKGEFRFLV

SEQ ID NO: 21454 - protein, 91 aa, Hyacinthus orientalis
MKFVMEFAENLILRMMEDPKERDKRAREHVYAIKDQCKKTKEMWSLPIRPYGFWTFDRFNAQLAWDAQISQVPGRRDPYDDLLADEPPTRP

SEQ ID NO: 21455 - protein, 1117 aa, Kluyveromyces lactis NRRL Y-1140
MSTSIYSSTEPTTSAFNTDEYNPQLVEGVESVLVIGSGGLSIGQAGEFDYSGSQAIKALKEANKKTILVNPNIATNQTSHSLADEIYYLPVTPEYITYIIERERPDAILLTFGGQTGLNCGVALDKAGVLAKYNIKVLGTPIKTLETSEDRDLFAQALKEIDIPTAESIACETVDAALEAADIVGFPVIVRSAYALGGLGSGFANNAQEMKQLASQSLSLAPQILVEKSLKGWKEVEYEVVRDRVGNCITVCNMENFDPLGIHTGDSIVFAPSQTLSDEEFHMLRSAAIKIIRHLGVIGECNVQYALSPDSLDYRVIEVNARLSRSSALASKATGYPLAYTAAKIALGYTLPELPNPITKTTVANFEPSLDYIVAKIPRWDLSKFQHVNRSVGSSMKSVGEVMAIGRNFEEAFQKAIRQIDPSFIGFQGSDEFDDLDNALSEPTDRRWLAVGQALIHEGYSVEKVHELTKIDSWFLFKCMNIVDMYKDLEQVNDLESLDKELLLEAKKLGFSDAQIALCLNKGSDSRTSELEVRSYRKSFGIVPFVKRIDTLAAEFPAQTNYLYTTYNATKSDIEFTDNGVLVLGSGVYRIGSSVEFDWCAVNTTKALRKEGKKTIMINYNPETVSTDFDEVDRLYFEELSFERVMDIYELENSEGCVISVGGQLPQNIALKLLHNGAHILGTSPEDIDKAENRHKFSTILDSIGVNQPEWSELSSVEEAKVFANQVGYPVLIRPSYVLSGAAMSVVTGEHELEVKLTTASDVSPDHPVVMSKFIEGAQEIDVDAVAHNGMVLVHAISEHVENAGIHSGDATLVLPPQNLSQNIKDRLKEIADKVAKAWNITGPFNMQIIKDDRDEGVSLKVIECNIRASRSFPFVSKVLGVNFIEAAVQAFLSKDVPEPVNLMDKAYDYVATKVPQFSFTRLAGADPFLGVEMASTGEVASFGSNALESYWTAIQSTMNFNVPLPPSGILFGGDLSKNYLGEVVKYVAPLGYKLYATNEDTKKYLETFSKGVSVELIEFPKNDKRKLRELFQAKDISAVFNLAAKRAESLEDVDYIMRRNAIDFALPLFNEPQTAMLFAKAMSLKIAEKVKVLESKDVIVPHEVRTWSEYLHCKPI

SEQ ID NO: 21456 - protein, 521 aa, Desulfitobacterium hafniense Y51
MVQTPEDMQARFNIDVRIRSEVIRLDAANKKVLVRSQSRGTYEESYDALILSPGAKALRPNIPGIDSERILTLRNIPDTDAIKGLVDQKGVQSAIIIGGGFVGVEMAENLREQGLNVTLVEAAPHILAPFDTDMVVLAEKKLVAHGIRLILNDGVKSFQDLENQVEVTLASNRKLQGDLIILAIGVIPDTGFLKESGLELGPKGHLIVNEHMATNLPHVYAAGDAVEVLDYITKTKTAIPLAGPANKQGRIAADNIAGLNSTYKGTQGTSIIKIFELTAASTGANERTLQRANLPYHVIHIHPVSHASYYPNAYPMTLKLIFGADGRIFGAQGIGRDGVDKRIDVISTVIRLGGTVEDLTELELAYAPPFSSAKDPVNMAGYVAQNVLTGQAHMLVWDDLNKIDEEYTFVDVRTKIEFAKGHVEGAINIPVDDLRQRIQELDPGKLIVVYCEVGLRGYFAERILTQKGYRVLNLTGGYTTYSVQGFDPNQALDDYKKDFNPYPCCADEDIIDPDTQRIKHQ

SEQ ID NO: 21457 - protein, 326 aa, Coccidioides immitis RS
MKARNGEPLGYKKVWTTLITNTDYLPGLLTLEYSLKRVGSKYPLIALYTDSFPAEGHAALDARRIAKRHIPYLLPSAHKDYSNDTRFYDCWSKLAPFSLVEYDRVVQLDSDMLILQNMDELMDLELDSPALGGTGTRVFAASHACVCNPLNKPHYPPDWTPAHCAFTSQHNTPDKAQVEGAPPTNGLAIPNGGLQVVNPSLGVYNRILECLQTPSSTSNYDFADQSLLADLFPGRWVAIPYIYNALKTLRWKGVHSAIWRDEKVKNIHFILSPKPWDEKWRKHASHEEKIARSANGKADETHDWWWKITNERHAEEKRLGIPRDGF

SEQ ID NO: 21458 - protein, 776 aa, Medicago truncatula
MSNNHLSNGESEPLLRRPLLSSQRSIINSTSQVAIVGANVCPIESLDYEIFENEFFKQDWRSRGVVQILQYICMKWLLCFMIGLIVGFIGFCNNLAVENLAGIKFVTTSNMMLERRFMFAFFIFFASNLSLTLFASIITAFIAPTAAGSGISEVKAYLNGVDAPGIFTVRTLCVKIIGSITAVSGSLVIGKAGPMVHTGACVAALLGQGGSKRYGITWRWLRFFKNDRDRRDLIICGSAAGIAAAFRAPVGGVLFALEEMASWWRTALLWRAFFTTATVAIFLRAMIDVCLSDKCGLFGKGGLIMFDAYSASISYHLVDVPPVFILAVVGGLLGSLFNFMTNKVLRIYNVINEKGTICRLFLACLISIFTSCLLFGLPWLAPCRPCPPDAVEPCPTIGRSGIYKKFQCPPNHYNGLASLIFNTNDDAIRNLFSMHTDNEFELSSMLVFFIICLFLSIFSCGIVAPAGLFVPIIVTGASYGRLVGILVGERTNLSNGLYAVLGAASLLGGSMRTTVSLCVIMLELTNNLLLLPLIMMVLVVSKSVANVFNANVYDLIMKAKGLPYLETHAEPYMRQLTVGDVVTGPLQMFNGIEKVRNIVFILRTTAHNGFPVIDEPPGSEAPILFGIILRHHLTTLLKKKAFLPSPVANSYDVVRKFSSDDFAKKYSVERVKIEDIQLTEEEMGMFVDLHPFTNASPYTVVETMSLAKALILFREVGLRHLLVIPKIPGRSPVVGILTRHDFTPEHILGMHPFLVKSRWKRLRFWQTFLEKILSGI

SEQ ID NO: 21459 - protein, 481 aa, Xanthomonas axonopodis pv. citri str. 306
MFPGEPMSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSAFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 21460 - protein, 545 aa, Burkholderia xenovorans LB400
MDLFGQMMYAPLLLSSLLQQAARHSSKVEIVSRRVEGDIHRYTYRDCHIRAMQLANALTAHGIEAGDRIGTLAWNGYRHMELYYGVSGIGAVCHTINPRLFTEQIAFIINHAQDRFICFDMSFAPLVEQIAHQCPLVEKWIMLCDESALPETFPVPLVSYETLIGAQPQEFDWPRFDEQRAAVLCYTSGTTGNPKGVLYSHRSLSLMAYASALPDTLCLSSTDTVAPVVPMFHVNAWGLPFSAPLVGAKLVLPGAKLDGESLWTLFEQEGVTFSAGVPTIWLGLVDYMRRAGKRSAHFRRAIVGGSACPPQLASSLRELGIKAVHAWGMTELSPLGTVCSPSHDYADKTTEEQKCIDAKQGRVVPGIDLKIVGSGGAELPWDGKSAGDLMARGHWVLDRYYGAGQTALEDGWFSTGDVATIDPDGYMQITDRSKDVIKSGGEWISSIELEHVAMSHPEVESAACIGCEHPKWDERPVLIVVKRPGSTLSAQQLLAFYEGKVAKWWIPDDVVFVPEMPLTATGKLQKLVLKQRFGRYLVDAAKPSA

SEQ ID NO: 21461 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPPVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 21462 - protein, 191 aa, Arabidopsis thaliana
MFAAENGLKGDPRLEAISAAIRVVPNFPKKGIMFQDITTLLLDHKAFKHTIDIFVDRYKDMQISVVAGVEARGFLFGPSIALAIGAKFIPLRKPGKLPGKVISESYELEYGHDRLEMHVGAVEPRERVIIIDDLVATGGTLSAAMSLLESQGAEVVECACVIGLPEVKGQHKLKGKPLYVLVEPSGLDEFC

SEQ ID NO: 21463 - protein, 315 aa, Silicibacter pomeroyi DSS-3
MSNAELVCVGEPLFELSNVGPGKWNAGVGGDVSNVAVAAARQGTRSTMLTQLGDDDFAAEIRNSWAAEGVNDAYVRTLVGAETGMYFITHDAGEHKFEYRRSGSAASQVRPEDLSEGVFDNAAIVHLSGISQAISASARATTDKAIAIAKKKGVKVSYDPNLRLKLWPLEEARKVILDTVRKVDIFLPGLDDARILTGIEEPVDIVRFFADLGAPIIALTMGDRGVLAANDGDMRFISSPKVDAVDATGAGDCFDGAFLSQLINEYSVFDAAAYAATAAAISIQGHGAAKSIPNREAVLALQEQCRGEIWTAPEI

SEQ ID NO: 21464 - protein, 359 aa, Prochlorococcus marinus str. NATL1A
MKSYKITLLPGDGIGPEITNVTHKILDLVSRKFGFEIKFKEMPFGGSAIDSDGIPFPDRTLQECKNSDAVLLAAIGDPKYDELPREKRPETGLLNLRSSLDLFANIRPVKIIPSLTKASSLKEDFVKKVDLVVVRELTSGIYFGEPKGRIKTDKGERAFNTMTYTSEEVKRIAEIAFKLAKQRNQKVCSVDKANVLDVSQLWREETILVSNKYKDIELTHQYVDNAAMQLVRNPSQFDVILTGNLFGDILSDIAAMLTGSIGMLPSASLTTDGPGVFEPVHGSAPDIAGKDIANPIAMLLSAAMMLKIALNEKEAATFLENAINEILNDGYRTSDLMSNQTTKQVGCSQMGELLAEKLK

SEQ ID NO: 21465 - protein, 180 aa, Bradyrhizobium japonicum USDA 110
MGRVEAPCALIVMGVSGSGKSTVAEALGERLGWRFEDGDSFHPASNVEKMKAGHPLTDEDRWPWLNAIADEIERVCKSGKHVIIACSALKHTYRDVLLRGRDDVRFVFLKGTKELIAERLAHRKGHFMPPGLLTSQFNTLEAPEASEHVVTVSIDETVEAIVDGVVRQLKLGGAIPKVLP

SEQ ID NO: 21466 - protein, 598 aa, Yarrowia lipolytica CLIB122
MVQIIHKAPLGDMAESELFYGSIPDFMRSSRFADDDTRISVVDYDTDKAMTLARVFKVSGMLRAQFFHTYDVGKKKDGDANPKVIFYVGNTADNLACHIALHDLGAIISPASTAYDVNDLLHQINVVDAALIVAEAARADVAREAVAKAGDKFKHVKVVVFEELLEQNRRVRPNLIRVAPIVHLSKEQAYTTLAYLGMSSGTSGGVPKAVELTHFAMTSNVQQTAKNAPNLVDDDTVCSAVIPTSHIYGLALFMLHMPFLGAKVVYHKKFDLVEMLEGQKKHGVNYWVLVPPIIVALAKHPIIDRYLDSIRANLKTITSGAAPLGGNVVDAVQTRFTGNTRGTLPNNRRIVIYQGYGLTETAPIACLCDPLWDNLNVVTVGTLVPNTEARIVDENGDDQPAFEVTDARALGDAVRRGDKIPSGELYLRGPQIMSGYHKNPKSTEESFEYVDYKAEGLRHYQDRWLKTGDVAVIDNFGRIQIVDRTKELIKSMSKQVAPAELEALLLSHPDVVDVAVIGVWQEEKATESARAFLVVRDPKVDVVAIKKWMDEQVPSYKRLYGGVVVIDAIPKNPSGKILRRLLRQRKDDVVQGLDQAKL

SEQ ID NO: 21467 - protein, 122 aa, Triticum aestivum
AYLGDSLEQVCTKKQAGTGPEFPGYRRPTRPAGEKPVVLDMYTQWCGPCKVMAPKFQEMSEKDHDVVFLKLDCNQDNRPLAKELGIRVVPTFKIFKDGKVAKEVTGAKIDELARAIEEVKSS

SEQ ID NO: 21468 - protein, 276 aa, Haemophilus ducreyi 35000HP
MARQYAVWGNPIAHSKSPYIHQLFAQQSNRRIEYAAKLGDKIAFEKQLVQFFTDGANGVNITSPFKARAFRLADVCSESCLLAGAANTLKRLDDGRLFADNTDGKGFCADLARLEWLIPEQRVLILGAGGVTKGVLLPLLLAKQKVTLSNRTHIKAVELAQQFAKYGDIQAVSLSEIVQHPPFDLIINATSLGLQGGYIALPNHLFEKSAVYDMEYASNMCTPFLNYVRTQGVTRYQDGLGMLVNQAAFSFQLWEGELPKVENVLKQLRAEMGYVK

SEQ ID NO: 21469 - protein, 449 aa, Deinococcus radiodurans R1
MTSVSPTPDGILRQLQDAEVSFLRLQFTDILGHTKNVEVPRTQFAKALSGDVTFDGSAVQGFTRVEESDMLLSPDLSTFLVYPQFARDDRERGRVARLICDVTLPDGTPFEGDPRRVLRAQVERAQALGLEMYVGTEPEFFLFERGPNGAATTVTHDRAGYFDLAPIDRGERIRREIASRLVEMGFEIEASHHEVAPGQHEIDFRYAPALETADRIATFKFVVKRIALEHGLLASFLPKPIAGVSGSGMHCHLSLFKDGQNVFDDPGGEHGLSDTAHQFVAGLLDHAEGMTAITNPLVNSYKRLVPGFEAPVNIAWSTSNRSALVRIPAKRGPSTRAELRMPDPSCNPYLALAAMLAAGLDGIERQLEPPPAIQRNIFRMTVREKRHHRVKELPGDLREAVDELAKDEVIAAALGEHVMEHYVTAKRAEWREYSSAVHAWELERYLDLV

SEQ ID NO: 21470 - protein, 226 aa, Desulfitobacterium hafniense Y51
MNTSNSKESQTQLPQGIRWNADGLIPVVVQDVDTREVLMLAYMNEEALRRTLQEGRAWYYSRSRQSLWLKGETSGHTQEVVDLRFDCDRDTILLTVRQKGVACHEEFYSCFHYGVQGEGYVTLGAPEEVPAIPLGRTMELLAEVIHSRNMERPEGAYTTYLFDKGLDKILKKVGEECAETIIAAKNSSAEEIRYEVSDLIYHVLVLLEERGVSLEAISQELLSRRK

SEQ ID NO: 21471 - protein, 257 aa, Hyacinthus orientalis
PYRHPPETRLEMPPPTRYFWGDEPEPDEYYASQGVRNSQAYFTTPTGAKLFTQSFRPLPPGPAKAAVFMTHGYGSDTGWLFQKIAIAFASWGYSVHCADLLGHGRSDGLRCYLGDLNSVADAALSYFLSVRNSDEHRHLPAFIFGESMGGLVSLLVYLRSPEPAAWTGLILSAPLFVIPGDMKPSKLRLFAYGLLVRDGGHVAGPMPGQQDGGGRGQRTRRSWKVIAANPKRYTGRPRLGTMTEIARMCDPLQGKFG

SEQ ID NO: 21472 - protein, 223 aa, Idiomarina loihiensis L2TR
MSGNADALKKAAAEAAMQYIEDGTVVGVGTGSTVNFFIDALAERKHDIEGAVSSSEASTERLKSHGIEVFELNSVVEVPIYVDGADEITEHGQMVKGGGGALTREKIIAAVARKFVCVADESKMVGRLGQFPVPVEVIPMARSYVAREIVKLGGDPVWRQGFTTDNGNWILDVHNFDIMEPMKLEAELNNIVGVVTNGLFAQRGADIALIAREDGVQTLKVSG

SEQ ID NO: 21473 - protein, 421 aa, Agrobacterium tumefaciens str. C58
MQEHHVVVVGGGFGGLQLVHGLEGAPVRITLIDRRNHHLFQPLLYQVATTALATSEIAWPIRHLYRDRKEVTTLLAEVTGVDRAARTVQLNSGQVIGFDTLVLATGARHAYFGHDEWERSAPGLKTLEDATTIRRRLLLAFERAELATSEEERQALLTFVIIGAGPTGVEMAGMIAELAHRALPAEFRNVDTRKTRVLLVEAGPRVLPVFTEDLSTYAKEALEKLGVEVLLGTPVTACTDEGVTVGETYYPCRTVVWAAGVQASPAAKWLNAAGDRAGRVIVGPQLHLEDDADIFVIGDTAAVNQENGKPVPGIAPAAKQQGAYVAKVIKARLEGKPIPAPFRYSHQGNLATIGKRAAVIDFGRFKLKGVLAWWIWGLAHIYFLIGTRSRLAVAWSWLWIYLSGQHSARLITQKETLKDEA

SEQ ID NO: 21474 - protein, 196 aa, Desulfitobacterium hafniense Y51
MEMREAYIERQTKETRIRVKLNLDGAGTAQVDTGIGFFDHMLEALARFGYLDLEVAAEGDLQVDPHHTIEDCGLVFGQAIREALGERRGIERVGDTLLPMDEALVQVALDLSNRPYLVWDVECPEGMVGGFPVEMAEEFFRAVSVQAGITLHIRLFSGKNRHHILEAIFKGFGRALGLALRENPRFQGVLSTKGVL

SEQ ID NO: 21475 - protein, 223 aa, Oryza sativa (japonica cultivar-group)
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGIRKISSGSHSLLSLLRKDLRDGSLQSFLGGSSYVSNPPAAAPDPFLSSLICSLPVAEPSKDLHSDSSDNNFLLNKFPDDKTAERAEPSLSEKDQKERAQRSKFVRGLVLSTIFEDDNL

SEQ ID NO: 21476 - protein, 226 aa, Brassica napus
MDSSNSWINCPSVFSSSSSASRRCQQSRSDLYIGGGYEDLEGEDDLKSEFICPFCAEVFDIVGLCCHIDEEHPVEAKNGVCPVCTKRVGLDIVGHITTQHANFFKVQRRRRLRKGGGYSSAYLTLKKELREANLQSLLGGSSSFASSTNIDSDPLLSSFMFNPPSAANKSATPVTEGASATTKLSQKESLKRDIREGPLSGEDREKAKKSEFVRGLFLSTMLGDDY

SEQ ID NO: 21477 - protein, 320 aa, Escherichia coli CFT073
MSKVFTIGEILVEIMASKIGQPFDQPGIWNGPYPSGAPAIFIDQVTRLGVPCGIISCVGNDGFGDINIHRLAADGVDIRGISVLPLEATGSAFVTYHNSGDRDFIFNIKNAACGKLSAQHVDENILKDCTHFHIMGSSLFSFHMVDAVKKAVTIVKANGGVISFDPNIRKEMLDIPEMRDALHFVLELTDIYMPSEGEVLLLSPHSTPERAIAGFLEEGVKEVIVKRGNQGASYYSANEQFHVESYPVEEVDPTGAGDCFGGAWIACRQLGFDAHRALQYANACGALAVTRRGPMEGTSRLMEIETFIQRHDMSIREAAQ

SEQ ID NO: 21478 - protein, 217 aa, Hordeum vulgare subsp. vulgare
MDVGALSSDYSSGTPSPVGADGGNSEGFSTYMTVSSAPPKRRAGRTKFKETRHPVYKGVRRRNPGRWVCEVREPHSKQRIWLGTFETAEMAARAHDVAALALRGRAACLNFADSPRRLRVPAVGASPDEIRRAAVEAAEAFLPAPDQSNAPAEEVAAAPTMQFAGDPYYGMDDGMDFGMQGYLDMAQGMLIAPPPLVGPSATAGDGDDDGEVSLWSY

SEQ ID NO: 21479 - protein, 1115 aa, Mycobacterium bovis AF2122/97
MPRRTDLHHVLVIGSGPIVIGQACEFDYSGTQACRVLRAEGLQVSLVNSNPATIMTDPEFADHTYVEPITPAFVERVIAQQAERGNKIDALLATLGGQTALNTAVALYESGVLEKYGVELIGADFDAIQRGEDRQRFKDIVAKAGGESARSRVCFTMAEVRETVAELGLPVVVRPSFTMGGLGSGIAYSTDEVDRMAGAGLAASPSANVLIEESIYGWKEFELELMRDGHDNVVVVCSIENVDPMGVHTGDSVTVAPAMTLTDREYQRMRDLGIAILREVGVDTGGCNIQFAVNPRDGRLIVIEMNPRVSRSSALASKATGFPIAKIAAKLAIGYTLDEIVNDITGETPACFEPTLDYVVVKAPRFAFEKFPGADPTLTTTMKSVGEAMSLGRNFVEALGKVMRSLETTRAGFWTAPDPDGGIEEALTRLRTPAEGRLYDIELALRLGATVERVAEASGVDPWFIAQINELVNLRNELVAAPVLNAELLRRAKHSGLSDHQIASLRPELAGEAGVRSLRVRLGIHPVYKTVDTCAAEFEAQTPYHYSSYELDPAAETEVAPQTERPKVLILGSGPNRIGQGIEFDYSCVHAATTLSQAGFETVMVNCNPETVSTDYDTADRLYFEPLTFEDVLEVYHAEMESGSGGPGVAGVIVQLGGQTPLGLAHRLADAGVPIVGTPPEAIDLAEDRGAFGDLLSAAGLPAPKYGTATTFAQARRIAEEIGYPVLVRPSYVLGGRGMEIVYDEETLQGYITRATQLSPEHPVLVDRFLEDAVEIDVDALCDGAEVYIGGIMEHIEEAGIHSGDSACALPPVTLGRSDIEKVRKATEAIAHGIGVVGLLNVQYALKDDVLYVLEANPRASRTVPFVSKATAVPLAKACARIMLGATIAQLRAEGLLAVTGDGAHAARNAPIAVKEAVLPFHRFRRADGAAIDSLLGPEMKSTGEVMGIDRDFGSAFAKSQTAAYGSLPAQGTVFVSVANRDKRSLVFPVKRLADLGFRVLATEGTAEMLRRNGIPCDDVRKHFEPAQPGRPTMSAVDAIRAGEVNMVINTPYGNSGPRIDGYEIRSAAVAGNIPCITTVQGASAAVQGIEAGIRGDIGVRSLQELHRVIGGVER

SEQ ID NO: 21480 - protein, 336 aa, Escherichia coli CFT073
MSALPGPIAKGFRNERGFVTTTICAMGELLAEFLSRNPHQKFTQPGEFIGPFPSGAPAIFAAQVAKLSHRAIFFGCVGNDDFARLIIERLRHEGVITDGIHVMNNAVTGTAFVSYQNPQQRDFVFNIPNSACGLFTAEHIDKDLLKQCNHLHIVGSSLFSFRMIDVMRKAITTIKSAGGTVSFDPNIRKEMLSIPEMAQALDYLIEYTDIFIPSESELPFFARHKNLSEEQIVSDLLHGGVKHVAIKRAQRGASYYKLKNGTLHAQHVAGHDIEIIDPTGAGDCFGATFITLFLSGFPAHKALQYANASGALAVMRQGPMEGISSLADIEDFLQQH

SEQ ID NO: 21481 - protein, 692 aa, Bradyrhizobium japonicum USDA 110
MRLTAGSPARLGASWDGRGTNFALFSANAQKVELCLFDTQGRRELERVELPERTEDVWHGYLNDVSPGQLYGYRVHGPYEPEHGHRFNANKLLLDPYAKRLSGRLVWSDAHFAYRTGSPREDLSFDRRDNARGMPKAVVVDETFNWGRREIRPNIAWEDTIIYEAHVKGLTQKRDDVPPNLRGTYGGLSSPAMIEHLKKLGVTTIELLPIHSFVDDRILVEKKLANYWGYNTLSFFAPEPRYAQDNALDSFRTTVARLHDAGIEVMLDVVYNHTAEGNHLGPTLCYRGIDNASYYWLNRENPRYYDDFTGCGSSVNLTHPRVLQMVMDSLRYWVEVCHVDGFRFDLATTLARGPNGFDRGSSLLTAIRQDPVLAAVKLVAEPWDLGLGGYQVGAFPSQWSEWNDRYRSAMRRYWSGEGSLIGDISSRMTASSDLFNHDGRRPRASINHITVHDGFTLADLFSYNEKHNEANGEDNRDGSNDNHSNNCGVEGPTDDPGILGLRRQLRKNVLACLMLAQGVPLLLAGDEVGNSQSGNNNAYCQDNEVGWVGWGNLGKDGDDMVDFVAGLADIRRRFSQLRSHRWLDGRPKDGLSYGALWLTPAGEEMTENDWKFPEGRFLSYVMGPMEPGGAAIFIVLNAAPEEIAFKLPKMTEYKSWQQILNTTDAKLNTIDFQPGSDSKAPPRSVLAFAGAL

SEQ ID NO: 21482 - protein, 435 aa, Acinetobacter sp. ADP1
MNHMKKNILFDGLRSVARIGETAFVAARAGIKYATEKPSNAKLMRETFESLGSTYIKLGQFIASTPSLFPREYVEEFQGCLDQTPTLPFSYIQEVLAEEFEGRDLNQIFASIDETPLASASIAQVHAARLTTGEDVVIKVQKPGVETILYTDLNVVHWATKMLEKAIPKVKFASLSEIVEEIKIRMVREVDFIEEAQNLDDFVEYLKITNNQAATAPKVYHQFSTRRILTMERLYGVSLTDFDIVKKFAKDPSQVLITAMNTWFGSLMLCKSFHADLHAGNLMLLEDGRIGFIDFGIVGQLNPQVWTACLAFMDALQKTDYTAMAENMLKMGMTKTQIDTQVLAQDLERLFSGVLLADPQEILASKPSDLNDIMLDMVAVGERHGIKFPRDFALLFKQMLYFDRFMRVLAPYTDIYADQRLKMVQTIEPQSLLKH

SEQ ID NO: 21483 - protein, 315 aa, uncultured bacterium
MLHPSAKALLDMMVEKQVPPTHTLTPEQARHFYRERRFATQPAAPEVAESRDLSAEGPNGPIPLRMVRPKGSTPEQVLPVLVYYHGGGWVIGDLDTHDTLCRELANAAGCAVIAVDYRMGPEFRFPAAPEDCIAATRWIRANAASLKIDADRLAVGGDSAGGNLAAVVALAARDAGDLPIRFQLLIYPATDAHCGSASYHANGQGYLLTKDTMAYFYGHYIDDEGHKDDWRASPLRAASHANLPPALVITAGFDPLRDEGLHYAQKLSEAGNRATHISFERQIHGFITMGKVIDESNAAVALCASMLRDALAPSA

SEQ ID NO: 21484 - protein, 431 aa, Prochlorococcus marinus str. MIT 9313
MKRVLAIILGGGAGTRLYPLTKMRAKPAVPLAGKYRLIDIPISNCINSSINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESARNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGQGTTVKGAILDKNTRIGNNVTIVNKDHVEEADRADEGFYIRNGIVVVVKNATISDGTVI

SEQ ID NO: 21485 - protein, 547 aa, Haemophilus ducreyi 35000HP
MRNINPTDTMAWQALVQHKAEHLSIPQLFAENEDRFATYNLSFEDQILVDYSKNAINQKTLTLLRQLAKECDVDGARQAMFSGEKINRTENRAVLHIALRNRANKAIFVDGKDVMPAVNAVLAKMKAFSEKVIKGDWKGYTGKAITDVINIGIGGSDLGPYMVTEALRPYKNHLNMHFVSNVDGTHIAEVLRKVNPETTLVLVASKTFTTQETMTNAFSAREWLLADAKDQSAVAKHFVALSTNSETVAKFGIDTENMFEFWDWVGGRYSLWSAIGLSIVLSIGFANFEQLLEGAYAMDKHFYHTADEQNIPLTLALVSIWNNNFLGAQTEAILPYDQYLHRFAAYFQQGNMESNGKYIGRDGKAVNYQTGPIIWGEPGTNGQHAFYQLIHQGTTLIPCDFIAPAQTHNPLSDHHNKLLSNFFAQTEALAFGKSKAQVELEFTQQGKSLDEVKDIVPFKVFTGNKPTNSILLKKVTPYSLGALIAMYEHKIFVQGVLFNIYSFDQWGVELGKQLANRILPELEDDQPVVSHDSSTNGLINQFKAWRE

SEQ ID NO: 21486 - protein, 304 aa, uncultured bacterium
MAGLLDRIQRARRMPLHAMTPQAARQAYEAAAEVLDLPRAPLPRVEDLQLPVGDGVVRPARLYAAGSGRLPVLLYLHGGGFTIGGLETHDSLCRQLALRSGGAVVALDYRLAPEHRFPAAVDDAWGAMRWLLEHADDLGLDASRLAVGGDSAGGTLAAVCALHARDRGWPLALQLLITPGTTAHADTGSHRLFANGFLLDAAAIEWFFEHYIDWHHRRDWRFAPLLADDVDGVAPACLILAECDPLVDEGLAYADRLRAAGVPVDLELFRGVVHDFIKMGRALREAGAAQQAAADALARAWGLR

SEQ ID NO: 21487 - protein, 839 aa, Deinococcus radiodurans R1
MTSYSRPSRFDLQRPEVRERLWSAAATFTLHAALIAGLALARPQPQASVAAVPDTRHAPLEVVALAPEVPNSNAAAPLSTSPLAASPNKPAPATKPTPTPAKPATPAPEPPKPPEPTPPEPKPETPPEPPKPAPEPPKPDPTPAEPLKPPVQDTPPPVTPKPVTPEPVTPKPAPTPPEVLQPPVAQTPPVAKPPVPAPTSQTPTPPVQPAPTRTPPPQAARPTPNAPAQTPAPATQAPAAQTPTAQAPATQTPATPAPAAQRPAGGAPSPAPAPAQANAPAGSVVPEATVPESSTPAAPSAQTPPTPTRETAQTEASPAAPNSSAAAPNEPASEPVAGRPGTAASSPESASPVTVTPRGETPDTAASAGTPSAGRVTPAPAPSASEGASAARTPGAGSQTPPIPATPIPATPAGRSSGESAGTAAARPNAAPAPVSEDRSDVSGLPRREDAPAESSPVAASPARGASSAPSSAPAAAVPSRAPVSGGSVSAPRTAPTAPVAEQGEVPVSPSAAAPRGGASSAAAPSAPAAARGGSGAAGGAAGGASAPAAARPAQTPGASAGGASGGGEGVSARPSQGGTPSGTPASAPVAAGRPAGGEGSGSGTSGSGSGAPAAARPGQGGSGDAPVDLGLTSGRGGSGAGNGGAGTGETGAGTPSASRPGSGGTGNGSGTGEGSGTVPASGRGTGGSGTGTGNGGGAGEGAGVGAVARGGGGAGQGAGNETRPLTCTVVVDVRGLGKLESAMTSFVMDSAGNQVWPDAELIKGVATQLVQEGNLQEYTRSEAGLAQLKNVTRVKASRLLRPKQSPGAPYFADVELSADAAQTFRSAGKACKVVYLRD

SEQ ID NO: 21488 - protein, 82 aa, Hyacinthus orientalis
  misc_feature (17)..(17): Xaa can be any naturally occurring amino acid
  unsure (1)..(82): unsure at all Xaa locations
AGFSSRWEHHLFPRLPXMPFEEDLANCQGNIARKHNLTYNSASFIEANRKTLRVLKAAALQARDWTNPAPKNLLWEAVNTVG

SEQ ID NO: 21489 - protein, 508 aa, Vitis vinifera
MAIDTSLLLEFAAATLLFFITRFFIRSLLPKPSRKLPPGPKGWPLLGALPLLGNMPHVALAKMAKRYGPVMFLKMGTNSMVVASTPEAARAFLKTLDINFSNRPPNAGATLLAYHAQDMVFADYGARWKLLRKLSNLHMLGGKALEDWSQVRAVELGHMLRAMLELCQRAEPVVVPEMLTFSMANMIGQVILSRRVFETKGSESNEFKDMVVELMTSAGYFNIGDFIPSIAWLDIQGIQRGMKHLHRKFDWLLTKMMEEHTASAHERKGNPDFLDVIMANQENSTGEKLTITNIKALLLNLFTAGTDTSSSVIEWSLAEMLKNPSILKRAHEEMDQVIGRSRRLVESDLPKLPYLQAICKESFRKHPSTPLNLPRVSTQACEVNGYYIPKNTRLSVNIWAIGRDPDVWESPEEFRPERFLSGRNTKIDPRGNDFELIPFGAGRRICAGTRMGIVLVEYILGTLVHSFDWKMPDEVEINMDEAFGLALQKAVSLSAMVTPRLHQSAYAV

SEQ ID NO: 21490 - protein, 429 aa, Nostoc punctiforme PCC 73102
MSKFLDTAIEAIAAREILDSRGRPTIEAEVHLANGVVGLAQVPSGASTGSFEAHELRDGDKSRYGGKGVLKAVKNVKEALAPKLLGLDALNQELLDRTMIAIDGSPNKSSLGANAILGVSLAAAKAGAESLDIPLYRYLGGPLANLLPVPLMNVINGGAHASNNVDFQEFMIVPIGATSFREALRWGAEVFATLSQVLDEKGLLTGVGDEGGFAPNLESNQVALELLVAAIKKAGYKPGEEVALALDVAASEFYKNGQYVYDGKPHAPAEFIDYLGQLVDQYPIVSIEDGLHEEDWQSWQLLTQKLGSQVQLVGDDLFVTNATRLQRGIEEKAANAILIKLNQIGSLTETLETIDLATRNSIRSVISHRSGETEDTTIADLAVATRAGQIKTGSLCRSERVAKYNRLLRIEDELGDRAVYAGAVGLGPK

SEQ ID NO: 21491 - protein, 509 aa, Vitis vinifera
MNPLALIFCTALFCVLLYHFLTRRSVRLPPGLKPWPIVGNLPHLGPVPHHSIAALAKTYGPLMHLRMGFVDVVVAASASVAAQFLKTHDANFSNRPPNSGAKHIAYNYQDLVFAPYGPRWRMLRKICSVHLFSGKALDDFRHIRQEEVAVLTRALARAGQTPVNLGQLLNVCTTNALGRVMLGRRVFGDGSGGEDPKADEFKEMVVELMVLAGVFNIGDFVPALEWLDLQGVAAKMKKLHARFDAFLGAIVEEHKISGSAGSERHVDLLSTLISVRDNADGEGGKLTDVEIKALLLNLFTAGTDTSSSTVEWAIAELIRHPEMMAQAQQELDAVVGRSRLVTDLDLPQLTYVQAIIKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKLNMDEAYGLTLQRAAPLMVHPLPRLSPQVFGK

SEQ ID NO: 21492 - protein, 517 aa, Lolium rigidum
MDKAYIAILSSAFLFLVHYVLGKVSDGRRGKKGAVQLPPSPPAVPFLGHLHLVEKPIHATMCRLAARLGPVFSLRLGSRRAVVVSSSECARECFTEHDVTFANRPKFPSQLLVSFNGTALVTSSYGPHWRNLRRVATVQLLSAHRVTCMSGVIAAEVRAMARRLFHAAEASPDGAARVQLKRRLFELSLSVLMETIAQTKATRSEADADTDMSLEAQEFKEVVDKLIPHLGAANMWDYLPVMRWFDVFGVRSKILHAVSRRDAFLRRLINAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFKPERFEDGKAEGLFMIPFGMGRRRCPGETLALRTIGMVLATLVQCFDWEPVDGVKVDMTEGGGFTIPKAVPLEAVCRPRVVMRDVLQNL

SEQ ID NO: 21493 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHATEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVSETLRLYPAAPLLLPHESSADCKVGGYNVPADTMLIVNAYAIHRDPAAWEDPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 21494 - protein, 517 aa, Lolium rigidum
MDKAYIAILSCAFLFLVHYVLGKVSDGRRGKKGAVQLPPSPPAVPFLGHLHLVDKPIHATMCRLAARLGPVFSLRLGSRRAVVVSSSECARECFTEHDVTFANRPKFPSQLLVSFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLVFRPERFEDGKAEGLFMIPFGMGRRRCPGETLALRTIGMVLATLVQCFDWEPVDGVNVDMTEGGGFTIPKAVPLEAVCRPRAVMRDVLQSI

SEQ ID NO: 21495 - protein, 145 aa, Prochlorococcus marinus str. MIT 9313
MTRSLQVHLAIATAVVGMSTPAALSQEGSPSAPVEDGGLITIESDIQNADSVTGVFTAIGNVRIVYPARGIVATSRQAQYFSKEDRVVLTGDVDVIRDGKNSMQAERVVYLLEEEQAVADPSTGAQVFTSVQLNSNKQAEAPLAQ

SEQ ID NO: 21496 - protein, 451 aa, Silicibacter pomeroyi DSS-3
MKTANFIKENNARQFWQPMTHPADAQANPPKIITGAAGVRIRDIDGHETIDAVGGLWNVNLGYSNDAVKQAITGQLDSLPYYSTFRGTTNDAAIELAYDLCDFFAEEGIQRVFYTSGGSDSVETALRLARQYHKLRGQPQRTKFLSLKKGYHGTHFGGASVNGNNKFRTDYEPLLPGCFHIPAPYTYRNPFNETDPARLAQLCAQALEDEIAFQGAETIAAFIMEPILGAGGVIPPHESFMPMVREICDRNGILLIADEVITAFGRTGAWSGSRLWGVQPDMMCTAKAITNGYFPFGAVLIGTRMTEVFEGDTSGKGAISHGYTYSGHPVGAAAAVVCLKETVKANVAENAATRGEELFNGLQALAAKHEMIGDVRGGHGLMAALEVVADRASKAPAGAAMMNTVYETAYGAGVMLRVSGPNIILSPPLVLSAQDVADILSALDAGFAALG

SEQ ID NO: 21497 - protein, 492 aa, Silicibacter pomeroyi DSS-3
MDQAAIDALRTRVIPPRGHVIGGRVEGGGETLDVISPIDGSVLTQIARGGAREVAQATAAARHAFTSRIWAGQPPAARKKVLTRLAELIEGEALDLAVQGVRDNGTEISMAFKAESGSAAGTFRYYAEALDKVYGEIAPTAGDILGLVHKEPVGVVGAILPWNFPLMIGAWKIAPALAMGNSIVVKPAESASLSILRLAELALEAGLPEGVFNVVTGKGSEVGEAMGLSMEIDILVFTGSGAVGRRLLEYSARSNLKRCYLELGGKSPNVVFADVADLDHAAKVSAAGIFRNSGQVCVAGSRLIVERSIHDEFVDALCRHASALRVGDPLDLGSTVGAVHSVAQLEQNLRFVETALAEGADCALGGKRILEETGGYYMQPTVMTGVTRDATLNQQEVFGPVLAVSAFDTEGEAVDLANSTVYGLASGLWTSDLGRAHRMVRAIRAGVVHVNTYGGADGTVPLGGVGQSGNGHDKSLHALDKYVDLKTAWMQL

SEQ ID NO: 21498 - protein, 118 aa, Medicago truncatula
MNGSAFLLFGVIFLTGWGSAEVVYNRRSDAFAALKRYNNVLLDGKPMKIEIVGTNSELPVTARVNVSAMNRQRKRTFVMTYCSASAFGVAEFVVTIGLFVSVTRLDCLQSVQFFQLLA

SEQ ID NO: 21499 - protein, 305 aa, Bradyrhizobium japonicum USDA 110
MFTPPAAWFTGFIPDLPTPFDAADTIDLKAFTALCERQIAAGVPAIVVCETAGEAPTLSPAEQELVIRAAVDVARGRVRIIAGAMSNATSQAIALARCAEAAGADAVMAVVPAYNKPMQEGMLAHFRAIAGATGLPVILHDIPSRTLRPLADETLVRLVESRQFVGLRDGSCDIARPMRLARLLPAGFRLLSGDDVTAFGYIASGGDGAISEVSNIAPDLCRMIFSQVRQGRLQSARYLHRRLIPLITCLSKDSPAALKSALSVLGLMSPATRLPIVPLDAAAQREVIRAFAAIADEELIDRVGA

SEQ ID NO: 21500 - protein, 453 aa, Xanthobacter autotrophicus Py2
MTSRTEFAREAEGRASVSAKVSLDLAKIAKERGIKYFLISYVDLFGGLRAKLVPASAIGPMQKEGAGFAGFATWLDMSPADPDLFAVPDPTSLIQLPWKEEIGWLAADLYMGGEEVAQGPRTVLKRQLAAAAALGYEVKTGVECEYFLITPDGKGISDTSDTAEKPCYDQSALMRRYDVIKDICDAMIKLGWGAYQNDHEDANGQFEMNWNYDNALLTADRHVFFKYMVKSIAEQHGLRATFMPKPFINLTGSGCHAHVSLWSKGKNAFSDPKGELGVSQLGYHFIGGLIHNADALCAITNPTVNSYKRINAPRTISGATWAPNTVTYTGNNRTHMIRIPDAGRFEFRLADGAANPYLLQAGLTAAGLDGIENQRDPGKRLDINMYTDGHKVKGAKRLPLNMLDALRALEKSRVLGERLGQPFVTGYLKLKNEEWNAYSRHLTQWERDNTLDI

SEQ ID NO: 21501 - protein, 344 aa, Magnaporthe grisea 70-15
MDIVLEITDTFLWDYMYAFVAPATAPPYDYPNLSNGTAVAHNGWEYKPTTALFSLEPSQAAYQSALPRDNIYRQGISLFLIYWIFGVLVYYIFATASYLFIFDKKQMEHPKFLKNQIKLEMIQANKAFPIMALYTVPMILLEIRGYSKLYDSADEAPAWWYNYIQFPLFLVFTDFCIYWIHRWLHAPIFYKRLHKPHHKWIMPTPFASHAFHPLDGYAQSFPYHLFPFIFPLQKVAYIGLFVFINIWTILIHDGEYVANNPIINGAACHAVHHFAFNYNYGQYTTLWDRLGGSYREPDADLFDLKAKMSKEQWNKQAKEMENLVQQIEGEDDRVYGEISDKKTR

SEQ ID NO: 21502 - protein, 182 aa, Musa acuminata
FGVVYRGELKDTNEIVAVKQLDRNGFQGNREFLVEVLMLSLLHHPNLVKLLGYCADGDQRILVYEYMPLGSLEDHLLDVSADAKPLEWHTRMKIAAGAAKGLQCLHETANPPVIYRDFKASNILIDEDYNAKLSDFGLAKIGPVGDKNHVSTRVMGTYGYCAPEYALTGQLTKMSDVYSFGI

SEQ ID NO: 21503 - protein, 216 aa, Glycine max
KELSLHPRIPGTCCDSRVKGEFFHQTTFSISLSVAKKFIEDVQKLVQLEPKGFCGIELYNGILMRYVKASSAYLGKQEDALDIDITYYRSKDPMTPRLYEDILEEVEQLGIFKYGGLPHWGKNRNLAFEGAIKKYKNAGRFLRVKEKYDLQGLFSSTWTDQMLGLKDGVTILKDGCALEGLCICSQDSHCNPSKDYYCKPGKVYKEARVCTHLKSK

SEQ ID NO: 21504 - protein, 522 aa, Escherichia coli CFT073
MRSRGSDMTDHTMKKNPVSIPHTVWYADDIRRGEREAADALGLTLYELMLRAGEAAFQVCRSAYPDARHWLVLCGHGNNGGDGYVVARLAKAIGIDVTLLAQESDKPLPEEAALAREAWLNAGGEIHASNIVWPESVDLIVDALLGTGLQQAPRESISQLIDHANTHPAPIVAVDIPSGLLAETGATPGAVINADHTITFIALKPGLLTGKARDVTGQLHFDSLGLDSWLAGQETKIQRFSAEQLSQWLIPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPGEAARLLGCSVAEIESDRLHCTQRLVQRYGGVAVLKGAGTVVAAHPDALGIIDAGNAGMASGGMGDVLSGIIGALLGQKMSPYDAACAGCVAHGAAADVLAARFGTRGMLATDLFSTLQRIVNPEVTDKNHDESSNSAP

SEQ ID NO: 21505 - protein, 361 aa, Aspergillus nidulans FGSC A4
MVQQMPPQGGSRKISFNVSDQYEIQDVIGEGAYGVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASTDDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPFKALFPKSNDLALDLLEKLLAFNPTKRITVEEALRHPYLEPYHDPDDEPTAPPIPEGFFDFDKNKDALSKEQLKSKYLAPIDSISYATIN

SEQ ID NO: 21506 - protein, 173 aa, Hyacinthus orientalis
MDAAATSLPTNPNPKVFFDMSIGGAPAGRIVMELFADVTPNTAENFRALCTGEKEPGRSGKPLHYRGPPSTGVIPGFMCQGGDFTAGNGTGGESIYGSKFEDQNFERKHTGPGILSMANAGPNTNGSQFFICTDETDWLDGKHVVFGQVVDGMEVVEAIQKVGSRGGTPKNPL

SEQ ID NO: 21507 - protein, 609 aa, Xanthobacter autotrophicus Py2
MKLRNIAIIAHVDHGKTTLVDELLKQSGSYRENQRVAERVMDSNDLEKERGITILAKATSVVWKDTRINIVDTPGHADFGGEVERILNMVDGAIVLVDAAEGPMPQTKFVVGKALKVGLKPIVAINKVDRSDARITEVVNEVFDLFAALDATDEQLDFPILYGSGRNGWMAESPEGPSDQGMSPLFDLVLKHVPEPTVDDGPFRMIGTLLEANPFLGRMITGRITSGSIKPNQPIKVLAQDGSLVEQGRVSKILAFRGIERQPIEEGVQGDIVAIAGLSKGTVADTFCALEVTEPLAAQPIDPPTVTMTFIVNDSPLAGTEGDKVTSRVIRDRLLREAEGNVALKIEESTEKDSFFVSGRGELQLAVLIETMRREGFELAVSRPRVVFQKDEATGQALEPIEEVLIDVDEEYSGTVVQKMSERRAEMVEMRPSGGNRQRLVFYAPTRGLIGYQSELLTDTRGTAIMNRLFHEYAPYKGEIAGRVNGVLISNEQGEAVAYALWNLEDRGPMIIEPGWKVYQGMLVGIHNRDNDLEVNVLKGKKLTNIRTTSKDEAVRLTPPIRMTLERALAWIQDDELVEVTPKSIRLRKRYLDPNERKREERKKETELA

SEQ ID NO: 21508 - protein, 460 aa, Aspergillus nidulans FGSC A4
MALPLRTARHASRLAQTIGRRGYATAEPDLKSALKAVIPAKRELLAEVKKQGDEVIGEVKVSNVIGGMRGLKSMLWEGSVLDADEGIRFHGKTIKDCQKELPKGPTGTEMLPEAMFWLLLTGEVPSTSQVRAFSKQLAEESHLPDHILDLAKSFPKHMHPMTQISIITAALNTESKFAKLYEKGINKADYWEPTFDDAISLLAKIPRVAALVFRPNEIDVVGRQKLDPAQDWSYNFAELLGKGGANNADFHDLLRLYLALHGDHEGGNVSAHATHLVGSALSDPFLSYSAGLLGLAGPLHGLAAQEVLRWILAMQEKIGTKFTDEDVRAYLWDTLKSGRVVPGYGHGVLRKPDPRFQALMDFAATRKDVLANPVFQLVKKNSEIAPGVLTEHGKTKNPHPNVDAASGVLFYHYGFQQPLYYTVTFGVSRALGPLVQLIWDRALGLPIERPKSINLLGLKK

SEQ ID NO: 21509 - protein, 331 aa, Idiomarina loihiensis L2TR
MTIKVGINGLGRIGRLALRVAWENPDLEIVQVNDPGADAATFAHLLNFDSVHGRWGYEAEAQDNAIQIGDERIAFTQHKTIAENDWSGCDVVLEASGKMKTVKVLNDYLSQGVKRVVVSAPVKEPGALNIVLGVNDHLYDPEKHQILTAASCTTNCLAPVVKVLQDKIGIKHASITTIHDLTNTQTILDAPHKDLRRARACGMSLIPTSTGSATAIVEIFPELKDKIDGHAVRVPLANASLTDCVFEVKKSTSVEEINGWMKEAAEGELKGILGYEERPLVSIDYKTDPRSSIVDALSTKVINGTHVKIYAWYDNEWGYANRAVELVEKVG

SEQ ID NO: 21510 - protein, 588 aa, Actinobacillus pleuropneumoniae
MSDKKIKGLEWQEKPLSDNERLKTDSNFLRGTILEDLKDGLTGGFKGDNFQLIRFHGMYEQDDRDIRAERLEEKLEPLKFMLLRCRLPGGIIKPYQWIEIDKFAREHTRYQSIRLTNRQTFQYHGVPKGKLQPMHRLLHSIGLDSIATAADMNRNVLCTSNPIESELHQQAYEFAKKISEHLLPRSRGYLDVWVDGKKIESSDDLLKIEDEPILGKTFLPRKFKTAVAIPPLNDVDVYANDLNFIAIQDDNGQLCGFNVLVGGGLSFEHGNTKTYPNVAYSLGFVPLEHTLAAAEGVVKTQRDFGNRSDRKNARVRYTIQNMTLDGFRAEVERCMNIKFEPTRPYEFTERGDRIGWVKGIDNNWHLTLFIESGRITDKPEKPLMTGVLELAKVHKGDFRITANQNLIVANVAEQDKAQIEAIARQYGLIQEISKLRENAMSCVSLPTCPLAMAEAERVLPDFISELDKVLSKHNVADESIITRITGCPNGCGRAMLAEIGLVGKAIGRYNLHIGGDRAGLRIPRLYKENITLQEIVNEIDQLVARWATERQTNEAFGDFVIRSNIIAPVVNAHIDFWDATKIIPTTII

SEQ ID NO: 21511 - protein, 507 aa, Lolium rigidum
MNLEVAFLHEYASPRALVVAVVLVLVAVHLARSTSRAERLRRKLPCPRFTLPVIGHLHLIGSLPHVGLRDLARKHGPDVMLLRLGAVPTLIVSSPSAARAVLRTHDHVFASRPDTVVGDILFVGSTNVGHSPYGEYWRQVRKIITTHVLTAKKIRANLPYREQEARLALASVREAAAAGTAVDLTHLFSHFAHDMVSQAVAGRIHREDRWGKLFHDLFVGNGQLLGGFNLDDCFPSLARLGIGSANIAKQRKRWDDLLDEVIDRHTSTPMEKGDEPDFIDVMLSVQDEYKLTRNNIKSILMDMFQAGTDTTFIWLDYAMAELARAPQVMAKLQAEVRRCSTTNQLLTQEDLSSMSYLKAVMKETMRLHPPGPLLLPHASIADCEVEGYVVPAGTRVIINVWAIGRHASSWERAEEFVPERFLEGSVDANSDFYGNDFRLLPFGSGRRMCPGINFATLTFEIILANLIYHFDWELPEGSPGVDMTEAFGMDVHRKENLLLVPRVAKIV

SEQ ID NO: 21512 - protein, 539 aa, Aspergillus oryzae
MGILNVVEDRPTPKSVYNWRVYLLAGIASCGSNMIGYTSAFIGTTITLDSFKEEFGLDKMSSAKVDLISENIVSLFIAGAFFGALLTYPVGHFLGRKWSLVIASAIFTLGAGLQLGANHSRGLGIMYAGRVLNGLGTGVASNIVPIYLSELAPPAIRGRLVGLYELGWQIGGMVGFWINYGVQKNMEPGHTQWLIPFAIQLIPAGLLFAGALWTKESPRWLFLKDRRQEAMANLCWIRQLSETDIYITEEVAAIDQALEEQAATIGIGFWKPFQSVGTRPKIMWRLFLGCMLFFWQNGSGINAINYYSPTIFKSIGVNSDTIGITTGLFGVVKAVMTFVWLLFLVDQLGRRKLLLIGAITGSICMWIIGAYICVVQPEENPTDHLNGGGIAAIFFFYLWTAIYTPTWNGTPWVINSEFFDPNIRSLAQAATTASNWLFNFLVSRFTEQMFAKMGYGVYFFFAALSFLAFFFTFFLIPETSGVPLEVVDRLFEVKPVWRANETVKAQMKEEEERFRFEIKEGNFDKSEEEHVEDGNETRS

SEQ ID NO: 21513 - protein, 510 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGPSTPVNLSVMFHSITNSIVARATFGKKRKNAAEFMAAIKSGVGLASGFNIPDLFPTLTTVLATITGMKRSLHGIHTSHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASGLRYLKLVIKEALRLHPPAPLLVPRESIDVCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 21514 - protein, 507 aa, Lolium rigidum
MDELFLLSVLLAAAAVALLQVLKVALNPVSDRAPPGPWKLPVIGSMHHLVNVLPHRALKDLADVHGPLMMLQMGQTPLVVASSKETARLVLKTHDTNFATRPKLLAGEIVGYEWSDIVFSPSGDYWRKLRQLCVAEILSPKRVLSFCHIREEEVGIRVEQIRAAGLSTPVNLSVMFHSITNSIVARATFGKKRKNAAEFMAAIKSGVGLASGFNIPDLFPTLTTVLATITGMKRSLHGIHTTVDTILEEIINERNIARAEKIKAGATENVDENLTDVLIGLQGKGGFGFHLDNSKIKAIILDMFAGGTGTSASAMEWGMSELMRNPAVMEKLQGQIREAFKGKTVVTEANLQASELRYLKLVIKEALRLHPPAPLLVPRESIDMCELEGYTIPAKSRVVINAWAIGRDPRYWDDAEEFQPERFEDGTVDFTGSNYEFLPFGAGRRMCPGFNYGLASMELALVTLLYHFDWSLPEGVAEVDMEEAPGLGVRRRTPLMLLATPFVPVVA

SEQ ID NO: 21515 - protein, 598 aa, Prochlorococcus marinus str. MIT 9313
MTEGQTTSGQAADLKFAACLASGAEQSKFEQFKADSCYLLDPLAAELENSSDHFSNDAVQLLKFHGSYQQDNRDNRQKGAGKDWQMMLRLRSPGGRIPPALFLALDDLSNRLGNGSLRATTRQAFQIHGVRKEDLREVISTIIRSMGSTLAACGDITRNVMAPAAPYEKGGYPAARQLANEIADVLSPTAAEGSYLDLWVNGNATYRIRPSRRVKKVRTRQHQGNVFSGDAKEPLYGTTYLPRKFKCAVTVPGDNSVDLLTNDIGLVVFTAANGEIKGCNVYVGGGMGRTHNNEQTFARTADPLGYVAAEHVLDLVQSILALQRDYGDRKTRRHARMKYLLNDHGISWFKQELKSKYFLHPIKALRPEPKSKLEDYLGWHQQSVGQWFVGLPLLSGRLEGDLKKGLRQLVETFQLEIRLTPNQDLLLCNIGTSQRSSVRKGLAALGIRAPEAPAMLARHAMACPALPLCGLAVTEAERTLPALLERIDAQLRRLEITKSILIRMTGCPNGCARPYMAELALVGSGVDQYQLWLGGTPNLQRLAKPYLQRMPLDQLESTLEPLLLSWKQAGGRRSLGDHVNKLGDQAVLGLLSGNGQAP

SEQ ID NO: 21516 - protein, 246 aa, Nostoc punctiforme PCC 73102
MSILDSLPDEPEEEPSPESSTPHNHWLDKEQQLMPPQLKADAPLRMVETAFLASTASLIWFINFYFPLGPVLRIFFPVPIALVYLRWGKRAAWMAALTSGLLLTVLMGPARSLLFVMPYGFMGVLLGATWYRRRVPWIVSITLGTLLGTLGVFFRLWLLSVLSGEDLWIYVITQVTEFIEWVFLKLSLLASPSVFLIQVGAIALILLNNFIYLFVVHLAAWFLFDRLGNPIPRPPRWVQVLMDYEG

SEQ ID NO: 21517 - protein, 272 aa, Escherichia coli CFT073
METYAVFGNPIAHSKSPFIHQQFAQQLNIEHPYGRVLAPINDFINTLNTFFSAGGKGANVTVPFKEEAFARADELTERAALAGAVNTLKRLEDGRLLGDNTDGIGLLSDLERLSFIRPGLRILLIGAGGASRGVLLPLLSLDCAVTITNRTVSRAEELAKLFAHTGSIHALGMDELEGHEFDLIINATSSGISGDIPAIPPSLIHPGIYCYDMFYQKGKTPFLAWCEQRGSKRTADGLGMLVAQAAHAFLLWHGVLPDVEPVIKLLQQELSA

SEQ ID NO: 21518 - protein, 387 aa, Agalinis fasciculata
  misc_feature (244)..(244): Xaa can be any naturally occurring amino acid
  unsure (1)..(387): unsure at all Xaa locations
DFEPVKPYEVPMTAAGALQSYKLAAKAITRLQALPSGSLERLCDTMVQEVFELTGYDRVMIYKFHDDDHGEVLSEITKPGLEPYVGLHYPATDIPQAARFLFIKNKVRMICDCRANHVKVIQDDNLPFDLTLCGSTLRAPHSCHLQYMENMNSIASLVMSVVVNEGNEDGPDSSSHPDKKKRLWGLVVCHNTSPRFVPFPLRYACEFRAQVFAIHVNREIELENQMLEKNILRTQTLLCDMLMXDAPLGIVSQSPNVMDLVKCDGAVLIYKTKKYRLGMTPSDFQIRDIVSWLDEYHRDSTGLSTDSLYDAGFPGALALGDAVCGMAAVRITNTDWLFWFRSHTAAEIRWGGAKHEPGEKDDGRKMHPRLSFKAFLEVVKTRSLPWK

SEQ ID NO: 21519 - protein, 559 aa, Yarrowia lipolytica CLIB122
MSYTPSENSVTKPEHDDLHNDVKGYTHDQEHATTDFSDGPAAEIADDGVKRGLKTRHLSMMALAGIIGPGLLIGSGGALTSGGPASLIIGFGCIGIIAFSIMQSLGEMTTLYPTGGAFTKLGDRFVDEAAGAAVGWNYFIIWACVLSNEYNALTSILYFWSEKVPIWGYFLLFWFFFLGFQLLGVEIFGEAEFWLGLIKIVGLVAFFIFAIVYAAGGVGRLDNGDGTTRALGFHYWHDPGAFPNGFRGVAQVFVFCSTFYAGVESVAVAATETRNPSVAVPRAIRQVFWRIIFVYLGSAFFFGLVCSSKATQLVSADAKALQSPMTVAIQTAGWHGGVHLINAFILVTCLSAVNSSIYIGSRTVLFMAKDKKAPKFLAYTNKRGVPVFAIIFTNAFAALSLMNISTGAGKAYGYIVNLSGVSTFLVWGSISFIHLRFRAGWAAQGYSPEDLPYRAMFFPYNAWFGLVANVFLALVQGWTTLSPFDAGNFVDAYILLPLFFVIFFLYKIIYKTRWVRANEMDVISGRRKDLDTKVDEEQMIDGVMTPKKKTVWKKVCENF

SEQ ID NO: 21520 - protein, 608 aa, Ajuga reptans
SGKPFYAIIHRVTGSLIIDFEPVKPHEVPMTAAGALQSYKLAAKAITRLQSLPSGSMERLCDTMVQEVFELTGYDRVMIYKFHDDDHGEVFAEVTKPDLEPYVGLHYPATDIPQAARFLFMKNKVRMICDCKANHVKVVQDENLPLDLTLCGSTLRAPHSCHLQYMENMNSIASLVMSVVVNEGNEEGGSESTHPEKRKRLWGLVVCHLTSPRFVPFPLRYACEFLAQVFAIHVNKELELENQMMEKNILRTQTLLCDMLLRDAPLGIVSQSPNVMDLVKCDGAALLYKNKKYKLGLTPTDFQIRDVVSWLDEYHRDSTGLSTDSLYDAGFPGALALGHAVCGMAAVKINDKDWLFWFRSHTASEIRWGGAKHEPGEKDDGRKMHPRSSFRAFLEAVKTRSLPWKDYEMDAIHSLQLILRNAFKEADDKDTDTKMIHTKLNDLQIDGIQELEAVTSEMVRLIETASVPILAVDADGLVNGWNTKIADLTSLPVDKAIGRHFLDLVEDTSADIVSHMLQLALQGKEEQNVQFEIKTHGENSESGPVTLIVNACASRDVKENVVGVCFIAQDITAQKSMMDKFTRIEGDYRAIIQNPNPLIPPIFGTDEF

SEQ ID NO: 21521 - protein, 619 aa, Alectra sessiliflora
SGKPFYAIIHRVTGSLVIDFEPVKPHEVPMTAAGALQSYKLAAKAIARLQATPSGSLERLCETMAQEVFELTGYDRVMVYKFHDDDHGEVFTEITKPGLEPYAGLHYPATDIPQAARFLFMKNKVRMICDCRSAHVKVVQDEGLFSDLTLCGSTLRAPHSCHLRYMENMNSIASLVMAVVVNEGNDEESSASSSSTSSHPEKKKRLWGLVVCHHTSPRFVPFPLRYACEFLSQVFSIHVSKELELLNQTQEKNILKTQTMLCDMLLRGNPLAIVTQSPTVMDLVKCDGAVLLYKGKTHRLGLAPSDLQIRDIMSWLDEYHRDSTGTSTDSLLDAGFPGAAALGDAFCGMAAIRITGRDWLFWFRSHTAAEVRWGGAKHEKGDEDDGRRMHPRSSFNAFLEVVKARSVPWRDFEMDAIHSLQLILRNACEKEMEEEERRKDMVVAGEIQARLTELHIDGAREMEAVTSEMVRLIETASVPILAVGVDGLVNGWNTKIADLTGLLVDEAIGQPFLALVEEASVDAVSRMLERALQGHEERNVQFEIKTHGPRAESGPISLVVNACASRDVRENVVGVCFIAQDVTTERSMMDKFTRIEGDYRAIVQNPNPLIPPIFGSDEF

SEQ ID NO: 21522 - protein, 510 aa, Desulfitobacterium hafniense Y51
MAQELVLVLDFGGQYNQLIARRVREAHVYSEMISYKTPVEEIKARNPKGIIFSGGPASVNQEGAPKVDEAIYELGIPIFGICYGMQLMTVQLGGKVMHPEVREYGKAMLHVDQAKGLWKGLGGERQCWMSHGDSVTELPEGFVIAAHTDHTPVAAMTDETRHFYGVQFHPEVKHTPDGQAMLKHFLFDICGCHGEWTMESFIDAQVKAIREKVGERQVLCALSGGVDSSVAAVLVHKAIGDQLTCVFVDHGFMRKNEPEQVKKIFTEQFHLKLIFVDARERFMAKIGGVSDPETKRIGIGNEFIRLFEDEARKLGQIDFLVQGTLYPDIVESGTDTAETIKSHHNVGGLPEDMQFELIEPLDMLFKDEVREVGAELGIPDEIVWRQPFPGPGLAIRIIGEVTEEKLDILREADAVIVEEIRNAGLYKEVWQSFAVLPTIKSVGVMGDGRTYAYPIVVRAVTSEDAMTADWARLPYDLMEKISTRIVNEVKGVNRVVYDITSKPPGTIEWE

SEQ ID NO: 21523 - protein, 296 aa, Burkholderia xenovorans LB400
MSITVSFPAEVRDWIAQNLTRGVAPQAIVRELVDRKNAVELASAMVNAVASSFLYGTPLPGETLEIGAAPVAYEPEPLRVPDGPLIRLGERKTRVISRMQRPAAVLLDDFLSANECEQLIALARPRLSRSTVVDPVTGRNVVAGHRSSDGMFFRLGETPLIARLEARIAELTGLPVENGEGLQLLHYEAGAESTPHVDYLIAGNPANRESIARSGQRVGTLLMYLNDVEGGGETMFPQTGWSVVPRRGQALYFEYGNRFGLADPSSLHTSTPLRAGEKWVATKWIRTRRFVPRDQA

SEQ ID NO: 21524 - protein, 291 aa, Capsicum chinense
LADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDVKEKLSYIALDYEQELETAKTSSSVEKSYELPDGQVITIGAERFRCPEVLFQPSMIGMEAAGIHETTYNSIMKCDVDI

SEQ ID NO: 21525 - protein, 203 aa, Orpinomyces sp. PC-2
MNFSIKSVIFLAIVALATLVSASTNPKVTNKVYFDIKQGDKDLGRIVLGLYGEVVPKTVENFRALATGEKGYGYKNSKFHRVIKDFMIQGGDFTRGDGTGGKSIYGERFADENFKLRHTGPGILSMANAGRDTNGSQFFITTVTTSWLDGRHVVFGKVIEGMDVVTAIETTKTLPGDRPATPVIIADCGELPVSNNNDAKAEL

SEQ ID NO: 21526 - protein, 235 aa, Zea mays
MKCRSDAPGGGDGHRDRVPAPAATGVGGSPPGERSKKQRTQEPSSSSSVDGECSSSTSSSQALPPPLPEQLPQDAGVGEQPPPGPEAAGGEQARVPDLGEDLVFEVLMRAEARTLAAAACVSRGWRLLARDERLWEAACVREWACTGFSEQMLRSVVLPLGGFRRLHEMYIRPVQRRAAGAPRGQQRRQLPVRMGRDQVQVSLSLLSTSFFLKMPNAPPPPPPMQHHHKLLMLCR

SEQ ID NO: 21527 - protein, 490 aa, Oryza sativa
MAGRKENPVLTACQAPSGRITRAQAAANRGRFGFAPSVSLPARTERKQTAKGKTKRGALDEITSASTATSAPQPKRRTVLKDVTNIGCANSSKNCTTTSKLQQKSKPTQRVKQIPSKKQCAMKVPKLPPPAVAGTSFVIDSKSSEETQKVELLAKAEEPTNLFENEGLLSLQNIERDRDSNCHEAFFEARNAMDKHELADSKPGDSSGLGFIDIDNDNGNPQMCASYASEIYTNLMASELIRRPRSNYMEVLQRDITKGMRGILIDWLVEVSEEYKLVPDTLYLTINLIDRFLSQHYIERQKLQLLGITSMLIASKYEEICAPRAEEFCFITDNTYTKAEVLKMEGLVLNDMGFHLSVPTTKTFLRRFLRAAQASRNVPSITLGYLANYLAELTLIDYSFLKFLPSVVAASAVFLARWTLDQSDIPWNHTLEHYTSYKSSDIQICVCALRELQHNTSNCPLNAIREKYRQQKFECVANLTSPELGQSLFS

SEQ ID NO: 21528 - protein, 175 aa, Oryza sativa (japonica cultivar-group)
MAPSVMASSATSVAPFQGLKSTAGLPVNRRSSSSSFGNVSNGGRIRCMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFVRIIGFDNVRQVQLISFIAYKPPGCEESGGN

SEQ ID NO: 21529 - protein, 506 aa, Lolium rigidum
MNDDLVYVCSALAVSILAIAVVQLLKARQRLPPGPLNLPVIGSAHRLVNALPHRAMRDLAGVHGPLMYLRVGQVPLVVVTSKEVAREVLKTHDAIFATRPKLMAGDIVAYGSTDLLFCSTPGDYFRKLRRLCVQEILSNDRIRSYQDIREDEVRSLVEDIRAAGPSAPVDLSRKIYKLTNGIVSRAAFGMKSSKAEDFVAAIKHSFVYSTGFSIADLFPGFTGILSFLTGQRRTLEGVRDTIDGILEEIINEREQILKSGRSTASEKNLVEVLLGLQGNEDFGFPITRSTVKAVILDIFAGGTETSGTSMEWAMSELMANPKVMGKLQGEIRAAFGDKEFISEADLRASGGVMKYLGLVIKETFRLHPPAPILVPRESTEACEINGYVIPAKTRVVINSWAIMRDPRYWEDAEEFRPERFEGGRMDFLGGNFEYTPFGSGRRMCPGYNYGMASMELTLVQLLHSFDWSLPDGVDQLDMTEIVSLSLTRKTHLMLRAAPHRAPLPSS

SEQ ID NO: 21530 - protein, 216 aa, Gossypium hirsutum
MDFVVQDYDMVDFGSVSESGTDRPVNFSDDYMMLASSYPKRRAGRKKFRETRHPVYRGVRRRNPGKWVSEVREPNKKSRIWLGTFPKADMAARAHDVAAIALRGKSACLNFADSAWKLPVPASSDPKDIQKTVAEVAETFRTAEHSSGNSRNDAKRSENTEMQKGFYLDEEALFGTQRFWANMAAGMMMSPPRSGHDGGWEEHEVDDYVPLWSYSI

SEQ ID NO: 21531 - protein, 513 aa, Lolium rigidum
MVMEMEPSSATLFFLSVVTLVILVSLVSRKPSSKLRRPPGPRDLPFVGSLHHLLTSQPHVALRNLAKTHGPVMRLRLGQVEAVVVSSSAAAQEVLRDNDLSFASRPNLLATEIMCYGNLDVAFAPYGAYWRALKKLCVLELLSSRKVRQFKPVRDSETMSLIKEICAAGKGGKPVKLRSLLVKCTSSVTGKATFGERCDIDLREQFMAAMEVAQIHSSGFCVGDLFPSLGFLDVATGMRYQLWRARQQLDNVVDKIISDCEARREEKKSTPTGDEDLLSLMLRIRDEGGSDFPIETINIKAIIVDLFTAGTETTSSTAEFVMSELMRNPKVMKKAQEEVWRMMENKSPQDHENHMDELPYLRMVIKETMRLHPVVPLLLPRLCRESCHVGGFEITKGTRVIINAWALATSPENWNEPEEFRPERFEDSVVVNDKGTQFKLMPFGGGRRMCPGDGFALATLELMVARLLYYFEWSLPDGMRPDELDMDVKVGTTSRRRNELRVVASPCRIPIEI

SEQ ID NO: 21532 - protein, 418 aa, Aeropyrum pernix K1
MQPTDPLEEARAQLRRAVDLLGYDDYVYEVLANPDRVLQVRVTIKMDDGTVKTFLGWRSQHNSALGPYKGGVRYHPNVTMNEVIALSMWMTWKNSLAGLPYGGGKGGVRVNPKILSPRELELLSRKYFESISDIVGVDQDIPAPDVYTDPQVMSWFLDEYNRVKRGQFFGVVTGKPVELGGLNARIVSTGYGVAVSTRVAAEKFLGGLEGRTVAVQGYGNVGYYAAKFLAEMGAKIVAVSDSRGGIYDPEGIDPEEALKVKRSTGTVANYQRGKKISTMEILELPVDILVPAAIEEVITDENADRIKAKIISEGANGPTTTAAEKILVKKGVLVLPDILANAGGVIMSHIEWVNNRMGGWITDEEALKKLEQKMVENTKTVITYWEKNLKPEENSLRDAAYMIAVERVFRAMKLRGWI

SEQ ID NO: 21533 - protein, 498 aa, Lolium rigidum
PLFLLGSLALAVSLLVLLGHGRGKTRLPPGPPALLFLAKFVALRRSIFDLGPLIVDLHARHGPVISIHLFRTLIFVADRKMAHRALVQGGATFAERPPPVDPTRLFTSGGRDISSSPYGTYWRLLRRNLAAEALSPARVAHFAAARRSACDGLVSSLLREQERQGQEEAVTLRPFLRRAMFELLVFMCFGARLEREAMDEVEELQHQVLVAFTSFPVFAFFPAVTKRLFRRRWAEYLAVRRRHEEVFVPLIHAERAGGDPPCYAESLLAVRMADDVRLTDAEMVSLCSEFLNGGTDTTVTLLEWIMAELVNHPDVQAKVYEEVRANPELNDLQGMGMPYLKAVVMEGLRLHPPGHFLLPHGVQHSGDGGVEIGGYMVPKGAEVNFLVAEIGRDETVWTAAREFRPERFLEGAEGHGVDITGSREIKMMPFGAGRRMCPGYSLGMHHAEYFVARMVMDVEWRPPVEGEEVDMAETLDFTTVIKHPLRARLFARTNSHNA

SEQ ID NO: 21534 - protein, 472 aa, Acidobacteria bacterium Ellin345
MPQQIKFGTDGWRGLIADDYTFENVRRVAHAMAHYIHKHEDASKGVYVAYDTRFGSRRFAEAASEAMASTGLRVKLADDYTPTPALSYAIKKFGAAGGVMITSSHNPANWNGVKYKAKYGGSGTPTIMKQIESYLDAPVIMKSGGKVEAFDFKAPYFEVLKSFVDLDAIAKANFRFCIDVMYGAGRGVLSKIFSERGISHVEIRGEVNPLFPGINPEPILPHIAALQEATVREKAHAGLATDGDADRIGAVDERGRFVDAHKCFAVILKWLLEKKQWPGAITRAFNTTSMLDRMAKKHGRELVEHGIGFKYVCDVVLSGKEVLVGGEESGGIGIPRHLPERDGILNSLVIANVMANYGMSLGQLVDSLQAEYGEHHYGRIDMHLDNAVKEDAMRRAGERPAKIGKLQVSRIEDMDGMKFFFETPNNGNGADAWVLIRASGTEPLLRVYSEASSPEMVQDILGEAEKFVHRRA

SEQ ID NO: 21535 - protein, 153 aa, Brassica napus
MMNTLQAFQTTLTPNFHVLFNPPRHSLPRTQFLCLSKPRDGNSDSESDPDPPKPEGDTQRQELLARIAMLQTSKVRLTDFLDERSDYLTKFAEEANAEFDKVGEDAMKDLDEASSRILENIESKMQAFEESAGLNRLEIEESDNKLAEFEEKI

SEQ ID NO: 21536 - protein, 525 aa, Lolium rigidum
MATRALQMLGEASPWNLACAAAAMALLWLAAWILEWAWWTPRRLGRALEAQGLKGTRYRLFTGDVPENARLNKEARSKPLPLGSHDIIPRVQPMISNAIKENGKLSFTWFGPEPRVTILDPESVREILSNKFGHYGKPRSSRFGKLLANGLVNHQGEKWAKHRRILNPAFHHEKIKRMLPVFSACSEEMITRWENSMSSQGVSEVDVWPEFQNLTGDVISRTAFGSSYQEGTKIFQLQGEQAERLMQAFQTLFIPGYWFLPTKNNRRMRAIDREICTILRGIIEKKDRAIKSGEASSDDLLGLLLESNRRESNGKANLGMSTEDIIEECKLFYFAGMETTSVLLTWTLIVLSMHPEWQEQARKEVLHHFGRTTPDFENLSRLKIVTMVLYEVLRLYPPAIFVTRRTYKAMELGGITYPAGVNLMLPILFIHHDPNIWGKDASEFNPQRFADGISNAVKNPAAFFPFGGGPRICIGQNFALLEAKMALSTILQRFSFELSPSYTHSPYTVLTLHPQHGAPIVLRKI

SEQ ID NO: 21537 - protein, 525 aa, Lolium rigidum
MATRALQMLREASPWSLAGAAAAMALLWLAAWIVEWAWWTPRRLRRALQAQGLRGTQYRLFTGDVPENARLNREARSKPLPLGSHDIIQRVQPMFSNVIKENGKFAFTWFGPTPRVMIPDPELVREVLSNKFGHYGKQKSSRLGKLLANGLANHQGEKWAKHRRILNPAFHNEKIKRMLPVFATCCEEMITRWDNSMSTQGSSEIDIWPEFQNLTGDVISRTAFGSNYQEGMKIFQLQGELAERLIMAFQTIFIPGYWFLPTKNNKRMRAIDCEIRTILRGIIGKKDKAIKNGEAISDDLLGLLLESNMRESNGKADLEMSTEEIIQECKLFYFAGMETTSVLLTWTLILLSMHPEWQEKARDEVLYHFGRTTPDFEHLSRLKIVTMILYEVLRLYPPITILTRRTYKAMELGGIKYPAGVNLMLPILFIHHDPNLWGKDASEFNPERFADGISNAAKHPGSFFPFGGGPRICIGQNFALLEAKMALSTILQHFSLELSPSYTHAPYTVITLHPQHGAQIRIKKI

SEQ ID NO: 21538 - protein, 524 aa, Aureolaria pedicularia
SGKPFYAIIHRVTGSMIIDFEPVKPHEVPMTAAGALQSYKLAAKAITRLQALPSGSMERLCDTMVQEVFELTGYDRVMIYKFHDDDHGEVLSEITKPGLEPYVGLHYPATDIPQAARFLFIKNKVRMICDCRANHVKVIQDDKLPIDLTLCGSTLRAPHSCHLQYMENMNSIASLVMSVVVNEGNEDGPDSSSHPDKQKRLWGLVVCHNTSPRFVPFPLRYACEFLAQVFAIHVNKEIELENQMLEKNILRTQTLLCDMLLRDAPLGIVSQSPNVMDLVKCDGAVLIYKTKKYRLGMTPSDFQIRDIVSWLDEYHRDSTGLSTDSLYDAGFPGALALGDAVCGMAAVRITDTDWLFWFRSHTAAEIRWGGAKHEPGEKDDGRKMHPRLSFKAFLEVVKTRSLPWKDFEMDAIHSLQLILRNASNKEAEERDVDGKEIHARLNDLQLDGIQELEAVTSEMVRLIETASVPIFAVDVDGLVNGWNTKIADLTGLPVDKAIGRHFLALVEDSSAEAVNKMLELALQG

SEQ ID NO: 21539 - protein, 639 aa, Prochlorococcus marinus str. NATL1A
MCGITGSTNLSLPCESYNNAISSIEYRGPDNTGRYLDNNIFLAHTRLSISELSKNGNQPYISKNYKGYVLVYNGEIYNIENVKNYLSKYKIKIKSKCDTELLYLMLSEFGIDKTLKLIEGIFSFAFYDKNQQKVWICRDHLGIKPLYYSLEKGLSFSSSQDGVINYLLEANDTSSIISKKGIISYLQFGYNLPNSQNNSKIKALLPGHYICHDIKHSKTMLKKWFKIIVNNKNRKVINNNTLKNTEKLIESIIKEQSVSEVEGTIFLSGGIDSTLIASNVDKNYIKKAFTIKYSDNDSNDESYIAEKVAKDCGLELLTFEFNFFNYNIDKAAERQLKITRYPFANSTLLSTDFLCQKANKEGIRMALVGDGGDELFGGYPRYKAVYLNYLLSKHNYIKGPTLAIKNTLKYSIQKNIMGFNYLINKKSYLDRRVRALLSILGSTSSFAHRKSHTYLDKDSLVNKDFNLCTDEFDAFFPLNEKPPCSSMVADLLTWIPFNLNHCSDLASMNNNIEIRVPFLDRRLLNYVFSQDISHLGIFNSKILLRKILNKKGFRYISKLPKKGFNPPLKNLVDLNLTEISEIIAETNYLLSEYIDIDVILFFLKSHKSKEKDFSRELWSVYLLAKWIRDPFKFLNYKLL

SEQ ID NO: 21540 - protein, 507 aa, Ashbya gossypii ATCC 10895
MTRLVWFCMQVAYCLHGWDWDIMDRGRSSNSYDSLWGGKARDNPIVSQLPLQYRIRSALTQEQQTAYQVMYRIQEITIKLRTNDLNPPTSRYRSLSPPPVYDSQGKRTNTREHRYRKKLEEERHRLVEIALKMIPHFIAPDDYRRPSKFQDKYYIPINDYPEINFVGLLLGPRGNTLKQLQQQSGCKIVIRGRGSVKEGKAATDLPKGAMNMNEPLHCVISADTEEKIPLGINAGESIIIKAITFPEGQNDFKRGQLRELAVLNGTLREDNRPCPLCGEQGHKKWECSSNPSLSMTVICQRCNQPGHAARDCTSPLNEFGKRTSDGPEFRETKKLQQDAPPPSGPVGSHPSAPGSGSANSGVAPASLHPPGTMAPPGALPPPGSLAAPGTLPPPAALPAPAAPGTLPPPVALPAPATLPQAGVPPAPDASPAVKTAVPIEGPPAPPQTAPPLRQTAATASSAGSSQSAQEEPENARNGVEKAAPGPPAAVLPPPPPPPPPPPPPPSS

SEQ ID NO: 21541 - protein, 1520 aa, Coccidioides immitis RS
MDGASDKIGRPVGSPGTNAQPGEPAARVDTPSNTGENEHAPSLQDEKGFHPIRSENPREPQSSTGSGPESSESEAALLYRRDTQHAKREEVDDGVETVTPSRQPLYEQTSRSTAPSSRDEEWANLQHILSNMFGRARQEVSEEEKSRHVGLVWKNLTVKGVGLGATLQPTNSDILLALPRLFGRLFTGKIRNRKPVRTILDDFTGCVKPGEMLLVLGQPGSGCSTFLKVLGNQRAGYEAVDGEVTYGGADAKTMAQKYRSEVLYNPEDDLHYATLTAKQTLNFAIRTRTPGKESRKPGESRRQYRETFLTSVAKLFWIEHCLDTRVGNALVRGVSGGEKKRVSIAEALITKASTQCWDNSTRGLDASTALEYVQCLRSLTTMTHVSTSVAIYQASESLYKLFDKVILLTEGKCAYFGPTSDAKAYFENLGFECPPRWTTADFLTSVTEPHARRVKSGWENRIPRSAEQFKRAYDESAVRKVAMESIAELEDEIEAKKGELEDIRRRTPKKNFTIPYYQQVIALSGRQFMIMIGDRESLLGKWCVILFLALIVGSLFYNLPKNSQGVFTRGGVMFYIILFNALLSMAELSSTFESRPILMKHKSFSFYRPSAYALAQVVVDVPLVFTQVFIFLIIVYFMADLARTASQFFIALLFVWLVTMVMYSFFRAIGALVTSLDAATRVTGVAIQALVVYTGYLIPPGEMRPWLKWLIWINPVQYTFESLMANEFYNLRIECVGPNLVPQGPNASPEFQSCTVQGSEPGQTFVDGSAYIFSNYGYTRDHLWRNFGIIIALLVLFIVLTMVGTEIQASSHSSAHSTAAVTVFMRGQVPRSVKHEMQNSKKGLDEEEGKQSVLSNGSESDAIEDKEVQAISRNAATLTWQGVNYTIPYKRTRKTLLQDVQGYVKPGRLTALMGASGAGKTTLLNVLAQRVDFGVVTGTFLIDGKPLPKSFQRATGFAEQADIHEPTSTVRESLQFSALLRRPPEVSIQEKYDYCERILDLLELQPIAGATIGHVGAGLNQEQRKRVTIAVELASKPDLLLFLDEPTSGLDSIAAFNIVRFLRKLADVGQAVLCTIHQPSSVLFEEFDDLLLLQSGGRVVFHGDLGADSRKLIEYFERNGARPCPPDANPAEYMLDVIGAGNPDYKGPDWADIWASSPEHETVTNEIKRIVHSSAQEGSPAGTAGQREFAMPKRTQILATAKRSFIAYWRTPNYTIGKFMLHIWTGLFNTFTFWHIRDSTIDMQSRLFSVFLSLVIAPPLIQQLQPRYLHFRGLYESREEKSKIYTWFALITSIILPELPYSVVAGTLFFCCWYFGTWFPRNSFAVGFTWMLLMVFEVFYVTFGQMIASISPNELFASLLVPAFFTFVVSFCGVVVPFQGIPYFWRSWMYWLTPFRYLLEGYLGVVTNKIPVRCSENEFARFRPPPGLTCEDYAGPFVEQRGGYVITDGSGMCALCQYANGNEFAASFNVFYKYKWRDYAIFWSYVVFNILAVYILSWLYLHGFPALRRKLNSRMMRETR

SEQ ID NO: 21542 - protein, 225 aa, Oryza sativa (japonica cultivar-group)
MRRRLVLGVGAAAAPAVAAPAASATPAAPRDWAAKVLITAGAYSLVRAFDGLTARRLIEQNLSRKIVHVLSGVLFMSSWPLFRELLRGPLYYVIVLLVSVLVFWRQSPIGIVSLSMMSGGDGFADIVGRRYGSAKLPFNENKSWIGSISMFISGFLLSALMLFYFSCLGYFTVCWDLALGKLALVALAATVVECIPVNDVVDDNISVPLATMLAAYLLFGYSSCC

SEQ ID NO: 21543 - protein, 389 aa, Bartsia alpina
DFEPAKPYEVPMTAAGALQSYKLASKAIARLQSLPSGSMERLCEAMAQEVFELTGYDRVMIYKFHEDDHGEVLTEITKPGLEPYVGLHYPATDIPQAARFLFMKNKVRIICDCRANHVRVIQDENLPLDLTLCGSTLRAPHSCHLQYMENMNSIASLVMSVVVNEGNEEAGPDDSSQHPDKRKRLWGLVVCHNTSPRFVPFPLRYACEFLAQVFAIHVNKELELENQMLEKNILRTQTLLCDMLLRDAPLGIVSQSPNVMDLVKCDGAILLHKNRKHRLGITPSDFQIRDIVSWLDEYHRDSTGLSTDSLYDAGFPRALALDDIVCGMAAVRITDRDWLFWFRSHTASEIRWGGAKHEPDERDDPRKMHPRSSFKAFLEVVKTRSLPWK

SEQ ID NO: 21544 - protein, 287 aa, Triticum aestivum
  misc_feature (133)..(133): Xaa can be any naturally occurring amino acid
  misc_feature (186)..(186): Xaa can be any naturally occurring amino acid
  misc_feature (277)..(277): Xaa can be any naturally occurring amino acid
  unsure (1)..(287): unsure at all Xaa locations
TLPNKFVQKSRLAPVRNSRDIVDPRVRAANWCYATVVAPRARSSTIVASLGTPAPSNSSSFRPKLIRNTPVQAAPVAPALMDAAVERLKTGFEKFKTEVYDKKPDFFEPLKAGQAPQVHGCSRCADSRVCPSXVTPGAWSPGEAFTIRNIANMVPSYCKNKYAGVGSAIEYAVCALKVEVIVVIGXTARCGGIKALLSLKDGADDSFHFVEDWVRIGFPAKKKVQTECASMPFDDQCTVLEKEAVNVSLQNLLTYPFVKEGVSNGTLKLVGGHYDFXVSGKFETWEQ

SEQ ID NO: 21545 - protein, 208 aa, Oryza sativa (japonica cultivar-group)
MAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 21546 - protein, 497 aa, Silicibacter pomeroyi DSS-3
MTLSHAEYRSIAATLEPNGMAFIDGAFCAAADGDSFETINPATGEILARVAHCKAADVDRAVAAARRVFNDGTWSRAEPEARKEVLLKVADLVRKHSDELAVLESLDTGKTITDCLAEIGGEVPKFFQWYAELADKTFGKIAPTSPGALALITREPAGIAGAVLPWNFPLVMAAWKIAPALAVGCSAVIKPAEQTPLSTIRLAELMQEAGVPAGVVNIVPGFGETAGKAIGLHNDIDTVSFTGSTEVGRMFMRYSGESNLKGVGLEMGGKSPFIVLDDAVIDDALIEHAAMSAFWNGGQNCSANMRQLIATPLVEEFTARIIARVKSFRLGDPLDPATDIGSMITKDHKDMVLSYIQSGVEEGAQKVIGGNSDLPGFFIEPTVFRNLSPEMKIAREEIFGPVLGIMPVASPQEALAIASDTEYGLHATVFTRDIDRALHIARSLPCGTVSINGFSEGDIKTPFGGYKQSGSMARDNGTEALEQYLQTKTIWIETQAG

SEQ ID NO: 21547 - protein, 549 aa, Brucella suis 1330
MARDATKLEATVAKLKKHWAESAPRDMRAAFSADPGRFGRYSLCLDDLLFDWSKCRVNDETMALLKELAVAADVEGRRAAMFAGEHINNTEDRAVLHVALRDTSSKEVLVDGHNVLPDVKHVLDRMAAFADGIRSGALKGATGRKITDIVNIGIGGSDLGPVMATLALAPYHDGPRAHFVSNIDGAHIADTLSPLDPASTLIIVASKTFTTIETMTNAQTARKWVADTLGEAAVGAHFAAVSTALDKVAAFGIPEDRVFGFWDWVGGRYSVWSAIGLPVMIAVGPDNFRKFLAGAHAMDVHFRDAPLEKNLPVMLGLIGYWHRAICGYGSRAIIPYDQRLSRLPAYLQQLDMESNGKSVTLDGKPVSGPTGPVVWGEPGTNGQHAFFQLLHQGTDTIPLEFIVAAKGHEPTLDHQHEMLMANCLAQSEALMKGRTLDEARAQLQAKNLPASQVERIAPHRVFSGNRPSLTLIHDMLDPYALGRLIALYEHRVFVEAQIFGINAFDQWGVELGKELATELLPVVSGKEGASGRDASTQGLVAHLHARRKA

SEQ ID NO: 21548 - protein, 554 aa, Brucella suis 1330
MEKIWLKSYPAGVPHDINLSAATSISDMISASCRQFANSPAFTCMGKDISYKELDDHSRALAAWLQSRGLVKGDRVAIMMPNILQYPITFTAVLRAGFVVVNVNPLYTPRELEHQLNDAGAKALVVLENFATTVEKALPSINVPNILVASMGDMLGFKGHIVNLVVRRVKKMVPAWNIPGHVRFKDALAQGRAKSFNPVPVQGCDIAFLQYTGGTTGISKGAMLTHSNILANVEQMNLWMDVAFRNKGKPKALNFVCALPLYHIFALTVNAMIGMKLGARNILIPNPRDIPSFVKELKKYPVHIFPGLNTLFNGLMNNPDFQTLDFKPLILTLGGGMAVQRPVAERWQHMTGCHITEGYGLSETSPVACANALDATEFTGTIGLPMPSTDVVIRDDDGSDLPLGKVGEICVRGPQVMKGYWNRPEETARAIMADGFFRTGDMGFMDERGYTKIVDRKKDMILVSGFNVYPNEIEEVAAEHPGVLESAAVGIPNEHSGEVVKLYVVRRDPELTEDEVKAFCAERLTNYKRPREVEFRESLPKSNVGKILRRELRD

SEQ ID NO: 21549 - protein, 525 aa, Lolium rigidum
MATRALQMLREASPWSLAGAAAAMALLWLAAWIVEWAWWTPRRLRRALQAQGLRGTQYRLFTGDVPENARLNREARSKPLPLGSHDIIQRVQPMFSNVIKENGKFSFTWFGPTPRVMIPDPELVREVLSNKFGHYGKQKSSRLGKLLANGLANHQGEKWAKHRRILNPAFHNEKIKRMLPVFATCCEEMITRWDNSMSTEGSSEIDIWPEFQNLTGDVISRTAFGSNYQEGMKIFQLQGELAERLIMAFQTIFIPGYWFLPTKNNKRMRAIDCEIRTILRVIIRKKDKAIKNGEAISDDLLGLLLESNMRESNGKADLGMSTEEIIQECKLFYFAGMETTSVLLTWTLILLSMHPEWQEKARDEVLYHFGRTTPDFEHLSRLKIVTMILYEVLRLYPPITILTRRTYKAMELGGIKYPAGVNLMLPILFIHHDPNLWGKDASEFNPERFADGISNAAKHPGSFFPFGGGPRICIGQNFALLEAKMALSTILQHFSLELSPSYTHAPYTVITLHPQHGAQIRMKKI

SEQ ID NO: 21550 - protein, 525 aa, Lolium rigidum
MATRALQMLGEASPWNLACAAAAMAVLWLAAWILEWAWWTPRRLGRALEAQGLKGTRYRLFTGDVPENARLNKEARSKPLPLGSHDIIPRVQPMISNAIKENGKLSFTWFGPEPRVTILDPESVREILSNKFGHYGKPRSSRFGKLLANGLVNHQGEKWAKHRRILNPAFHHEKIKRMLPVFSACSEEMITRWENSMSSQGVSEVDVWPEFQNLTGDVISRTAFGSSYQEGTKIFQLQGEQAERLMQAFQTLFIPGYWFLPTKNNRRMREIDREICTILRGIIEKKDRAIKSGEASSDDLLGLLLESNRRESNGKADLGMSTEDIIEECKLFYFAGMETTSVLLTWTLIVLSMHPEWQEQARKEVLHHFGRTTPDFENLSRLKIVTMVLYEVLRLYPPAIFVTRRTYKAMELGGITYPAGVNLMLPILFIHHDPNIWGKDASEFNPQRFADGISNAVKHPAAFFPFGGGPRICIGQNFALLEAKMALSTILQRFSFELSPSYTHAPYTVLTLHPQHGAPIVLRKI

SEQ ID NO: 21551 - protein, 525 aa, Lolium rigidum
MATRALQMLGEASPWNLACAAAAMAVLWLAAWILEWAWWTPRRLGRALEAQGLKGTRYRLFTGDVPENARLNKEARSKPLPLGSHDIIPRVQPMISNAIKENGKLSFTWFGPEPRVTILDPESVREILSNKFGHYGKPRSSRFGKLLANGLVNHQGEKWAKHRRILNPAFHHEKIKRMLPVFSACSEEMITRWENSMSSQGVSEVDVWPEFQNLTGDVISRTAFGSSYQEGTKIFQLQGEQAERLMQAFQTLFIPGYWFLPTKNNRRMRAIDREICTILRGIIEKKDRAIKSGEASSDDLLGLLLESNRRESNGKADLGMSTEDIIEECKLFYFAGMETTSVLLTWTLIVLSMHPEWQEQARKEVLHHFGRTKPDFENLSRLKIVTMVLYEVLRLYPPAIFVTRRTYKAMELGGITYPAGVNLMLPILFIHHDPNIWGKDASEFNPQRFADGISNAVKHPAAFFPFGGGPRICIGQNFALLEAKMALSTILQRFSFELSPSYTHAPYTVLTLHPQHGAPIVLRKI

SEQ ID NO: 21552 - protein, 1483 aa, Aspergillus oryzae
MASHKKSEDPLVVKDRQEQECESSDSTIASENASEHRSPMGLIDEDGIETLNRIASQSSRRRSSVYPPNVPTRTSTLATISENDPAVDPQGPSFDLNKWLKMVLRESERQGREAHRTGIVFKNFTVSGTGAALQLQDTVSSMLSAPFRIGEMMKNRHSPPKRILNEFNGLLKSGELLLVLGRPGSGCSTFLKSLCGELHGLSMSKESVIHYDGVPQQRMIKEFKGEVVYNQEVDKHFPHLTVGQTLEFAALARTPAQRIRDMSREEFAKHITQVVMAVFGLSHTYNTKVGNDFVRGVSGGERKRVSIAEMALAHSPLAAWDNSTRGLDSATALKFVEALRLFADLSGSAHAVAIYQASQSIYDIFNKVVVLYEGRQIYYGPAKDAKSYFERQGWECPQRQTTGDFLTSVTNPSERKARPGMENQVPRTAEDFEAYWRKSPEYQKLMSEISHYEQEHPLEEEGDALATFQQKKREIQAKHTRPQSPYLLSVPMQIKLNTKRAYQRVWNDISSTVSTVISQIIMALIIGSVFYGTPDATAGFTAKGATLFFAVLLNALIAMNEINSLYSQRPIVEKHNSYAFYHPATEAIAGVVSDIPVKFVIAVVFNLILYFLAGLHRSAGQFFLYLLVTFIVMFVMSAVFRTMAAITQTVSQAMGLAGILILALIVYTGFVLPVPSMHPWFEWIHYLNPIYYAFEMLIANEFHGRDFICSQFIPAYPNLSGNSFVCSSAGAKAGQRAISGDDYIQVNYQYSYGHVWRNFGILIAFLVGFMMIYFIATELNSSTSSTAEVLVFRRGHEPAYLRTDSKKPDAESAVELSAMKPTTESGEGDMSIIPPQKDIFTWRDVCYDIEIKGEPRRLLDHVSGWVKPGTLTALMGVSGAGKTTLLDVLAHRTSMGVITGDMFVNGRGLDQSFQRSTGYVQQQDLHLETATVRESLRFSALLRQPPNVSIQEKYDYVEDVIRMLKMEDFAEAVVGVPGQGLNVEQRKLLTIGVELAAKPKLLLFLDEPTSGLDSQSSWAICAFLRRLADSGQAVLCTIHQPSAILFQQFDQLLFLARGGKTVYFGPIGQNSNTLLNYFESNGARKCADDENPAEWMLEIVNAGTNSEGENWFDVWKRSSECQGVQTEIDRIHREQQSKTQASDKDNESWSKSEFAMPFWFQLYQVTYRVFQQYWRMPEYIASKWVLGILSGLFIGFSFFQAKSSLQGMQTIVYSLFMLCSIFSSLVQQVMPLFVTQRSLYEVRERPSKTYSWKAFLIANIIVEIPYQIMMGILTYACYYYAVVGVQDSERQGLVLLLCIQFFIYASTFAHMAIAAMPDTETASAIVVLLFAMSLTFCGVMQTPTALPGFWIFMYRVSPFTYWVSAMAATQLHDRVVQCSPSEMSIFDPPSGQTCGEYMSSFMSMAGGQLSNPNATSDCNYCSVAVADDFLSSVNIYWSERWRNFGLMWVYIVFNIFLATMLYYTFRVKKWNLSGLKERFSKKK

SEQ ID NO: 21553 - protein, 473 aa, Prochlorococcus marinus str. MIT 9313
MGKSPQDVLRQIKDEGIELIDLKFTDLHGKWQHLTVCSDLIDEEAFANGLAFDGSSIRGWKAINESDMDMVPDASTAWIDPFYRHKTLSLICSIREPRSGEPYARCPRALAQKALGYLAGTGLADTAFFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKFAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPEERLASIPTVPASLNGALEALNADKNYLMEGGVFTEDFIDNWIDIKYEEVQQLRQRPHPHEFTMYYDA

SEQ ID NO: 21554 - protein, 453 aa, Bacillus cereus G9241
MIALGGVIGTGLFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFTINALSARSYAETEFWFSSIKVSAIIAFIILGGAAMFGFIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNIGIPYAADIMNFVILTAVLSVANSGLYAATRMLWSLSKNEMAPAFLKKLSSRGIPLNALIMTIAISAFSLLTSVVAAETVYLWLISISGVITIIVWMSICVSQFFFRKHYLADGGRLEDLKFKTPLYPLVPILGFGLYDIILISLIFIPEQRLGIYCTVPFIIFCYTYYHFKVKKRISTNTQSETKISETM

SEQ ID NO: 21555 - protein, 162 aa, Ashbya gossypii ATCC 10895
MSKVFFDVEADGQPLGRIVFQLYNDVTPKTAENFRALCTGEKGFGYAGCPFHRVIPDFMLQGGDFTHGTGVGGKSIYGGKFPDENFVKKHEKPGLLSMANAGPNTNGSQFFITTVPCPWLNGKHVVFGEVSEGMDVVKKVESMGSSSGATRARIVISKSGEL

SEQ ID NO: 21556 - protein, 154 aa, Ashbya gossypii ATCC 10895
MIRGGRRPIVSSLNQPVVLHVAGPPQHLDKDSALRFLSVFIEEKETAAVLGAAGGAVVTSGGVGSEGGVDTALSSALAQLKRMERDLKGLPPTILSGADEEEREEEPEAVVGETVSRSATGGTKRRFADEEAEKAEEAATAASDDEEAPKKARK

SEQ ID NO: 21557 - protein, 615 aa, Boschniakia hookeri
SGKPFYAIIHRVTGSLIIDFEPVKPHEVPMTAAGALQSYKLAAKAITRLQALPGGSMERLCDTMVQEVFELTGYDRVMIYKFHDDDHGEVSTEITKPGLEPYVGLHYPATDIPQAARFLFMKNKVRMICDCRANHVKVVQDENLSFDLTLCGSTLRAPHSCHLQYMENMNSIASLVMSVVVNEGNEDGPDSSSVPDKRKTLWGLVVCHNTSPRFVPFPLRYACEFLAQVFAIYVNKEFELENQMLEKNILRTQTLLCDLLLRDAPLGIVSQSPNVMDLVKCDGAVLLYKNTKYRLGLTPSDFQIRDIVSWLDEYHRDSTGLSTDSLYDAGFPGALSLCDAVCGMVAVRITERDWLFWFRSHTAAEIQWGGAKHEPGETDDGRKMHPRSSFKAFLEVVKTRSLPWKDFEMDAIHSLQLILRNAFKESEGRDSESREIHARLHDLQIDGVREIEAVTSEMVRLIETASVPIFAVDVDGLVNGWNTKIADLTGLCVDKAIGWHFLALVEDSSADTVSKMLELALQGKEEQNVQFEIKTHGQTSESGPITLIVNACASRDVKGNVVGVCFIAQDITTQKIMMDKFTRIEGDYRTIVQNPNPLIPPIFGTDEFGWCSEWN

SEQ ID NO: 21558 - protein, 62 aa, Triticum aestivum
MDRAVGNQAGQVSKKGKKKHAKDESDRQKQAEKKRRRLEKALANSAAIISELEKKRQQKQEE

SEQ ID NO: 21559 - protein, 484 aa, Rhodococcus erythropolis
MQALTSSVPLVIGDQLTPSSTGATFDSINPADGSHLASVAEATAADVARAVEAAKAAARTWQRMRPAQRTRLMFRYAALIEEHKTELAQLQSRDMGKPIRESLGIDLPIMIETLEYFAGLVTKIEGRTTPAPGRFLNYTLREPIGVVGAITPWNFPAVQAVWKIAPALAMGNAIVLKPAQLAPLVPVALGELALEAGLPPGLVNVLPGRGSVAGNALVQHPSVGKVTFTGSTEVGQQIGRMAADRLITASLELGGKSALVAFGDSSPKAVAAVVFQAMYSNQGETCTAPSRLLVERPIYDEVVELVQARVEAARVGDPLDPDTEIGPLISAEQRESVHSYVVSGTEEGATLISGGDQSPTGAPEQGFYYRPTLFSGVTADMRIAREEIFGPVLSVLPFEGEEEAITLANDTVFGLAAGVFTRDVGRALRFAQTLDAGNVWINSWGVLNPASPYRGFGQSGYGSDLGQAAIESFTKEKSIWARLD

SEQ ID NO: 21560 - protein, 129 aa, Glycine max
  misc_feature (19)..(19): Xaa can be any naturally occurring amino acid
  misc_feature (23)..(23): Xaa can be any naturally occurring amino acid
  misc_feature (83)..(83): Xaa can be any naturally occurring amino acid
  unsure (1)..(129): unsure at all Xaa locations
MSGRGKGGKGLGKGGANPXRKVXRDPSQGLSKPAIRRLASRGGAKRLSGLIYEEPRGVLKLFVETLIRPAVTHPAHARRKPVXPMDVVPPLKTQGSPLHGFPGYHIGDFSNASSPRVSYSLHFDVYPPQ

SEQ ID NO: 21561 - protein, 312 aa, Xanthomonas axonopodis pv. citri str. 306
MSARIPTLDITRFDTDREAFVAELGAAYRQWGFAGIRNHGIAQADIDAAYEVFKAFFALPEATKRRYHVEGSGGARGYTAFGVETAKDSKHFDLKEFWHIGREIPDDSPYRAVMPPNLWPSEVAGFRERGHQLYQQLDQLGSRVLSALALHIGLPQDYFVDKTNNGNSILRPIHYPPITSDDIPNVRAGAHGDINFITLLVGASAAGLEVRSHEGEWVPFTADADTIVVNIGDMLQRLTNHVYPSTIHRVVNPPGEQARQPRYSVPFFLHPNPDFLIDVLPSCISADNPSRYPEPITAHGFLEERLREIKLK

SEQ ID NO: 21562 - protein, 592 aa, Boschniakia rossica
SGKPFYAIIHRVTGGLIIDFEPVKPHDVPMTAAGALQSYKLAAKAITRLQALPSGSMERLCDTMVQEVFELTGYDRVMIYKFHDDDHGEVFTEITKPGLEPYVGLHYPATDIPQAARFLFMKNKVRMICDCRANHVKVVQDENLPFDLTLCGSTLRAPHSCHLQYMENMNSIASLVMSVVVNEGNEEDGPDSSSGPDKRKRLWGLVVCHNTSPRFVPFPLRYACEFLAQVFAIHVNKELELKNQMLEKNILRTQTLLCDLLLRDAPLGIVSQSPNVMDLVKCDGAVLLYKNTKYRLGLTPSDFQVRDIVSWLDEYHRDSTGLSTDSLYDADFPGARALGDAVCGMAAVRITDSDWLFWFRSHTAAEIRWGGVKHEPGEKDDGRKMHPRSSFKAFLEVVKARSLPWKDYEMDAIHSLQLILRNAFKESEGRDLESREIHARLNELQIDGAREIEAVASEMVRLIETASVPIFAVDVDGLVNGWNTKIADLTGLCVDKAIGSHFLALVEKEEQNVQFEIKTHGQTSESGPISLIVNACASRDVKENVVGVCFIAQDITTQKSMMDKFTRIEGDYRAIVQNPNPLIPPIFGTDEF

SEQ ID NO: 21563 - protein, 608 aa, Boschniakia strobilacea
SGKPFYAIIHRVTGSLIIDFEPVKPHEVPMTAAGALQSYKLAAKAITRLQALPGGSMERLCDTMVQEVFELTGYDRVMIYKFHDDDHGEVSTEITKPGLEPYVGLHYPATDIPQAARFLFMKNKVRMICDCRANHVKVVQDENLSFDLTLCGSTLRAPHSCHLQYMENMNSIASLVMSVVVNEGNEDGPDSSSVPDKRKTLWGLVVCHNTSPRFVPFPLRYACEFLAQVFAIYVNKEFELENQMLEKNILRTQTLLCDLLLRDAPLGIVSQSPNVMDPVKCDGAVLLYKNTKYRLGLTPSDFQIRDIVSWLDEYHRDSTGLSTDSLYDAGFPGALSLCDAVCGMVAVRITERDWLFWFRSHTAAEIQWGGAKHEPGETDDGRKMHPRSSFKAFLEVVKTRSLPWKDFEMDAIHSLQLILRNAFKESEGRDSESREIHARLHDLQIDGVREIEAVTSEMVRLIETASVPIFAVDVDGLVNGWNTKIADLTGLCVDKAIGWHFLALVEDSSADTVSKMLELALQGKEEQNVQFEIKTHGQTSESGPITLIVNACASRDVKENVVGVCFIAQDITTQKIMMDKFTRIEGDYRTIVQNPNPLIPPIFGTDEF

SEQ ID NO: 21564 - protein, 389 aa, Oryza sativa
  misc_feature (317)..(317): Xaa can be any naturally occurring amino acid
  unsure (1)..(389): unsure at all Xaa locations
MSSHHRYAHLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIXDALEGPDYMVRTAKKSMLDELEGMLEIVDPQPPGKQRSLTRRKFDLPEGGPITDEKMAGVNNAVKVIQKGKK

SEQ ID NO: 21565 - protein, 398 aa, Brandisia hancei
SGKPFYAIIHRVTGSLIIDFEPVKPHEVPMTAAGALQSYKLAAKAITRLQSLPSGSMERLCDTMVQEVFELTGYDRVMIYKFHDDDHGEVFTEITRPGLESYVGLHYPATDIPQAARFLFMKNKVRMICDCRANHVQVVQDDNLPFDLTLCGSTLRAPHSCHLQYMENMNSIASLVMSVVVNEGSEEAGGPDSSLHPDKRKRLWGLVVCHNTSPRFVPFPLRYACEFLTQVFAIHVNKELELENQMLEKNILRTQTLLCDMLLRDAPLGIVSQSPNVMDLVKCDGAVLIYKNNKYRLGLTPSDFQIRDIVSWLDEYHRDSTGLSTDSLYDAGFPGALTLGDAICGMAAVRITDKDWLFWFRSHTAAEIRWGGAKHEQGEKDDGRKMHPGSSFKAFLKL

SEQ ID NO: 21566 - protein, 324 aa, Haemophilus ducreyi 35000HP
MAKEIKKIAVLTSGGDAPGMNAAIRGVVRAALNEGLEIFGVQDGYYGLYHDKVIPLDRRSVSEIINRGGTFLGSARFPQFKDIEVRKQAVKILAKYEIDALVVIGGDGSYMGAKLLTEEFGYPCIGLPGTIDNDIVGTDYTIGYQTALQTAVEAIDRLRDTSTSHQRISIVEIMGRHCGDLTISAALAGGCEYIIVPEKGLDKESLIHSIADNFRKGKRHAIIAITELMTDVHQLARELEEKFGHETRATVLGHIQRGGSPCPFDRILASRMGVYAVDLLRQGFGGRCVGIQNEHLVHHDIIDAINNMRRPFKQDIFEAASKLA

SEQ ID NO: 21567 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALRYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 21568 - protein, 165 aa, Cryptococcus neoformans var. neoformans B-3501A
MVKLPNFPQASPSSTLEVKQPGSHEHACIHLKYSSVCPQRLRHFRSALIAHFDNMSQYAHVPKSELDEAQIRELEEYEISQGPLSVLQQSVRNSSQVLISLRNNKKLLARVKAFDRHCNMVLENVKEMWTETPKGKGKKPVNKDRFISKMFLRGDSVILVLRNAA

SEQ ID NO: 21569 - protein, 204 aa, Triticum aestivum
  misc_feature (32)..(32): Xaa can be any naturally occurring amino acid
  misc_feature (36)..(36): Xaa can be any naturally occurring amino acid
  unsure (1)..(204): unsure at all Xaa locations
RGVSSLSQGHTGFCFPVTTETKSGFFGCQGVXKKAXALEGWHWLFLKNGVEVNLQRNPLSVLEAPTGNEDDDEIDGGNNSFCGSFDMGDKDMNYSSIEYQKPTKPRVRHTRPWSSCTTTSSSRANLQSTSKLRARVNLTKLGTPTLWRYWKHFNLVSMNPTPSEEQLFHGVQQHFQSQQLDELQVILGFIQTAKRLKTLYKNSS

SEQ ID NO: 21570 - protein, 325 aa, Mycobacterium tuberculosis H37Rv
MIPAVSLGDPQFTANVHDGIARITELINSELSQADEVMRDTVAHLVDAGGTPFRPLFTVLAAQLGSDPDGWEVTVAGAAIELMHLGTLCHDRVVDESDMSRKTPSDNTRWTNNFAILAGDYRFATASQLASRLDPEAFAVVAEAFAELITGQMRATRGPASHIDTIEHYLRVVHEKTGSLIAASGQLGAALSGAAEEQIRRVARLGRMIGAAFEISRDIIAISGDSATLSGADLGQAVHTLPMLYALREQTPDTSRLRELLAGPIHDDHVAEALTLLRCSPGIGKAKNVVAAYAAQAREELPYLPDRQPRRALATLIDHAISACD

SEQ ID NO: 21571 - protein, 426 aa, Alteromonadales bacterium TW-7
MTISQDLFERAQTSIPGGVNSPVRAFNGVGGTPLFITKAEGAFTFDADGNRYIDYVGSWGPMIMGHNHPAIKKAVHEAVENGLSYGAPTEAEILMAEKVKALVPSIEKVRMVSSGTEATMSAIRLARGFTNRDKILKFEGCYHGHADSLLVKAGSGALTMGVPNSPGIPEDFAKHTLTVSFNNIEEVKAIFEKYADEIACIIVEPVAGNMNCIPPVEGFLEGLRAVCDEYKSVLIFDEVMTGFRVALGGAQAYYNIKPDLTCLGKVIGGGMPVGAFGGKTEIMDYIAPVGPVYQAGTLSGNPIAMAAGLKSLELLSEPGLHDKLEAISKAICEGFEAGAKKAGIALTTNYAGGMYGFFFTDAEKVTTYKQATECDLERFKRFFHLMLEEGVYLAPSAFEAGFVCAAHTEQEVQETIAAAERCFAKL

SEQ ID NO: 21572 - protein, 542 aa, Idiomarina loihiensis L2TR
MLGNMMKRPLQIIDLLKFAANRHPRQEIVTRRLEGDIHRYSYAECWQRSGQLAHALQKLGVQPGERVASLAWNTYRHMELYYAVSGSGAVMHTVNPRLFGEQIAWILNHAESGWVFVDLSFVELLESIEDKLPGVKGFVVMTDKNHMPNTKLKNVLCYEELLESEPKDYDWPDVDENSAALLCYTSGTTGNPKGVLASHRAMVLHAQATVSADMLDLRSDTVLMPMVTMYHVAAWGAPYAGPLSGCKLVFTGDGTSGEAMAEMIRTENVTVGLGVPTIWLTLHNYLSENSLDIPSLQRVCVGGAASPMGLVKTYDQEYNVYWQPIWGMTETGPLVHSVPPQADVTHRPKEEQYKLQTTAGRPVFGIEHRIVDAEDTPLPNDGETRGELQVRGHWIASQYFRNDDLSSFPDGWLATGDIAVIDPEGFMKVVDRKKDVIKSGGEWISSLDIENFVSQHQAVNESCVIGVKHPKWDERPLLLVVLNKGESLSKEDIKNFLDGKIARWWMPDDVVFVDELPHTGTGKLIKNTLREQYQNYLQENEL

SEQ ID NO: 21573 - protein, 405 aa, Oryza sativa
MAVKRCAEVPISARPGKMMRIAIKSWSRFLPPYIPDDVIFDILLRLPSKSLIRFKSVCKAWHAIISNPCFISAHLECSKQKPSIFMVPGVYEKQNNGENTSFLMGLYQYQGGNIMEQIHVQDFPQGIGTWSRPIHCNGMLLISTMNHEMIVCNPSTREIVSLPKGSYNLHAGPRAGFGFDPHSNKYKVARFFYQRDDDTSELVCKFEVLTLGTNLWRQTEDPPYPISGLTPVHVKGAIYWMVNTPLCPDPPNAFLRFCLTNEKFSLLQYPPCNLKPTRFIEVEGELCCACFCSQVSALKIWTCNYAQNPEWTQRCTVQIPPDIVVNNPVARPPIVFLHGKKLLLTWNQVYQYDIQTCRMEKIASGVEDFTCYDPRNNKYWAYLEKEVTDMHLFNYAESLVPIREF

SEQ ID NO: 21574 - protein, 534 aa, Aspergillus nidulans FGSC A4
MADGVVAGTRVEAPVTWKTYLMCAFAAFGGIFFGYDSGYINGVMAMDYFIHEFSGKVKAEYEAADNLSGYVISSSNKSLITSILSAGTFFGAIIAGDLADWFGRRTTIISGCGIFMVGVALQTASTTVALLVVGRLIAGFGVGFVSAILILYMSEIAPRKVRGAIVSGYQFCVTVGLMLASCVDYGTENRTDSGSYRIPIGLQLLWAIILAVGLFLLPESPRYYVRKGDVSSAAKVLARVRDQDVESDYVKEELAEIVANNEYEMSLIPQGGYFATWFNCFRGSIWSPNSNLRRTILGTSLQMMQQWTGVNFVFYFGTTFFTNLGTISDPFLISMITTIVNVFSTPISFYTMEKIGRRPLLLWGALGMVICQFIVAIAGVVDGSNNKTVSAQIAFICIYIFFFASTWGPGAWVVIGEIYPLPIRSRGVALSTASNWLWNCIIAVITPYMVDEDKGNLKSKVFFIWGSLCACAFVYTYFLIPETKGLTLEQVDKMMEETTPRTSSKWKPHGTFAAEMGMTEKDVTQTVEDIAKKA

SEQ ID NO: 21575 - protein, 466 aa, Buchnera floridana
SGKPFYAVIHRVTGSLVIDFEPVEPHEVPMTAAGALQSYKLAAKAISRLQALPSGSLERLCETMAQEVFELTGYDRVMVYRFHDDDHGEVFAEITRPGLEPYLGLHYPATDIPQAARFLFMKNKVRMICDCRAAHVKVVQGEGLSSNLTLCGSTLRAPHSCHLRYMENMNSIASLVMSVVINEGTDEESSATSSSSSHPDKQKRLWGLVVCHHTSPRFVPFPLRYACEFLSQVFSIHVGKELELLNQTVEKNILKTQTMLCDMLLRGNPLAIVTRSPTVVDLVKCDGAVFLYKGKYHRLGLAPSDLQIQEIVSWLDEYHRDSTGMSTDSLLGAGFPGAAKLGDAFCGMAAVRITGRDWLFWFRSHTAAEVQWGGAKQEKGDEDDGRKMHPRSSFKAFLEVVKARSVPWRDFEMDAIHSLQLILRKACDKEEEEEARRKDMVVAGEIQSRLNEMHIDGAKEMEMVTS

SEQ ID NO: 21576 - protein, 233 aa, Onion yellows phytoplasma OY-M
MNILSIETSCDETSCAVTQNGKKVLSNVVFSQIKDHQIFGGVVPEIASRKHIQFMTLVLQQALKEANLTPQEIDLVAVTQGPGLVGSLLVGINAANVFAYTYQKPLLGVNHLLGHIYSAQIEHEINFPALVLLVSGGHTDLFYLTDHLQIKPLGTTLDDAVGEVYDKIAKNLNLPYPGGPLIDQLAQQGKDTYHLVRPYLKNDNLNFSFSGLKSTLVNLVMKQNLKDINIPDL

SEQ ID NO: 21577 - protein, 463 aa, Ashbya gossypii ATCC 10895
MNSRLGQVLRQAVRVQTGLRGPARSMRGYVSQTQTKQNTVAVVAGAAERFVAPAADAHLKTLSQRELVALGVIGCVTTNARLLKLVTQAFPYVPTPVAKLLISALYCGGDTMAEVRETGRALARRGVGNMMLSLTVEDSEGTKNIDIDYIVEETVRSLHGVLLPHMEEQLARAADVNSVPPGYLALKPSALVSDPANTLLHFADPAWREKRDALVANFSRIVGEVYKLNQEMLARYPGRKSPFFVATIDAEKYEVQCAGVYELQRLMFAKYNPVSSPIVSCIGTWQLYLRDAAADLVAQAERAEREGYKLGLKLVRGAYLHSEPNRDVIHPTKEATDEHYNEVMAKVIQDLLANGEHSVFGHLVVASHNYQSQMLATMLLQAHGESVGKSNVVLGQLLGMADNVTYDLIHNHGARNIIKYVPWGPPKETKDYMHRRLQENGDAVRADNGWPLVKAVCRALFYR

SEQ ID NO: 21578 - protein, 349 aa, Aeropyrum pernix K1
MPPKRDGEVLVLGIESTAHTFGVGIVSTRPPIVRADVRRRWTPREGGILPREVAEFFSLHAGEAVAEALGEAGVSIADVDAVAVALGPGMGPALRVGATVARALSAKYGKPLVPVNHAVAHVEAARFTTGLRDPVALYVAGGNTTVVSFVAGRYRTFGETLDIALGNLLDTFAREAGIAPPYVAGGLHAVDRCAEGGGFVEGIPYVVKGQDVSFSGILTAALRLLKRGARLSDVCYTLREVAFSSVVEVTERCLAHTGKRQATLTGGVAANRVLNEKMSLMAGLHGAVYRPVDVRLSGDNGVMIALTGLAAYLHGVIIDPGEAYIRQRWRIDEVDIPWYPWLPGDPPPG

SEQ ID NO: 21579 - protein, 433 aa, Haemophilus ducreyi 35000HP
MAKIVKVIGREIIDSRGNPTVEAEVHLEGGFVGLAAAPSGASTGSREALELRDGDKSRFLGKGVLKAVAAVNNEIAQAIVGKEGCAQSEIDQTMIDLDGTENKSKFGANAILAVSLATAKAAAASKGLPLYAYIAELNGTPGVYSMPLPMMNIINGGEHADNNVDIQEFMIQPIGAKTLREALRIGAEVFHNLAKVLKAKGLSTAVGDEGGFAPNLASNADALACIKEAVENAGYVLGKDITLAMDCASSEFYNKENGLYEMKGEGKSFTSQEFTHYLENLCKEYPIVSIEDGQDESDWDGFAYQTKILGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALGEMAPFLGLKAIKGQA

SEQ ID NO: 21580 - protein, 347 aa, Candida glabrata CBS 138
MGIFSRKKKEATPVNRGDLIPCETMIEAPPKGSPPPKKPADLDAEQTKKLAQMLEHFNKPDLVLPVSSTDDTGKTRPISSWEKFFLTRDCFLRYLRAQKWDVPKAIKMLTETLVWRREVGITHGEEDEHPLKPEDIAVENETGKEILLGFDYDRRPLFYMKNGRQNTESSFRQVQQMLFMMECATTLTPQGVEKMCVLVDFKHYKEPGIITDKAPPISIAKMCLHIMQNHYPERLGKCILINIPWFIWAFLKMMYNFLDPATKEKVIFDEPFTNHIDPSQLEATYDGRLDFKYNHAVYWPDMNAKIEAIRNKQYERFQKFGAVMGLSEWDLKGDHDELVYPVDSIKA

SEQ ID NO: 21581 - protein, 332 aa, Candida glabrata CBS 138
MFSGFGFGNTGSVPIPQEFEDFFRCYPIAMMNDRIRKDDANFGGKIFLPPSALNRLSMLNIRYPMLFRLTSNESGKVTHGGVLEFIAEEGRVYLPQWMMETLNAQPGSLMKINSTDVPLGQFVKIEPQSTDFLDITDPKAVLENVLRNFSTLTIDDIIEISYNNKTYRIKVLEVKPESAAKSICVIETDLVTDFAPPVGYVEPDYKALKAEQDAKRKSAAIDPVKHSQGSMATRINYSNILNSTDSETIRFAGEGQKISGKPNKTSKGKQDISEIKISLDSEPARLDLPEGQLFFGFPLVLPKDENADEEENDKKVFIGEGQSLRKSKKSKK

SEQ ID NO: 21582 - protein, 358 aa, Solanum lycopersicum
MMTRGATRMTRVVMGHMGPRYFSTTVLRNNPGTGVVGGVAAGLLHGFPANPSEKVAVTWVRHFSAMGSRSASTAALNDKQQEKESSDKKVENTATATAAVNGGVGKSVVSYWGVPPSKATKPDGTEWKWNCFRPWETYEADMSIDLTKHHAPVTFLDKFAYWTVKILRFPTDVFFQRRYGCRAMMLETVAAVPGMVGGMLLHCKSLRRFEQSGGWIKALLEEAENERMHLMTFMEVAKPNVYERALVFAVQGVFFNAYFAAYLISPKLAHRIVGYLEEEAVLSYTEFLKELDNGNIENVPAPAIAIDYWRLPKDATLRDVVLVVRADEAHHRDVNHYASDIHYQGQQLKDSPAPLGYH

SEQ ID NO: 21583 - protein, 409 aa, Magnaporthe grisea 70-15
MYPSSSDNSGLSSPGQANRPEFELAVLARWRNWVSSSSYSPWNLHYITPPRPNDLPNDMDESPNGWADAFEDLLRASSHSTGGPNLPLADHHERLRAARKDRVDHRNVDRRWLWLAGLRAEGLLGAAYPAGKGRSHAVLRDMASEAFGAHSSLPQTEEDVFLRFMKDSEDVLDVLPKAVGFVSDRDDSGPTGHGMEDPSRKQRTPGKHVSTEKFQNSDGTTTVVTREEKVDGKGNTRSVKTVTKTLDQEGNEIICGNAVRIGSFLTPPAHAVRWGLPCTRSGDMTWVYRKKLRCNKLLGKEHHLSIDQRNASQLKPHKTTYATTMDASDVEKLQPKDKAELLQFVNNEQQRTKVQSQTHNLTEVCWKKCVTSIKGNGLEKSEEQCLASCVDRFLDVNLATMQHLSTLRR

SEQ ID NO: 21584 - protein, 379 aa, Oryza sativa (japonica cultivar-group)
MSTSAPTSSPEPPEFIRGSLIPALPDDLAIHCVALLPRAAHPSLALVSRAFHTLLCRDPGPLLAARRRLRLSDPHVILSLRPPASASPLFFLLLPHPGWPPLPLPSPPVPVSSSSSVAVDGNRVFLFGGSVSGVPSPSVQILDPRTRSWSVGPRLSSPREFAAAVAHSGVLFVAGGCVPSSPFWAESLNLSSPDAKWSPVPSPPHFREKWMHGSASLAGKVLAVADRGGLAYDPAAPPTEAWAPVSPILDMGWKGRAAVVGGILYSYDYLGQVKGYDPDTDCWSKVEGLEQELPKFLCGATLANVGELLYLVWEGKWKGKGKAKGKGEARSMVVIDWAAIAVTKAEEGRLTGKVLSRDTIVFKDMPKGSAITHCIALEL

SEQ ID NO: 21585 - protein, 511 aa, Rhodococcus aetherivorans
MLNQGTGTWPHRRARQAPDAVALDFRGTTVTYRELDERVTRLAHALRARGIGPGDRVALLSANHPAYLEVLFAAGLLGAVFVPLNARLTTPEVEYCLADSGSAVLIHSAALADVADAAATAAGTAAGTARRVVLDGAPDDRAVGYKEIIATGPADRLDLPVTHNDPCFIMYTSGTTGRPKGVVLTHGNEVFAVMKAIVDLDFLSDQVALDAAPLFHTDALNLIALPTLLKGGTVIVEEGFKPGRILHLIETKRVTYSFGVPTMLDAMSTHPNWNRTDLSSIRRWIVAAAPVPPRTLQTYTARGVRLCQGYGLTETGPGALILTPKDAERKLGTAGAPHFFTDVRVVDPDGPEVAPGDRGEIQISGPNVMRRYWNRPDATAEAFTGDGWFRSGDVGVPDEDGFVTIVDRLKDMIISGGENIYPAEVEAAILDLPGVLGCAVFGVPDEKWGEVGRAAVTLADGATLTEDELFAFLGERLARYKIPKSLLVLDEIPRNATGKIRKDKLREQYAH

SEQ ID NO: 21586 - protein, 587 aa, Magnaporthe grisea 70-15
MSGPPSRLKAVLGHLGLANAGAEATQGTGRPNHLHALSPTLFLQRAAAIEPEAEAVVHVTANGRTLRRSYAELADRARGLAYYLAKKGFFRVGILAPNTPAFLESIYGVNASGGVIVPVNYRLKQEDIAYIFEFANVDAIIVDAEFVGLLELYQKDHVNVPLIIDTDTDATEGELSGPFDECIAQGLQHDREAGGKGWDGLCQQPNDEDDIIAIPFTSGTTSKPKGVEYTHRGAYLAALANIVESGLNYNVGRCKYLWTLPMFHAVGWTFPWAVTAVRGTHVCLRKIDYPLIWRLLTGERVTHFNAAPTVCTLLCAADEAQRLPDPPVRVTVAASPPTAHLFRQMTELNLSPVHVYGMTETYGPITKGYHMPAWETLPEADKFARMARQGHGFLTSLPIRIVKPEEAENGVLIDVAKDGVEIGEIVFAGNICAKGYYNDPEATKKMFAGGVLHSGDLAVWHPDGSAQILDRQKDIIISGGENISSVALESMLVQHPDVLEAGVVAVPDSHWGERPKAYVTVRRSKEAGMEPLTGQGLIDWAKHQSAISKFMIPREVEIVDELPKTSTGKIKKNELREWAKHGKSSLE

SEQ ID NO: 21587 - protein, 476 aa, Magnaporthe grisea 70-15
MSLPKDFLWGFATASYQIEGAIDKDGRGPSIWDTFTAIPGKVADGSSGVTACDSYNRTQEDIDLLKSVGAQSYRFSISWSRIIPIGGRNDPINQKGIDHYVKFVDDLLEAGITPLITLFHWDLPDGLDKRYGGLLNREEFPLDFEHYARVMFKAIPKCKHWITFNEPWCSSILAYSVGQFAPGRCSDRSKSPVGDSSREPWIVGHNLLVAHGRAVKVYREEFKAQDKGEIGITLNGDATFPWDPEDPRDVDAANRKIEFAISWFADPIYFGEYPVSMRKQLGDRLPTFTEEEKALVKGSNDFYGMNCYTANYIRHKEGEPAEDDYLGNLEQLFYNKAGECIGPETQSPWLRPNAQGFRELLVWLSKRYNYPKILVTENGTSVKGENDMPLEKILEDDFRVQYYDDYVKALAKAYSEDGVNVRGYSAWSLMDNFEWAEGYETRFGVTFVDYENGQKRYPKKSAKAMKPLFDSLIEKD

SEQ ID NO: 21588 - protein, 413 aa, Coprinopsis cinerea okayama7#130
MSLSNKLSITDLDVKGKRVLIRVDFNVPIQEGKITNPAGLLKEYLIVILGAKSVVLMSHLGRPDGKVNEKFSLKPVAAKLEELLGKSVIFTNDCVGADVEKAVNGAPDGSVILLENLRFHIEEEGSVKNKDGTKTKADPAAVTAFREGLTKLGDVYVNDAFGTAHRAHSSMVGVKLPQRAAGFLMKKELEYFAKALEHPERPFLAILGGAKVSDKIQLIENMLDKVNSLIICGGMAFTFKKALDGVAIGNSLFDSAGAEKVASLVEKAKKNNVKLVFPVDYITADKFDKDAATGTATDKDGIPEGWMGLDAGPESRKLYRETVLEAKTILWNGPPGVFEFPAFANGSKELLKATEEAVAKGATVIIGGGDTATVVAQFGDESKLSHVSTGGGASLELLEGKTLPGVAELSEKQ

SEQ ID NO: 21589 - protein, 1166 aa, Xanthobacter autotrophicus Py2
MRPERDRKGASAPEANLPGSIDETDPAVRPRVYPGAGGDGGERQTEMPKRTDIETILIIGAGPIVIGQACEFDYSGTQAVKALKEEGYRVVLVNSNPATIMTDPDMADATYIEPITAEIVTKIIEKERGDRSKGFALLPTMGGQTALNCALSLKKMGTLEKYDVEMIGATAEAIDKAEDRELFREAMTKIGLSTPTSRQIKTLSQALEALEVVGLPAIIRPSFTMGGTGGGIAYNKAEFIEIVERGIDASPTNEVLIEESVLGWKEYEMEVVRDKADNCIIICSIENIDPMGVHTGDSITVAPALTLTDKEYQIMRDASLAVLREIGVETGGSNVQFAVNPADGRLIVIEMNPRVSRSSALASKATGFPIAKVAARLAVGYTLDEIENDITGGATPASFEPTIDYVVTKVPRFAFEKFPGADPVLTTAMKSVGEAMAIGRTFQESLQKALRSLETGLTGLDDIEIEGLGQGDDKNAIRAALGTPTPDRLLYVAQAMRLGLTDEQIHSACKIDPWFLAEIRGIVETEAKVRRLGLPVTAGAFRSLKAMGFADARLATLAGLSEAEVRERRQRLDVRPAYKRIDTCAAEFASPTAYMYSTYETPFAGAVADEARPSNRQKVIILGGGPNRIGQGIEFDYCCCHAAFALKDAGYEAIMVNCNPETVSTDYDTSDRLYFEPLTAEDVLELIAREKTSGTLKGVIVQFGGQTPLKLAKALEDAEVPILGTSPDAIDLAEDRDRFKTLLDRLKIRQPANGIAYSVEQARLVAAELGYPMVVRPSYVLGGRAMQIIREESQLGDYLLETLPGLVPQEVKARYPNDKTGQINTVLGKNPLLFDRYLSDAIEVDVDALCDGTDVFIAGIMEHIEEAGIHSGDSACSLPPYSLSPEILAALEKQTAAMALALGVVGLMNVQYAIKGDVIYVLEVNPRASRTVPFVAKVIGLPIAKIAARVMAGEKLASFNLERPQVAHIAIKEAVFPFARFPGVDTVLGPEMRSTGEVMGLDTDFGVAFAKSQLGGGTKVPKSGTVFVSLKEGDKERILPSIKMLLDIGFKVIATSGTQRFLEEHGVPSAKINKVLEGRPHIVDAIKNGEVQLVFNTTEGAQALADSRSLRRAALLQKVPYYTTLSGAIAAAQGIKAYAGGDLKVRPLQDYFEAGGQEARGKASVA

SEQ ID NO: 21590 - protein, 334 aa, Burkholderia xenovorans LB400
MARKITFSQAINEALSQEMARDETVIVMGEDNAGGAGSPGEQDAWGGVLGVTKGLFHKYPGRVLDTPLSEGGYIGAAVGAAACGMRPVAELMFIDFMGVCFDQIFNQAAKFRYMFGGKAVTPVVIRAMQGAGLRAAAQHSQMLTSLFTHIPGLKVVCPSTPYDAKGLLIQAIRDNDPVIFCEHKLLYSREGDVPEESYAIPFGEANVVRDGDDATIVTYGRMVHYATEAAEKLAKDGIEVEVIDLRTTSPLDEDTILESANRTGRVVVVDEANPRCSMATDISALIAQRAFRSLKAPIEMVTAPHTPTPFAGVLEDMYIPSARQIADAVLKVRG

SEQ ID NO: 21591 - protein, 567 aa, Triticum aestivum
MASPALISDTDQWKALQAHVGAIHKTHLRDLMTDADRCKAMTAEFEGVYLDYSRQQATTETIDKLFKLAEAAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAEAAKGRQLRFLANVDPVDVARSIKDLDPATTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHVHTSSFEKNIPVLLGLLSVWNVSFLGYPARAILPYCQALEKLAPHIQQLSMESNGKGVSIDGVRLPFEAGEIDFGEPGTNGQHSFYQLIHQGRVIPCDFIGVIKSQQPVYLKGETVSNHDELMSNFFAQPDALAYGKTPEQLHSEKVPENLIPHKTFQGNRPSLSFLLSSLSAYEIGQLLSIYEHRIAVQGFIWGINSFDQWGVELGKSLASTVRKQLHASRMEGKPVEGFNPSSASLLTRFLAVKPSTPYDTTVLPKV

SEQ ID NO: 21592 - protein, 500 aa, Mycobacterium sp. JLS
MTANRRPEGVPQRIQHFIGGKLVDSLADTWFDVIDPVTNQPYAQAAAGQADDVDRAVAAAKVAFRTGPWPNMQARSRSRVLNRIADAIESRDARLAELESFDSGLPITQALGQARRAAENFRFFADLVVAQADDAYKVPGSQINYVNRKPKGVAGLITPWNTPFMLESWKLAPALASGCTVVLKPAEFTPLSAGLWADIFRDAGVPDGVFNLVNGIGEEAGDALVKHPDVRVISFTGESATGEIIFRNCATGLKGMSMELGGKSPAVVFADADLDAALDSTLFGVFSLNGERCTAGSRILVQEEIYDEFVERFAARAAGIVVGDPQDPRTEVGALVHPEHFAKVMSYIDVGKTEGRLLCGGGRPAHLPQGNFVAPTAFADVEPNARIFQEEIFGPVVALSRFQTEEQALALANGVKYGLAAYIWTNDLKRAHRFAQNVDSGMVWVNSHNVRDLRTPFGGVKASGLGHEGGYRSLDFYTDQQAVHITLGDVHTPRFGITAR

SEQ ID NO: 21593 - protein, 1079 aa, Coprinopsis cinerea okayama7#130
MEILDEKQPGPPMEVDEAVSVRDHEAFAAKHLPDLGHDVKDFKVFTWRLENWRQLDKKLTSPEFECGGHKWRILLFPFGNSNAPPNDTVSVYLDYAEPKKSPEGWHACAQFALVISNIHDPTIYTVSHAHHRFIAEECDWGFTRFSELRKLFQPVEGQPRPTIENGSADITVFVRVLEDPTGVLWHNFVNYDSKKETGFVGLKNQGATCYMNSLLQSLFCTHYFRKIRRYIKYRQNTITPPKAWRLLCSEYSITYKLQISQSEFNRVLQDKLESKMKGTKAEGAIQKLFVGKMKSYIKCVNVDYESSRTEAFNDIQLNVKGMKNLYESFKDYVAVEMLDGENKYQAEGFGLQDAKKGIIFESFPPVLHLQLKRFEYDIQRDAMVKINDRHEFPFEIDLEEFLDPAADRSQPWVYKLTGVLVHSGDLHGGHYFALIKPDRNSRWLKFDDDRVTPVTDKEVLEENYGGEPLNGIPPTYQRNQGRTIKRFTNAYMLVYIRESAMDEILAPFTEEDTPAHLKRRLDEEKLQQEAKKREREEQHLFLTAKVITDETFSRHEGFDLASFDEKNWPPSDLPSFRVLKQETYATFKNRIARHFNYHDNQIRLWVLVNRQNKTVRPDTWIPENEPTLTVDVIRNQMAARQTDLRLYVDVIADPSKPDPPPQTIMIFLKHFDTTKQSLTGVGKVYVGRQSKVGDLIPIINERMRWTPGTPLKLYEEIKPGMIELMKPKLTFSQSEIQDGDIICFQVDLSEKEITDLDSQGLYSNPVQFYDFLQNRVMLIFRPKHEDGQDNPEFHIILSKKHNYDMMANKVGEALRHDPIKLRFTTTHASNGSPKAILKRSLNQSIAEIMAPNYISPTTTVILYEKLDVSIVELETKRSLKVIWTGIHNKEEASYPFLLPKTSMVHDLADHLAKQVTLSPGGTGKIRVFEISKDGKMQKEFTGSEMIGNIPDPVELYAEEVTREELEADDTDKVIGVFHFSKELTRTHGVPFKFVVKRGEKFYDTKKRLQARLGVSDKEFAKYRFALIQASTFKQPSYIEDEDTIYDHQFAPEDVLGLDHVDKSGRTRAGGGEKAIVIRG

SEQ ID NO: 21594 - protein, 327 aa, Burkholderia xenovorans LB400
MSVSTELSKDELLKAYRMMRTIREFEERLHVEFATGEIPGFVHLYAGEEASAVGTMLHLNDADYVATTHRGHGHCIAKGVDVRGMMAEIYGRKTGVCHGKGGSMHIADLSKGMLGANGIVGAGGPLICGAALAAKYKKSGGVGVCFFGDGASNQGVIFESMNLASVWRLPAIFVAENNGYAEATSSTWSVATDNIADRASGFGMPGVIVDGFDFFAVHEALGEAIERARHGGGPTLVEVKFSRYFGHFEGDAQTYRAPGEVQKLRDEKDCLKRFEERVVRAGMLSADQLRGVDAEVKTLIDTAVTEAKAAPLPTAEDLLSDVYVSYP

SEQ ID NO: 21595 - protein, 316 aa, Mycobacterium sp. JLS
MTARRDPHSIRGSITPLMTPFTDDGAVDHRSLANLVNWQLASGSHGISIGGSTGEPGAQSVAERLAAIATVMKSVSGRAPVVAGTGTAKLDETIELTGRAAELGIDAALVITPYYARPTQEALYRWYKTVAEEYPDLPILAYNVPVRTAVDLAPETIARLYRDVENFVGVKETTKDFEHFSRVMHLCGPDIIVWSGIELLCLPLLALGGTGFLSATANIAPAAHARMYELWIAGAHEEARAIHYGLHPLVDLLFVETNPAPGKWLLKDLGLIASDHVRPPLITPTPGALERIAVLRRAGEKFLTPVGDFALEGAFA

SEQ ID NO: 21596 - protein, 292 aa, Glycine max
  misc_feature (202)..(202): Xaa can be any naturally occurring amino acid
  misc_feature (248)..(248): Xaa can be any naturally occurring amino acid
  unsure (1)..(292): unsure at all Xaa locations
MAATFKHHPTGLHGWGAPRSSRNLPSFFSMRFPCSTRHHHIRASVSHHSSTEAESALILIRHGESLWNEKNLFTGCCDVPLTNRGVEEAIEAGQRISYIPIDMIFTSALIRAQMTAMLAMTQHSQKKVPIIIHDESEQATTWTQVYSEKTTKQSIPVITAWQLNERMYGELQGLNKQETAERYGKEKVHEWRRSFDIPPPKXEPQLKSGKHVMVAAHGNSLRSIIMYLDGLTSQEVTSLEISTGIPLXLYIYKEGKFNSRGSPVGPTEAGVYAYTQSLAVYRQQLDDMSSCY

SEQ ID NO: 21597 - protein, 324 aa, Bacteroides fragilis YCH46
MDSLSLIKSPITTELEDFKNLFDSSLSSSNLLLNNVIAHIRQRNGKMMRPILVLLVAKLYGEIKPETLHAAVSLELLHTASLVHDDVVDESTERRGQLSVNAIFNNKVAVLVGDFLLATSLVHAERTRNHDIIGVVACLGQDLAEGEILQLSNVSNREYSETIYFDVIRKKTAALFAACTKAAALSVEVTDEKAEFARLFGENIGICFQIKDDIFDYFESKEIGKPTGNDMLEGKLTLPALYVLNTTTDAWAQEMALRVKAGTATVDEITRLIEFIKQNGGIEYAVKVMYEYKERALDLLRTLPDSAVKTSLITYLDYVVDRDK

SEQ ID NO: 21598 - protein, 327 aa, Prochlorococcus marinus str. MIT 9313
MSGTLLFNALRDAIDEEMARDSHVCVMGEDVGQYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLIEELPDGDYVCALDQADLVREGKDVTILTYSRMRHHCLKAVEQLEADGIDVELIDLISLKPFDMETIVRSIRKTHRVIVVEECMKTGGIGAELIALITEQCFDELDARPIRLSSQDIPTPYNGKLENFTIIQPHQIVEAAKQIVLKGL

SEQ ID NO: 21599 - protein, 609 aa, Castilleja miniata
SGKPFYAIIHRVTGSMIIDFEPVKPHEVPMTAAGALQSYKLAAKAITRLQALPNGSMERLCDTMVQEVFELTGYDRVMIYKFHDDDHGEVLSEITKPGLDPYVGLHYPATDIPQAARFLFIKNKVRMICDCRANHVKVIQDDNLPFDLTLCGSNLRAPHSCHLQYMENMNSIASLVMSVVVNEGNEDGPNSSSHPDKKKQLWGLVVCHNTSPRFIPFPLRYACEFLAQVFAIHVNKEIELENQMLEKNILRTQTLLCDMLLRDAPLGIVSQSPNVMDLVKCDGAILIHKTKKYRLGMTPSDFQIRDIVSWLDEYHRDSTGLSTDSLYDAGFPGALALGDAVCGMAAVRITDTDWLFWFRSHTASTIRWGGAKHEPDDKDDGRKMHPRSSFKAFLDVVKTRSLSWKDFEMDAIHSLQLILRNSSSKEAEKGDVEGKEIHARLNDLQLDGKKELEAVTSEMVRLIETASVPIFAVDVDGHVNGWNTKIADLTGLPVDKAIGRHFLALVEDSSAEAVNKMLELALQGNEEQNVQFEIKTHGPRSESHPISLIVNACASRDVKENVVGVCFIAQDITTQKSMMDKFTRIEGDYRAIVQNPNQLIPPIFGTDEF

SEQ ID NO: 21600 - protein, 451 aa, Prochlorococcus marinus str. MIT 9313
MSDATSHEIDHFMKGLMKRNPGEPEFHQAVHEVVETLIPFILSNRVYKDAQILERMTEPDRVVIFRVCWEDDSGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFIKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFTKVADAMLAYGIV

SEQ ID NO: 21601 - protein, 377 aa, Oryza sativa (japonica cultivar-group)
MPATAGRVRMPANNRVHSSAALQTHGIWQSAIGYDPYAPENNKHQPPSSSVSANAAAANAAAASAPSASAPSSSSAAASSDNAYTSFQGLLALARITGSNSDETRGACRKCGRVGHLTFQCRNFLSVKEDLDMEDDIDAGIRAASQANAQAKLDEFRKKTSGGKDADEGSDDEDEDDEEDSDDSSDSDIDPELERIIAERERAKSGRKHSRDEEKKTSRHRSSSRGRSKHRRSTKRSDTEDDLEEERSKDKKKKSRRKRHERSDEDSESDSDKKRHRKSRKDRKRRRSHRRSDDTSDEDESGGEDRRRRRHRKRQHHHRKGASDGDSGSGASDSADDRKRSSRRRRHRKSESSGSDGDERHGQGAKRSKEKRGKEEC

SEQ ID NO: 21602 - protein, 460 aa, Ralstonia eutropha JMP134
MKHLQRNLGARHIRFLALGSAIGTGLFYGSASAIQLAGPAVILAYILGGAAVYMVMRALGEMAVREPVSGSFGRYASEYLGPLAGFLTGWTYILEMIIVCLADVTAFGIYMGFWFPEVPQWIWVLGIVMLICGLNLCNVKVFGELEFWLALVKILAIGAMIIGGTLILFLGVKMNGEHSPGLTNLWAHGGFLPHGAGGLIASLAVVMFAYGGIEIIGITGGEAKEPEKVIPRAINAVPARILLFYVLTMVVLMAIFPWTGIGGQGSPFVQIFSGLGIKSAAAILNLIVISAAISAINSNIFGAGRMMFGMAEQGQAPRLFAITSRQGVPWVTVLAMAAALLGGVVLNYLIPEQVFVIIASIATFATVWVWLMILLSQVAMRRRLSAEEVRALKFKVPMWPVGPALAIAFMLFVICVLGYVEDTRVALYIGAGWVALLSLAWYLRAKPHEDRILTGESSAL

SEQ ID NO: 21603 - protein, 547 aa, Oryza sativa (japonica cultivar-group)
MDKLGANPANSCALTPLGFLERAATVFGDCPSVVYHDTVFTWSQTHRRCLRLASALVSSLGISRGDVVSVLLPNVPAMYEMHFAVPMSGAVLNSINTRLDARTVSVLLRHSGSKLIFVDPALLPVLRDALRLLPAGHTAPRVVLVEDPHEKEFPPAPAAALTYERLVEKGDPEFAWVRPASEWDPMILNYTSGTTSAPKGVVHCHRGIFLITVDSLVDWAVPPRPTYLWTLPMFHANGWSFPWGMAVVGGTNVCLRRVDAAEVFDTIARRGVNHLCGAPVVLNMLANAPEGVRKPLPGKVRILTAGAPPPAAVLYRTEAIGFEVSHGYGLTETAGLVLSCAWKGEWDKLPASERARLKARQGVRTPGMAEVDVVDGETGRSVPRDGSTMGEIVLRGGCITLGYLNDEAATKAAIRDNGWFYTGDVGVMHPDGGGENISSVEVESVLYGHPAVNEAAVVARPDEFWGETPCAFVSLKQGGGAVTAADVVAWSRERMPRYMVPKTVIFRDELPKTSTGKIRSTCSGISPRRWGPPRAPTPNATVKCSGI

SEQ ID NO: 21604 - protein, 427 aa, Glycine max
MSLSVPKLARPLPLHHHSSYGSLTMSFHTFTPFLGSTHKLRFISPIKLNAPRFNSSVVSVSDLFKNNKPKSTTNLLITKEEGLQLYEDMVLGRSFEDMCAQMYYRGKMFGFVHLYNGQEAVSTGFINFLKKEDCVVSTYRDHVHALSKGVPARAVMSELFGKATGCSRGQGGSMHMFSKEHNLIGGFAFIAEGIPVATGAAFSSKYRREVLKEADCDHVTLAFFGDGTCNNGQFYECLNMAALWKLPIVFVVENNLWAIGMSHLRATSDPQIWKKGPAFGMPGVHVDGMDVLKVREVAKEAIERARRGEGPTLVECETYRFRGHSLADPDELRDPAEKAHYAGRDPISALKKYMIENKLASEQELKTIDKKIEEVVEDAVEFADESPHPPRSQLLENVFADPKGFGIGPDGKYRCEDPKFTEGTAHV

SEQ ID NO: 21605 - protein, 404 aa, Gibberella zeae PH-1
MKHRVIHQFKRAHIASCPSTARFSLALPIGRRCYSTHPPNAKLNLPVDYGTTPLLAHSSQTALSHKELPEHIRNGPTKKMNLFQAINDAMGIALTEDESVVVFGEDVAFGGVFRCTMNLAETHGAERVFNTPLTEQGIMGFGIGLAAEGMRPIAEIQFADYVYPAFDQLVNEAAKFRYRDGTCGRSVGGLTVRMPCGGVGHGGLYHSQSPESLFTHIPGLKVIMPRSPAQAKGLLLAAIRSNDPCVFLEPKILYRAAVEQVPTGSYELPLSKAEVLKEGKDVTIVSYGQPLYLCHNAIKQAEQDLGISVELIDLRTLYPWDKKTVLESVRKTGRAMVVHEAMVNAGIGAEVAAVIQEDHDTFLRLEAPVARVAGWSIHQPLLYERFNLPDVARIYDNIKRLLDY

SEQ ID NO: 21606 - protein, 600 aa, Desulfotalea psychrophila LSv54
MEQSKIRNVAIIAHVDHGKTTLVDELFKQSGMFRDNQAVSERLMDSGDIEKERGITITAKNGSYHYDDHMINIIDTPGHADFGGQVERVLRMADGALLLVDAQEGPMPQTYFVLKKALENHLPVIVVINKIDKPAARCDWVVDQVFDLFVKLNAPDHILDFPIVYASAKEGYALLNPDDEIVDGGSMECISRMIIEQTPAPVGSVDAPLQMQVGTIDYSPYLGRLGIGKVVNGTMTINQPIAVARRDGSLTPVRITKIYRFECDGKVSIESASVGEIVAVAGMDDVNVGVTFTDLANPTPLPLIEIDPPTISMHFIPNDSPFAGREGKYVTSRHIGDRLEKEILSDVALRYEPLTDAVGFKVSGRGELHLSILIENMRREGFEFQVTRPQVIMREDDNGQVLEPYETLTVDVDELYQGPVIEKLGKLKGQMEEMTLANGMVRLIYKIPTRGLLGYKSQFMTDTKGMGMMAYVFSEYGPYAGDIINRVNGVLIAKETCVAVAFALFNLQDRGYLIVKPGDPLYAGQIVGEHARAADLVVNPAKGKKLTNMRASGSDEAVILVPAKAMTLEDCIAYINDDELVEVTPQSIRLRKKPGVRIRS

SEQ ID NO: 21607 - protein, 1024 aa, Pyrobaculum aerophilum str. IM2
MDIKKILVIGSGAIKVAEAAEFDYSGSQALKAFREEGIKTVLVNPNIATIQTSKFLADRVYFIPIQRQFLAEVIEQERPDAIACGFGGQTALSACVDLDEAGVLEKYGVRVVGTPVRGIKRALSRDLFQKAMREAGIPVPPSSPAKSPEEAIEIARYLGYPVVVRVSFNLGGAGAFVARSEEALKARIYKAFAQSAIGEVLVEKYLEGWKEIEFEVVRDAYDNVAAVVCMENIDPMGVHTGDSIVVAPCLTLTDEEYQTARNISIGVVRTIELIGEGNVQVAINYAGPEQYAIETNPRMSRSSALASKASGYPLAYIAAKLALGYRLDEVLNQVTRRTVASFEPALDYIVVKHPRWESDRFGVTEGLGPEMMSIGEAMGIGRTLEEAWQKAVRMIDIGEPGLVGGPMFQSLTLEEALKCIKDYVPYWPICAAKAIYLGVSVEEIYKINKVDKFFLNAIKRIVDVYKRLEAGEVDLDEAKVLGFSDWQIAKALGKSVDEIRAMRRRPVVKKIDTLAGEWPADTNYLYLTYGGQYDDKTPGVDYLVVGAGVFRIGVSVEFDWSTVTLATELKNRGYRVAILNYNPETVSTDWDIVDKLYFDEISVERVLDIVEKEGNGVTVVLYAGGQIGQRLYVPLEKVGVKIGGTRAKSIDMAEDRGKFSKLLDRLGIKQPPWLYAASVEEAVKLAEGLGFPVLLRPSYVLGGTYMAVAYNKEELINFLSKAAKVSGEYPVVISKFMPRGIEAEVDAVSDGVKIVATPIEHIEPPGVHSGDSTMVLPPRRLEEWAVKKMIDIAHTLAVELEVKGPLNVQFIVQDDVYVIEANLRVSRSMPLVSKATGVNYMSLVADVLTHGRLAVDEERITLKPSKWWVKSPQFSWARLRGAYPRLGPVMYSTGEVASNGSVFEEALLKSWLSATPNKIPSKTALIYTYDPHHEELLRQAAGLLSWRLEIYTPEQLGGKIAEMLKWRKIDIVMTAGITPEKDFHVRRTAADTNTPLVLDSTLAVELAKAFNWYYKNGKLEVAPW

SEQ ID NO: 21608 - protein, 1267 aa, Alteromonadales bacterium TW-7
MLFNGDLTTDCPIRQKIRDFYRIDENAVIDHILPLAEVGVKARSRAWERARQIVLNIRKEQDGQGGVDALLNEFSLSSEEGVVLMCLAEALLRVPDKETQEALIRDKLAKGDWSSHLGSSDSLFVNASSWGLLVTGKMVNYTDKTKDQQFGMLKKTIGRLGEPVIRKSVNFAMKIMGKQFVMGRTINEAIERAADTEQKGYVYSYDMLGEGARTSKDAKRYFDSYMNAIHSIGKAANGRGPIKSPGISVKLSAIHPRYEFTHKDRVMAEIVPKLKELALAAKQYDIGFTVDAEEADRLDISLDIIEAVFSDKDLDGWQGFGLAVQAYQKRAIFVIEWLTELATRVGRKLMVRLVKGAYWDTEIKTTQQDGLDHYPVFTRKATTDVSYKACAIKMLEARDVLYPQFATHNAYTAATILEVAKGDNTGFEFQRLHGMGESLFDQIVNAEKIQCRVYAPVGQHEDLLAYLVRRLLENGANSSFVNAIVDTSKPVETLLPDPVETLQGLRNKYNTQIKMPIDLYGEERANSKGMDLTDINVITPFKDNLDNWFNEHLIDQSQVPDGSLAVKNPANHKEIIGHVKLQSGDEMKTLLANAEAAFESWSQTPVKDRANLLRRIADILERHHDELVAICIKEAGKVAQDGIDEVREAVDFCRYYAARAEELSEDERFEARGVILCISPWNFPLAIFLGQVAAAIVTGNTVIAKPAEQTSLIALRTIELMLSVGLPEHVVQPVIARGSEVGKTIVPDERIQAVMFTGSTETGTLISQTLAARNDIQVPLIAETGGQNCMIVDSTALPEQVVDDVISSGFQSAGQRCSALRVLFIQEDVADGIIEMIKGALAELHIGDPSLLSTDVGPVIDEKALKNLTNHVEYLKGNATLHYECKIPDNSENGAYFFAPRLYEIKDLSVLKREVFGPCVHIIRFKANQLDDVIDQINNTGYGLTMGVHSRIEERCEYLAKMSRAGNVYVNRNMIGAIVGVQPFGGRGLSGTGPKAGGPNYLQRLVKEKASPENVQMTNLTPDELDLHHYSGANAQVEKLMANSMRDEKIWRATPLNDRVSAVRQLLAKIATVEIIDDLADDLALTLADARAQLNRLEKHMRKFTTLPGPTGESNTLHLEARGCVVCYADKSTSFNFWALSIITALAAGNTVITVASEMFYEEAEAFREKFIATGVAEGVFQVAKPNQLQAILGHPHLAGAVVAARSSRLGYFSQQLAQRKGAILPVISSEYYDTLIKRLITEKTISVDTTASGGNTSLMTLVEDDD

SEQ ID NO: 21609 - protein, 519 aa, Mycobacterium tuberculosis H37Rv
MKPYYVTTAIAYPNAAPHVGHAYEYIATDAIARFKRLDRYDVRFLTGTDEHGLKVAQAAAAAGVPTAALARRNSDVFQRMQEALNISFDRFIRTTDADHHEASKELWRRMSAAGDIYLDNYSGWYSVRDERFFVESETQLVDGTRLTVETGTPVTWTEEQTYFFRLSAYTDKLLAHYHANPDFIAPETRRNEVISFVSGGLDDLSISRTSFDWGVQVPEHPDHVMYVWVDALTNYLTGAGFPDTDSELFRRYWPADLHMIGKDIIRFHAVYWPAFLMSAGIELPRRIFAHGFLHNRGEKMSKSVGNIVDPVALAEALGVDQVRYFLLREVPFGQDGSYSDEAIVTRINTDLANELGNLAQRSLSMVAKNLDGRVPNPGEFADADAALLATADGLLERVRGHFDAQAMHLALEAIWLMLGDANKYFSVQQPWVLRKSESEADQARFRTTLYVTCEVVRIAALLIQPVMPESAGKILDLLGQAPNQRSFAAVGVRLTPGTALPPPTGVFPRYQPPQPPEGK

SEQ ID NO: 21610 - protein, 273 aa, Pseudomonas fluorescens PfO-1
MDRYVVFGNPIGHSKSPMIHKLFAEQTGQSLDYSTLLAPLDDFSGCATAFFQEGRGANVTVPFKEDAYRLANSLTARAERAGAVNTLSKLADGSLLGDNTDGAGLVRDLTVNGGFSLTGKRILLLGAGGAVRGALEPLLAEKPASVIIANRTVDKAELLAELFCDLGPVSASGYDWLREPVDVIINATSASLTGDVPPIAESLIEPGKTLCYDMMYGKEPTAFCRWASEHGAGVVMDGLGMLAEQAAEAFFLWRGVRPDTAPVLAELRRQLTL

SEQ ID NO: 21611 - protein, 511 aa, Cryptococcus neoformans var. neoformans B-3501A
MALVDVEEQSTAGPSHSRSSSVLAATAAESVSSSRRESRRGSKDREVGDGGRGGDDHVSFKTAEEDIELQDSATAPLLAGAAASPRLLESEERHLLEAEGHNSVSRGSILDAVTNMANSIIGAGIVGLPYAVSEAGFVMGVFLLIALAAISDWTIRLVILTSKLSGRESYTETMYHCFGPLGAMAVSFFQFSFAFGGTAAFHVIVGDTIPRVVSYIFPSFAENVFLRLFVNRQAVIIMCTLFISFPLSLHRDIVKLSKSSSFALVSMVIIIVSVLFRSVAVDPSLRGSSTDVFSIVKPGVFQAIGVISFAYACHHNSNYIYKSINVPTLDRFDMVTHISTGISLIACLLVAVCGYVVFTDKTEGNILNNFSSEDWLINIARFCFGANMSTTIPLEVFVCREVIEETFYKSKPFSKLRHVIITSSVIFIAMGLALTTCDLGVVLELAGGLSASALAFILPASAYFVMLSGPWSSRRKLPALLVASFGVIVLVLSCGLSLKKAWSGEGGKSVC

SEQ ID NO: 21612 - protein, 465 aa, Coprinopsis cinerea okayama7#130
MFARFVVPTRASAARFAATQYRFASTKSLRDTLKDIIPAKQEQLKKLKTEHGQTVVGDVKVENIIGGMRGLKAMLWDASVLDPIEGIRFHGLSIPDCQKVLPPAPGGKEIIPESMLWLLLTGQVPTSEQTRQLSRELAEKGDLPKFVEQLVDELPKTLHPMTQLGIGVAALNHDSAFQAAYEKGMKKTEYWAPTLEDCLNLIARLPALAARIYRNVYKPGTELPAINKDLDLVGNYTNMLGYGSNQNLTEYLRLYIALHGDHEGGNASAHTAHLVGSTLSDPYLSYSAALFALAGPLHGLANQEVLRWQLAMQQELGDKITHDDIRDYLWKTLKSGQVVPGYGHGVLRNPDPRFIALQEFCQARPELKESPIVQLVNKTFEVAPDVLKEHGKTKNPYPNVDATSGCVLYHYGLTEFKYYTVIFGVSRALGALTQLVWARALGLPIERPKSLSLDALEELIKNQKQ

SEQ ID NO: 21613 - protein, 467 aa, Sphingopyxis macrogoltabida
MKEYPNLYIGGQWVSPHSDNMSTVINPSTEEVCAKIASGDKADVDAPVRAAREAFDSFWQSSRESRVKLLRDVVAGIQSRADEFAEAINQEMGAPLWWAQQAQVPAGIAHFATAADVLEKFKFVEAKGTTHLRREAIGVCGMITPWNWPLNQVACKIAAALAVGCTVVLKPAEQTPLDSILLAEVIDAAGAPPGVFNLVTGSGSVVGSALSDHPEVDMVSFTGSTRAGAMVAKAAADSIKRVSQELGGKSVNLVLPDADLQESVVRAVRSLMSNAGQTCSAGSRLLVPADRQEEAIAIAKQTAESIPVALSADADAPAIGPISTQRQYEQVKKLIGVGIDEGATLVTGGVESPSGATKGFFVKPTIFANVNNAMAIAQEEIFGPVLVIIAYEDVDQAVQIANDSPYGLSGYVQGPHEQAVEVASSIRTGQVFINNAHADFNAPFGGFKQSGNGREWGEVGFDEFLEY

SEQ ID NO: 21614 - protein, 317 aa, Arabidopsis thaliana
  misc_feature (230)..(230): Xaa can be any naturally occurring amino acid
  unsure (1)..(317): unsure at all Xaa locations
LKQIQFVDMCDPTRDDGSSRSRVVSTMQKRAYFQRQWPLVDVVRASVVVIVHFLCLLAPFNFKWEALRFGLVLFALTTLSITFSFHRNLSHRSFKIPKWLEYPWAYSAVFALQGDPMDWVSIHRFHHQFTDSDRDPHSPKEGLLFSHILWIFDTQYIKYKCGGRDNVLDLKKQWFYKFLRRTIAVHILMFWTILYLYGGLPYLTCGGGVGIFIGYHVTWLVNSACHIWGXSRSWNTKDTSRNGFDDLVNIFRWLSLFTMGESWHNNHHAFESSARQGLEWWQIDITWYLIRLFEVLGIATDVKLPSELQKQKMALVR

SEQ ID NO: 21615 - protein, 685 aa, Coprinopsis cinerea okayama7#130
MKKIGKSLLSRKSSQDSASSKKESKQGHAAQAASAPPPPPPNTSKPLPQPVQSTQHHNNYSANSRLGQQSDRRSAPDLTQTAPPIVVVSSDPAQDRPNHAQDRHSLGLDHSSPTPPRNTTLNRLRAAPKDTIPIVGKPPRKQRSSRFVVTEKVEIERLPPFNETPPSERPGLFIRKLAQCRVLFDFNDASSELKGKQIKAQTLHEMLEYITTQRGVITENVYPEVVNMFATNLFRSIPPPVNPTGDAFDPEEDEPVLELAWPHLQIVYEFFLRFVESPDFNTNLAKRYIDQPFVLNLLELFDSEDPRERDFLKTTLHRIYGKFLNLRAFIRRSINNVFFQFIYETERHNGIAELLEILGSIINGFALPLKEEHKVFLTRVLIPLHKVKSLSLYHPQLAYCVVQFLEKDPTLAEDVMLGLLKYWPKVNSPKEVMFLNEVEEVLDVTDPIEFQKIQVPLFQQLARCINSQHFQVAERALLYWNNEYVVNLMSDNLSVILPIVFPALYNNSKSHWNRTIHGMVYNALKLFMEINPDLFDETLQHYKQTKFREQEHAVSQYAAWQMLREKAIRNNGGSLPEGYVEPPREPPPPPTAIDDSEILDLSMELNAASIDDMQGDLDESGIERVPMADPGLDTPIPQVGHHENIVGAEHGLHTRRKSVLPVDPSVLRDLQAHRSLDDAPILPGR

SEQ ID NO: 21616 - protein, 532 aa, Burkholderia xenovorans LB400
MRIRHVTSRQCRLSPSPPGQSLEASHMNHADMQFLDVEFPYARQYGNFIGGEWVPPVRGEYFDNVSPITGEPFTSIPRSTEEDIELALDAAHRARKAWADTAPALRANVLNRIADRMEQNLSRIAFSESIDNGKPIRETLAADIPLAIDHFRYFASCIRAQEGTLSEIDHDTVAYHFHEPLGVVGQIIPWNFPILMAVWKLAPALAAGNCVVLKPAEQTPASILVLIELIQDLLPPGVLNVVNGFGLEAGKPLASSKRIAKIAFTGETSTGRLIMQYASQNIIPVTLELGGKSPNIFFADVVDQDDGYFDKALEGFAMFALNQGEVCTCPSRVLIDEKIYDRFMERALKRVAAIAQGHPLDPRTMIGAQASQEQLEKILSYVDLGKQEGAECLIGGERNTLGGELSKGYYVKPTVFRGNNKMRIFQEEIFGPVVSVTTFRTEEEALEIANDSLYGLGAGVWTRDGTRAYRFGRQIQAGRVWTNCYHAYPAHAAFGGYKQSGIGRETHKMMLDHYQQTKNLLVSYSEQPLGFF

SEQ ID NO: 21617 - protein, 598 aa, Debaryomyces hansenii CBS767
MECYKDVEKSSKMKSYSNQSIMLAALELEDIDLSPEAEEAVKFLESSIEELEDQCEKLEGEYEKISQKKIRKNNLTMIEERKQELEGFSNRNKFHIEKMEMVIDFLKKDKISPDAVFAIQEDITFYLESNQEPDFIDDDTLYDELTKEASRASTNNNIDEENSQNGDISFQDQSFSNKEDVEEVSVSTPIKKSSDQFPTPSSHPRPDNLSQIHADATMTPQRAPLPVPSTPELSSPAIIKSLKPATTPSKPVGNLKWAVAAAGSAPSTSSGIGKNGDMDIKPMKEEPLFIQSQNSNVPSNKSPFESQLQLQAPSELQYPEPLLESQFSVEKKSNDPNYRFVEVLQNSSVSNTELELFSDLNLIRLPPGIQDLAISFTATRKVSTNDSKILINTNAYNPYITPIQKPFLPLAIQATFNHHLPNNTQEQRIKAPLHLLKFQSYWNRIRAENQFDQFVKEIQLLSAQNNADNVPVINELTMVLFYGYYYGFTPIENLIAESCLFKLNWKPYGSRSEIQNNLRATNHIQDKSPFDKVLFESKHYYYWFKCVRNSPTPQVYANEYVEHGDYQVFDLITWETYIKYDYRLELKLCQLEPSKTLF

SEQ ID NO: 21618 - protein, 241 aa, Glycine max
MVSVSLLLFLSFFAFFAPSESHDKVSLELYYESLCPYSANFIVNHLPKIFTPDLAPIVHLKLVPWGNAKLRANATFDCQHGPYECLLNTVEACAIHIWPQLSKHFPFIYCVEDLVFQSKREEWESCFEKLDLDSEPINQCYNSEHGKQLELQYAAETSALEPPHKYVPWVVVDGEPLYEDYENFLSYLCKAYKGTVTPQSCTQASYLREVNAKPKHSVCYKDSGIMLTWEKVRSTIASWMH

SEQ ID NO: 21619 - protein, 195 aa, Zea mays
  misc_feature (132)..(132): Xaa can be any naturally occurring amino acid
  unsure (1)..(195): unsure at all Xaa locations
MAGKKRKAEAARLEETDRALYGAFRGAANSLSQLYTLGMGAQKASFHAGERHAMEKLYEWILRQHENGLRLTVADVASHIQHEIQYGGDNASASPRSQYPSQSTAPTMHIPNTSNQQPSPSLFASGNPGVDXSKNSMVFSSALSSPIRRSLQPYHLEQDGDAGYFANGASRDVNPTASNDSSMDMHSDSPAHDSY

SEQ ID NO: 21620 - protein, 334 aa, Candidatus Desulfococcus oleovorans Hxd3
MTIRLGINGFGRIGRMVFRAAMNHPQVKVVAINDLSDAETIAHLLAFDSVHGRFGHTVKAGENSIIVDGETIPVFAVKDPAKLGWRDVNAGIVAECTGIFRDRDGASKHLEAGARKVIISAPAKEPDITIVMGVNSTSYDPRKHHIISNASCTTNCLAPVAKVIHEKFGIQAGLMTTIHSYTGDQRLLDFPHKDLRRARAAALSMIPTTTGAAKAVALVLPELAGKMTGLAIRVPTPNVSIVDFVATVNASGVTASDVNAALKAASENELAGILGYSDLPLVSSDFNGSALSSIVDALTTDVMGNMVKVLSWYDNETGYSTRMVDLAAMIGESL

SEQ ID NO: 21621 - protein, 466 aa, Shigella flexneri 2a str. 301
MSSVGGEPWGFSKTCFLLLIRCRLVNLNLFNLVYKSIMTTDDLAFDQRHIWHPYTSMTSPLPVYPVASAEGCELILSDGRRLVDGMSSWWAAIHGYNHPQLNAAMKTQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKMCDREGILLIADEIATGFGRTGKLFACEYAEIAPDILCLGKALTGGTMTLSATLTTREVAETISNGEAGCFMHGPTFMGNPLACAAANASLAIIESGEWQQQVAAIEVQLREQLAPARDAEMVADVRVLGAIGVVETTRPVNMAALQKFFVEQGVWIRPFGKLIYLMPPYIILPQQLQRLTAAVNRAVQDETFFCQ

SEQ ID NO: 21622 - protein, 178 aa, Bacteroides fragilis YCH46
MIMSKEKLIKSIREIPDFPIPGILFYDVTTLFKDSERLQELSDIMYEMYKDKGITKVVGIESRGFIMGPILATRLGAGFIPIRKPGKLPAETMEESYDKEYGKDTVQIHKDALNENDVVLLHDDLLATGGTMKAACNLVKKLYPKKVYVNFIIELKELNGKQVFENDQDVDIQSVLSL

SEQ ID NO: 21623 - protein, 251 aa, Candidatus Desulfococcus oleovorans Hxd3
MTARTPLIAGNWKMHKTGDEAGDTAADLARRIAGVTGREVMIAPPFTALAAVKIAIAGSIIGLGGQNLHWESSGAFTGEISGPMLTAAGCTHVIIGHSERRQFFGETDETVNKKIQAARAANLVPVMCIGETEAQREAEQTFSVLDKQIRNGLQGFALQDISDLVLAYEPVWAIGTGKTASREQAQEAHAFIRSVVEKLFGGPAAAAMRILYGGSVKPSNIADLMAMDDIDGALVGGASLEAATFADIVTY

SEQ ID NO: 21624 - protein, 558 aa, Onion yellows phytoplasma OY-M
MCSIFGILNIKTDPQILRDQALKLSSLMRHRGPDWSRIFASQKAILAHERLSIIDVNAGAQPLYNKTKTLILAINGEIYNHLDLRKQYKDKYEFQKESDCEVILALYQEKGVNFLDELQGMFAFILYDLTKNTYLIGRDHMGIIPLYMGYYLNQNFYIASEMKALIPICQTLSIFPPGNYLYSESGKMVKYYKRNWMDYQNVYNNQTNTNQLRNFLEASVKKILMSDVPYGVLLSGGLDSSIISGITKKFAKHRIEESSKKEVCFPSLHSFAVGLKGAPDLKAAKEVDNHLGTAHHEINFTIQEGIDALKDVIYHIETYDITTIRASIPMYLMARKIKAMGIKMILSGEGADEIFGGYLYFHKAPNAQEFHKETVRKLASLHLYDCSRANKAMSAWGVEARVPFLDKNFLDVAMRLNPKDKMCGTNGKIEKHILRQTFESYLPKKIVWRQKEQFSDGVGYSWIDALKQLAQTKITDTQLKNAYVRFPYNTPTNKEGYMYREIFEILFPLPSAISLFPGGPSIACCTAKAIEWDKAFKQINDPSGRAALGVHNEAYKDK

SEQ ID NO: 21625 - protein, 585 aa, Castilleja sulphurea
PYEVPMTAAGALQSYKLAAKAITRLQALPSGSMEQLCDTMVQEVFELTGYDRVMIYKFHDDDHGEVLSEVTKPGLDPYVGLHYPATDIPQAARFLFLKNKVRMICDCRANHVKVIQDDNLPFDLTLCGSILRAPHSCHLQYMENMNSIASLVMSVVVNEGNEDGPDSSSHPDKKKRLWGLVVCHNTSPRFVPFPLRYACEFLAQVFAIHVNKEIELENQMLEKNIIRTQTLLCDMLLRDAPLGIVSQSPNVMDFVKGDGAILLYRTKNYRLRKTPSDYQIRDIVSWLDEYHHESTGLSTDSLYDAGFPGALALGDAVCGMAAVRITNTDWLFWFRSHTAAEIRWGGGKHEPGEKDDGRKMHPRLSFKAFLEVVKTRSLPWKDFEMDAIHSLQLILRNASNKEVEEMDVDGKEIHARLNDLQLDGIKELEAVTSEMVRLIETASVPIFAVDMDGLVNGWNTKIADLTGLPVDKAIGRHFLGLVEYSSAEVVNKMLELALQGNEEQNVQFEIKTYGPRSESAPISLIMNACASWDVKENVVGVCFIAQDITIQKSMMDKFTRIEGDYRAIVQNPNQLIPPIFGTDGF

SEQ ID NO: 21626 - protein, 457 aa, Castilleja sulphurea
SGKPFYAIIHRVTGSMIIDFEPVKPHEVPMTAAGALQSYKLAAKAITRLQALPNGSMERLCDTMVQEVFELTGYDRVMIYKFHDDDHGEVLSEITKPGLDPYVGLHYPATDIPQAARFLFIKNKVRMICDCRANHVKVIQDDNLPFDLTLCGSNLRAPHSCHLQYMENMNSIASLVMSVVVNEGNEDGPNSSSHPDKKKQLWGLVVCHNTSPRFVPFPLRYACEFLAQVFAIHVNKEIELENQMLEKNILRTQTLLCDMLLRDAPLGIVSQSPNVMDLVKCDGAVLIHKTKKYRLGMTPSDFQIRDVVSWLDEYHRDSTGLSTDSLYDAGFPGALALGDAVCGMAAVRITDTDWLFWFRSHTASEIRWGGAKHEPDDKDDGRKMHPRSSFKAFLDVVRTRSLPWKDFEMDAIHSLQLILRNSSNKEAEKRDVEGKEIHARLNDLQLDGKKELEAVTS

SEQ ID NO: 21627 - protein, 500 aa, Thermus thermophilus
MEKVFYVTTPIYYVNAEPHLGHAYTTVVADFLARWHRLDGYRTFFLTGTDEHGETVYRAAQAAGEDPKAFVDRVSGRFKRAWDLLGIAYDDFIRTTEERHKKVVQLVLKKVYEAGDIYYGEYEGLYCVSCERFYTEKELVEGLCPIHGRPVERRKEGNYFFRMEKYRPWLQEYIQENPDLIRPEGYRNEVLAMLAEPIGDLSISRPKSRVPWGIPLPWDENHVTFVWFDALLNYVSALDYPEGEAYRTFWPHAWHLIGKDILKPHAVFWPTMLKAAGIPMYRHLNVGGFLLGPDGRKMSKTLGNVVDPFALLEKYGRDALRYYLLREIPYGQDTPVSEEALRTRYEADLADDLGNLVQRTRAMLFRFAEGRIPEPVAGEELAEGTGLAGRLRPLVRELKFHVALEEAMAYVKALNRYINEKKPWELFKKEPEEARAVLYRVVEGLRIASILLTPAMPDKMAELRRALGLKEEVRLEEAERWGLAEPRPIPEEAPVLFPKK

SEQ ID NO: 21628 - protein, 324 aa, Onion yellows phytoplasma OY-M
MASMTLLDAINQTLDSKLAKDPRVVLFGQDVGKLGGVFRVTKGLQDKHGETRVFNAPIAESSIIGSAIGLAINGMRPVAEIQFDGFIFVGLEDLFAHAARLRNRSRGNYTVPMVVRVPVGGGVKSLEHHSESLEVILGSVPGLKVVIPSNPYDAKGLLMAAINDPDPVVYMEPKRIYRGFRQEVPETDYEVQIGKAKVVQEGTDITVVAWGAMVPETLLALKQLDPNVSVELIDLRTINPIDRETVITSVKKTGRFLVVHEACKTYGPAGELMALVNEQAFLYLDAAPARVTGNDITMPLAKAEHYQFLSPEKIADAIKKVVCE

SEQ ID NO: 21629 - protein, 394 aa, Onion yellows phytoplasma OY-M
MGDQVKEGDVLVKVETDKLDVELTSPVAGKILKRDLNEGEVICVGDTIVLIQEPGDTDADVKKFSSQNPNETAATEKNDTQQAQTSAQTSLPPQKVLATPLVKSLAKELGLDLSTIKGTGVNGKILKVDVQNATNPLQTQPQPTTPFVQEEQIPTPTFATSSQETEVVKISRLRKAIAQKMVLSKGKIPETTLMDEVNITALVTLRKQAKDQAQSQGIKLTFMAFIMKAVAIALQEFPLFNASYDDVKEEVTYKKFINLGVAVDTKDGLIVPNIKDANKLTLLEMAQQLQQVAKATTERKVELNQLQNGTFTITNFGSIDITYGTPVINYPELAILGVGKITKKPVVENSQIVIADMLPLSLAIDHRIIDGADGGRFLKRVKELLNTPTLLLLS

SEQ ID NO: 21630 - protein, 308 aa, Yersinia pestis CO92
MTKKADYIWFNGEMVPWAEAKVHVMSHALHYGTSVFEGVRCYESHKGPVVFRHREHMQRLHDSAKIYRMPVSQSVDELMEACRATLRKNNLTSAYIRPLVFIGDVGMGVNPPEGYNTDVIIAAFPWGAYLGAEALEQGIDAMVSSWNRVAPNTIPTAAKAGGNYLSSLLVGSEARRHGYQEGIALDVHGYLSEGAGENLFEVKDGILFTPPFTSSALPGITRDAIIKLAKDMGLEVREQVLSRESLYLADEVFMSGTAAEITPVRSVDGIQVGIGKRGPVTAKIQQAFFGLFTGETEDKWGWLDQVNP

SEQ ID NO: 21631 - protein, 1497 aa, Ashbya gossypii ATCC 10895
MEFFNANLTANRASHVSAGASTSIGEADRPYVGLAEDLEEQEVIRSLAQTLSRSSAAEYELQPTSADPSALFGPDKDARLDPESDEFDPRYWVRTIRNLYASDPDHYKPAELCVVIQNLRVCGVSADTDYQATVGNSPLKALRMLYQMTPFARGREKSEFDILKPLDVVFEPGRLCVVLGRPGAGCSTLLKTVGARTYGFTVAPESEISYSGFSQKEIKNHLRGEVIYSAESDTHFASLPVGYTLEFAARCRCPQVRPGGVKREVFYKHYAAAVMAMYGLSHTRYTKVGNDYIRGVSGGERKRVSLAEVTLAGAKLQCWDNCTRGLDSATALEFVRALRDNAEVMRTTQLIAIYQCSEAAYSLFDDVLVLYEGYMIYFGPRKLAKGYFLRMGWECPPRQTSADFLTSVTSPFERKSQPGYEDKVPRTAREFYEYWLRSPEHAVAMKQIQRRIAEAKTDAAREQLRDHHIVRQARHVKSSSPYLISFYMQFRAIVDRNWQRLRGDPSVYLFSIVAYSIMGLILASCFLNLKPDTNSLFNRGSALFTAVLLNSFFSFLEIMSLFEARAIVKKHKSYAFYRPSADAFASIFTELPAKFTVCICFNVPFYFMVNLRRSTGAFFFYMLVSLTATFAMSHLFRSVGAACKTLYVTMFPASLLLLGLAVYVGFVIPQKNILGWSRWLFYLNPIARIMEAMVANEFDGRIFECSRMVPDGSFYEGFPISNKVCLSVGAVPGQSFVNGTRYIEFAYGYNTKNKWMNWGIVLAYAFFFLGVYLILIEYNKSGMQKGEMAVFLRSTLKKIKKQNKKAINCDIEFGNAPGKESSTIGSDQSRELIQRIGSDSIFHWRDVCYDIQIKNETRRILTNVDGWVKPGTLTALMGYSGAGKTTLLDVLANRVRVGVVTGNIFVDGHLRDTSFQRKTGYCQQQDLHGRTQTVRDALKFSAYLRQPQSISRAEKNAYVEDIIKLLGMEAYADAVVGVTGEGLNVEQRKRLTIGVELVAKPELLLFLDEPTSGLDSQTAWSICQLIKKLVNHGQAILCTIHQPSAILMQEFDRLLLLSNGGRTVYFGPLGEGCSTMIQYFENHGSQKFPEACNPAEFMLEIIGAAPGSHALQDYHEIWKNSDEYQSVQEELHRMEMELWHKPRFETSDQNKEFASSIWYQYIIVSRRVLQQYWRSPEYLWSKIFMSIFASLFIGFSFFKSKTSIQGLQNQMFAVFLFLVVLTPLVQQMLPQYVEQRDLFEVRERHSKTFSWKVFLLSQITAEIPWAILGATISFFCFYYPVGFYTHATDAANRAERGFLFWSLCVAFYIFSATFGQFCIAGLEKAEPAAILANFYFTMCLIFSGVLVTKDNLPRFWIWMYYLSPVTYLVSALLSTGSGNMTVECAPEELIKFAPPKGLFCALYLEPFANNAESVLLNPAATDLCTVCPIKNSDYYLALVNIFYNHRWRDWGIFTIFVATNIIGFAATYWFFRVPKSTHITIKTKANVKEQEQEQEHQ

SEQ ID NO: 21632 - protein, 615 aa, Chelone obliqua
SGKPFYAIIHRVTGSLIIDFEPVKPHEVPMTAAGALQSYKLAAKAITRLQSLPSGSMERLCDTMVQEAFELTGYDRVMIYKFHDDDHGEVFSEVTKPGLEPYVGLHYPATDIPQAARFLFMKNKVRMICDCRAKHVKVVQDEKLSFDLTLCGSTLRAPHSCHLQYMENMNSIASLVMSVVVNEGDEDGSESVHPQKRKRLWGLVVCHNTSPRFIPFPLRYACEFLAQVFAIHVNKELELENQMLEKNILRTQTLLCDMLLRDAPLGIVSQSPNVMDLVKCDGAALMYKNKKYKMGLTPTDFQIRDIVSWLDEYHRDSTGLSTDSLYDAGFPGALALGDAICGMAAVKISERDWLFWFRSHTAAEIRWGGAKHEQGEKDDGRKMHPRSSFKAFLEVVKTRSLPWKDYEMDAIHSLQLILRNAFKDGENADSDTKAIHTRLTDLRIDGMQELEAVTSEMVRLIETASVPILAVDVDGHVNGWNSKIADLTGLPVDEAIGKQFLELVEDSSTDTVSKMLKLALEGKEEQNVQFEVKTHGERSDSGPVTLVVNACASKDVEENVVGVCFIAQDITAHKNMMDKFTRIEGDYKAIVQNPNPLIPPIFGTDEFGWCSEWNN

SEQ ID NO: 21633 - protein, 457 aa, Onion yellows phytoplasma OY-M
MKNYDVLVIGGGPGGYVAAIKAAQMGAKVALVEKHKLGGICLNYGCIPTKAYLKSAKMYKDIKRCADFGIKVQNGVSFDWSSILSRKNKIVAQLTTGISFLLKKNKIDFYHGFASVLSPCEVQVDTNLLHTQKLIIATGSTAFVTPIPGAQEAYQKGILKTSKELLQLESYPSKVTIVGGGVIGVEFATIFNSFGSEVTILERQDNILNGMDRDVVVAYTKKLQADGIQILTQVEVTKINDNQTTYTQKGNAKTITSDVILMAVGTKANLAGLEKLNLALNRNSVQTDNFCQTSIPGVYAIGDVNGKHMLAHVASHEGIVAVTHALEQKAQPINYDRVPACIYGFPEIASIGMTEQQAKEKQMDYKVSKISLGAVGKSLADGEKEGFAKLIVCKKHLEILGMHIYAYNATELISEMAVGMELEGTAYELSQAIHPHPTLSELTFEALLGAVDKPIHA

SEQ ID NO: 21634 - protein, 605 aa, Conopholis alpina
SGKPFYAIIHRVTGSLIIDFEPVKPHEVPMTAAGALQSYKLAAKAITRLQALRGGSMERLCDTMVQEVFELTGYDRVMIYKFHDDDHGEVSTEITKPGLEPYVGLHYPATDIPQAARFLFMKNKVRMICDCRASHVKVVQDENLPFDLTLCGSTLRAPHRCHLLYMENMNSIASLVMSVVINEGNEDGASSSSGPDKRKTLWGLLVCHNTSPRFVPFPLRYACEFLVQVFAIHVNKELELENQMLEKNILRTQTLLCDLLLRDAPLGIVSQSPNVMDLVKCIGAVLLYKNTKYRLGLTPSDFQIRDIVSWLDEYHWDSTGLSTDSLYDAGFPGALALGDALCGMAAVRITDRDWLFWFRSHTAAEIQWGGMKHEPDEKDDGSKMHPRSSFKAFLEVVKTRSLPWKDYEMDAIHSLQLILRNAFKESEGRDLEIHARLNELQIGGVREIEAVATEMVRLIETASVPIFAVDVDGLVNGWNTKIADLTGLCVNKAMGSHFLALVEDSSADTVSKMLELALQGKEEQNVQFEIKTHGQNSESGPITLMVNACASRDVKENVVGVCFIAQDITTQKSMMDKFTRIEGDYRAIVQNPNPLIPPIFGTDEF

SEQ ID NO: 21635 - protein, 211 aa, Prototheca wickerhamii
LKCCSQVPGASTSPHSSTCLADEMGGSTQYERHLCASSITMTSLPLASSAGRVCEPTLVASAPSWDWKFWKTGRDGLKPFLGPDASGRGTGKVALPFKPGQGKCSSGPGIRLSNSGLRLPRLAMGGGSGHGAGAYSFFMIQAPRLWPVSWRIPPKKGSAGEDKQRILILMSDTGGGHRASAQALHSGFQELYGDKYKIDVLDIWTNYTPWP

SEQ ID NO: 21636 - protein, 436 aa, Clostridium perfringens SM101
MNYTTQMDAAKKGIITKEMQVVAEKEGINIETLMNLMAEGKIVIPANKNHKSISAEGVGQGLKTKINVNLGISKDCANIELELEKVKKAIDMNAESIMDLSNYGKTYDFRKRLVEVSTAMIGTVPMYDVVGFYDKELKDITVDEFFDVVEKHAKDGVDFVTIHAGLNRETIETFRRNKRLTNIVSRGGSLLFAWMELNNRENPFYEYFDRLLDICEKYDLTLSLGDACRPGSIADATDAVQIKELITLGELTKRAWERNVQVIIEGPGHMAMNEIEANVLLEKKLCHGAPFYVLGPIVTDIAPGYDHITSAIGGAMAASYGADFLCYVTPAEHLRLPNLEDVREGIVATKIAAHAADIAKGISGARDIDNKMSDARKRLDWDEMFSLAIDSEKAIRYRKESTPEHKDSCTMCGKMCSIRNMNKILEGKDINLLRED

SEQ ID NO: 21637 - protein, 858 aa, Magnaporthe grisea 70-15
MAPSSSSSSMEKPSETATLVEMVGIKNRSGDRSSKDEPKASVEVSGREVLGDTGSSRYEDDGSGITVLSRDKPPVDDIKERLSMWGESSSRTPYGDEYEGDEGSEYELLLDPNLPDDYSTAATNRSDPERSSADKEISTEEDSPYPEVRAAVRNYDEDLPCNTVRAWTIGLFLVVIGASMNTLFSLRSPSISLSSLIAQIIAWPLGHGWAKVMPKRKFSFFGIPWSLNPGPFNIKEHTIIVVMAGVSFSVAYATDIILAQVVFYKQDFGIAWQLMLMISTQSLGYGIAGMMRKFLVYPASMIWPANLVGVTLMNAMYEKPPPNDPTIIGGSMPRYRWFGIITLCSFVYYFIPGFLAQFLSIFAFATWIAPQNPVVNQLFGGLTGLSLIPITFDWSQIVGFVGSPMIPPWYAIANTLIGVVLFFIILASGLHYTNTWYADFLPISDSSTYDNTGSPYNVTRVITKDFTLSEEAYKAYSPLFLSTTFALTYGLSFAAIASLIVYTYLHHRKTIWLQYKNATNEAEDIHMKLMRKYVEAPTWWYMILFAIMLVIGFVTVLAYPTNMSWWSFLLAVAISFAFSLPIGIIQAVTNNQIGLNVLTEFVYGYIQPGRPLALMIFKTFGYITMSQALGFVGDLKFGHYMKIPPRTMFMCQVVATTFSCFIQIAVLNFALKHIDGVCTPTQAERFTCPGGKVFFSASVIWGLIGPARMFSPGQIYSSLMIFFGIGAVVPVMIYFYVRKWPKSPARFLMSPLIFGGSAAIPPASPLNYLTWGIVGFVFQYLIKKRHFNWWSRLNFLTSSGLDLGLGLATLVIFFAFTLNNINPPKWWGNDIVQTTMDFTDTAVRKHVAEGQIFGPRTW

SEQ ID NO: 21638 - protein, 416 aa, Saccharomyces cerevisiae
  misc_feature (1)..(1): Xaa can be any naturally occurring amino acid
  unsure (1)..(416): unsure at all Xaa locations
XSKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKKSLSSKLSVQDLDLKDKRVFIRVDFNVPLDGKKITSNQRIVAALPTIKYVLEHHPRYVVLASHLGRPNGERN

SEQ ID NO: 21639 - protein, 133 aa, Aeropyrum pernix K1
MSGEVKREVFVETAPKPVGPYSQAVESGCFMFVSGQIPINPETGALEEGGFKESAKRALDNLKAIVEGAGYSMDDIVKVTVYITDISRFSEFNEVYREYFNRPYPARAVVGVAALPLGAPLEVEAVLYTCRRK

SEQ ID NO: 21640 - protein, 575 aa, Coprinopsis cinerea okayama7#130
MCGIFAAHGLEKPSQDRARCIALAKRLRHRGPDWSGCYVGQQSVLVHERLAIVGVESGAQPLVSEDGKQILAVNGEIYNHVALREHVGRDIKFKTNSDCEVVLPLYKKYGTELCGMLDGMFSFVLLDESVTPSRIIAARDPIGITTLYQGWSSQRPGAVFFASELKALVDDCDEIISFPPGHVYDSADKTTTRYYKPSWWNGDLDGPEATIPTTKADLTLIRETLEAAVRKRLMSEVPYGVLLSGGLDSSLIAAVAARETEKVAKAQYELRQRKLQEASSGPPSPSGSGLVTEEATLAAWPQLHSFSIGLENSPDLLAARKAAHFLGTVHHEYVFTVQEGLDALPEVIYHLETYDVTTVRASTPMYLLSRKIKAMGVKMVLSGEGSDEIFGGYLYFHAAPDARSTMAWGLEARVPFLDKAFLDVAMNVDPKEKMFSKGSTQEVDEDGCPRMEKYILRKAFDCSPDGKPYLPRSILWRQKEQFSDGVGYSWIDGMKQHAEDTITDEQFAKGAERWPEDTPATKEAYLIRQIFDDLFPSPAAAKTAVRWIPRGDWGCSSDPSGRSVSIHNAAYSVDD

SEQ ID NO: 21641 - protein, 716 aa, Debaryomyces hansenii CBS767
MGHYITLATCNLNQWALDFEGNRDRIITSIIEAKKLGATLRVGPELEICGYGCLDHFLENDLYDHSWEMYGHILTNPNTQDILLDVGMPIIHKSIKYNCRLLSYNGKILLIRPKLYLANDGNYREMRYFTPWNRPKYYESFQLPKNISSVTGQSNVTFGDCVIQTLETTLGAETCEELFTPQSPHISMALDGVEIFTNSSGSHHELRKLDTRLQLITGATKKCGGVYLYANQKGCDGDRLYYDGCACIIVNGKVVAQASQFSLRDVEVVSATIDLDDVRSYRNQKLSAFQSVSQSDSTVYHHIPTDIELSPNSNVFNPNVKPSPYRDIRYHLPEEEIALGPACWLWDYLRRSKCAGYFLPLSGGIDSCATAVIVHLMCRLVVKSCEEGDKQVISDIQSLTHDPEFVPKTPQEVAGRLFYTSFMGTENSSKETRSRAKELSEKVGSHHIDMNMDSLVSAVVSVFEVATGKKPIFKIFGGSQTENLALQNIQARLRMVLSYLFAQLLPWTRNISGGLLVLGSANVDECLRGYLTKYDCSSADINPIGGISKTDLKRFIDWADKNFELPILHDFLTATPTAELEPITQNYVQSDEVDMGMTYDELSRFGRLRKVDKCGPMAMFIKLYHEWSQPPLNLTAEQVAEKVKRFWFFYAINRHKMTTMTPSYHAEQYSPDDNRFDLRPFLINPRFPWASKKIDEAVDIINQRTEEIKRANLSVD

SEQ ID NO: 21642 - protein, 604 aa, Conopholis americana
SGKPFYAIIHRVTGSLIIDFEPVKPHEVPMTAAGALQSYKLAAKAITRLQALRGGSMERLCDTMVQEVFELTGYDRVMIYKFHDDDHGEVSTEITKPGLEPYVGLHYPATDIPQAARFLFMKNKVRMICDCRASHVKVVQDENLLFDLTLCGSTLRAPHRCHLLYMENMNSIASLVMSVVINEGNEDGASSSSGPDKRKTLWGLLVCHNTSPRFVPFPLRYACEFLVQVFAIHVNKELELENQMLEKNILRTQTLLCDLLLRDAPLGIVSQSPNVMDLVKCIGAVLLYKNTKYRLGLTPSDFQIRDIVSWLDEYHWDSTGLSTDSLYDAGFPGALALGDALCGMAAVRITDRDWLFWFRSHTAAETQGGMKHEPDEKDDGSKMHPRSSFKAFLEVVKTRSLPWKDYEMDAIHSLQLILRNAFKESEGRDLEIHARLNELQIGGVREIEAVATEMVRLIETASVPIFAVDVDGLVNGWNTKIADLTGLCVNKAMGSHFLALVEDSSADTVSKMLELALQGKEEQNVQFEIKTHGQNSESGPITLMVNACASRDVKENVVGVCFIAQDITTQKSMMDKFTRIEGDYRAIVQNPNPLIPPIFGTDEF

SEQ ID NO: 21643 - protein, 365 aa, Oceanicola granulosus HTCC2516
MANPSLLILPGDGIGPEVMAEVRKVIDWFGSQGTPFDVSEDLVGGAAYDAHGTPLTDATMAKAQEVDAVLLGAVGGPKYDDLDFSVKPERGLLRLRKEMDLFANLRPAQCFDALADFSSLKKDVVAGLDIMIVRELTSGVYFGEPRGIVTENNERVGINTQRYTESEIERVARSAFELARKRGNKLCSMEKANVMESGILWREVVQRVGDEEYPDVELSHMYADAGAMQLTRWPKQFDVIVTDNLFGDLLSDLAAMLTGSLGMLPSASLGLPMANGRPKAMYEPVHGSAPDIAGQGKANPIACILSFAMALRYSFDMGEAADRVEAAVEKVLADGLRTADLLGEEGRAPVSTSDMGDAIVAALAD

SEQ ID NO: 21644 - protein, 209 aa, Xanthobacter autotrophicus Py2
MDETLNDLAAHVSAALSGAVLGSLVAHGELTLQIDPAQIVKVATFLRDDPACLFHCIVDVCGVDYPAREKRFDVVYHLLSLKQNVRIRLKVETDEDTPVPSICSVFPGANWFEREAYDMYGILFTGHPELRRLLTDYGFDGHPLRKDFPTTGFVEVRYDDEQKRVVYEPVRLPQEFRNFDFLSPWEGVEYVLPGDEKASGQPPVPPKAG

SEQ ID NO: 21645 - protein, 402 aa, Xanthobacter autotrophicus Py2
MVDIADEMKPADKVRNFQINFGPQHPAAHGVLRLVLELDGEVVERVDPHIGLLHRGTEKLIEAKTYLQAVPYFDRLDYCAPMNQEHAFCLAAEKLLGIEVPKRGQLIRVLYSEIGRLLSHLLNVTTFAMDVGALTPPLWGFEEREKLMIFYERASGSRMHAAYFRPGGVHQDLPRALVEDIGAFCDPFLKLLDDLDGLVTENRIFKQRTVDIGVVSLEDALAWGFSGVMVRGSGAAWDLRRAQPYECYSELDFDIPIGKHGDCYDRYVVRMEEMRQSTKIMKQCVERLLKEAGPVSTTDNKIVPPKRGEMKRSMEALIHHFKLYTEGFHVPAGDVYAAVEAPKGEFGVYLVSDGTNKPYRCKIRAPGFAHLQAMDFLCRGHMLADVSAVLGSLDIVFGEVDR

SEQ ID NO: 21646 - protein, 484 aa, Ralstonia eutropha JMP134
MFSLKDPGLLRQQAYVDGQWRAAESGKTLDVINPANNEPLGTIPACDAADTRAAIEAANRALPAWSALTTHQRAAVLRKWRELMVAHADDLALIMTLEQGKPLAEARGEILYGASFVEWFAEEGIRAYGETIPATHASRRIIARKVPVGVCAAITPWNFPNAMITRKLAPALAAGCAVVVKPSELTPYSALALAELGERAGIPAGVLNIVTGMPQGIGGELTANPIVRKLTFTGSTQVGKLLLRQCADTVKRVSMELGGNAPVIVFDDADLEQAVAGVMASKFRNSGQTCVCANRIYVQAGIYDRFSARLSEEVRKLKVGAGTEDGVSIGPLINDAALRKVVRHVEDAVAHGAKVIVGGASLSRGQQYFEPTVVTGATDGMLIASEETFGPVAALFPFESETEIIRRANDTPYGLAAYLFSTDVNRVFRVSEALEYGMVGANTGVISSAVAPFGGVKESGLGREGSHHGIDEFLEVQTLHLEIV

SEQ ID NO: 21647 - protein, 375 aa, Sinorhizobium meliloti 1021
MDARAAVAIQAGKPLEVMTVQLEGPRAGEVLVEVKATGICHTDDFTLSGADPEGLFPAILGHEGAGIVIDVGPGVTSVKKGDHVIPLYTPECRACPSCLSRKTNLCTAIRATQGQGVMPDGTSRFSLNGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTRVMRQALEASHRGWGKSVIIGVAGAGQEIATRPFQLVTGRTWMGTAFGGARGRTDVPKIVDWYMEGKIAIDPMITHTMPLDDINKGFELMHSGESIRSVVLF

SEQ ID NO: 21648 - protein, 162 aa, Xanthobacter autotrophicus Py2
MKLDQAARGLFLTELVSGFFLAMRYFFKPKATLNYPFEKGPLSPRFRGEHALRRYPNGEERCIACKLCEAICPAQAITIEAGPRRNDGTRRTTRYDIDMVKCIYCGFCQEACPVDAIVEGPNFEFAAETREELYYDKEKLLANGDRWEREIARSIAMDAPYR

SEQ ID NO: 21649 - protein, 429 aa, Ralstonia eutropha JMP134
MALESTHQDLAAARAQHVARGVVTAHPIFVDHAQGSRVWDVNGRSYLDFVGGIGVLNVGHNHPRVVAAVKQQLERVSHAAFQVAGYDVYIELAARLNRLVGGSEAYKTVFLTTGAEAVENAVKIARAYRNAPGIIAFRGGFHGRTLLGMTLTGMSTPYKQNFGPFAGDVYHTPYPDPYRGFSGDDALRALDDLFATQIAPDRVAAIILELVQGDGGFLAAGSDFLKKLRALTTKHGIVLIADEIQTGFGRTGELFAFQEAGIQPDLVTVAKSLAGGLPLSGVVGRAEIMDAPLPGGLGGTYAGNPLACAAALAVLDLFEDEKLTERARELGTTLRGGLLALADKYQEIGTIRGVGPMLALEFVKHGDPHQPDADFAQRVVDACRDEGLLVIKCGVHRNNVRLLAPVNTELDDAHEAIAILGRAIAKVRG

SEQ ID NO: 21650 - protein, 429 aa, Mycobacterium tuberculosis H37Rv
MPIIEQVRAREILDSRGNPTVEVEVALIDGTFARAAVPSGASTGEHEAVELRDGGDRYGGKGVQKAVQAVLDEIGPAVIGLNADDQRLVDQALVDLDGTPDKSRLGGNAILGVSLAVAKAAADSAELPLFRYVGGPNAHILPVPMMNILNGGAHADTAVDIQEFMVAPIGAPSFVEALRWGAEVYHALKSVLKKEGLSTGLGDEGGFAPDVAGTTAALDLISRAIESAGLRPGADVALALDAAATEFFTDGTGYVFEGTTRTADQMTEFYAGLLGAYPLVSIEDPLSEDDWDGWAALTASIGDRVQIVGDDIFVTNPERLEEGIERGVANALLVKVNQIGTLTETLDAVTLAHHGGYRTMISHRSGETEDTMIADLAVAIGSGQIKTGAPARSERVAKYNQLLRIEEALGDAARYAGDLAFPRFACETK

SEQ ID NO: 21651 - protein, 478 aa, Xanthobacter autotrophicus Py2
MTSAPLSNSTAHWRALDAAHHLHPFSDTKALNAEGVRVITRAEGVYVFDSEGNRILDGMSGLWCSQVGHGRRAIVDAIAQQLHQLDYYNTFFKTTHPGAAELAAAISDVAPAHMNHVFFTSGGSEAVDTVLRMVRHYWAALGKPEKSIFISRRNGYHGSTLGGASLGGMKPMHAQGGLPIPGIIHVAQPYWWAEGGEMGREEFGLFAAREVARAIDEAGPENVAAFIGEPIQGAGGVIIPPANYWPEVEKICRERDVLLVCDEVICGFGRTGRWFGADFMGVKPDLITFAKGITSGYFPLGGVIVGDKVAEGFIEHGGDFNHGFTYSGHPGGCAAALANLRIMHEEKLVERVRTDIGPYLQERWLKLAEHPLVGEARMVGLIGALELTPEKASRAAFAAEEGTVGLICRDFSFREGLVMRAVRDGMILAPPFTLSHEEADELVAITWRVLDLTYAELHKRGMMVPVPRVPARPVQASA

SEQ ID NO: 21652 - protein, 493 aa, Xanthobacter autotrophicus Py2
MAAAERTADHYPSFRTQALIDGVFAPAASGRTFDAVNPATGKVLAQVAACDSADVDRAVKAARAAFEDRRWAGLRPVERKRILQRFAELIRAHRDELALTETLNMGKPIADARSIDVRAAADCFAYYGECCDKVYGEVAPTTADNLALVLREPLGVVGCVTPWNFPMIMAAWKVAPALAMGNSVVLKPAEESPLTALRLGELALEAGVPAGVFNVVPGLGVEAGKALGLHMDVDAIAFTGSTEVGRYFLRYSSDSNLKRVFLELGGKTAFVVAHDVPDLDEVAQAVASGIFFNQGEMCTAASRLLVDNRIREDLVARVAALAPRWMPGDPQDPAARAGAVVSFEHQGRILSAIEEGVASGALLVTGGTAVRQETGGAFVAPTVFDGVVPSSALAQKEIFGPVLSVIGFDGLEEAVAIANGTVYGLGAAVWSGDLSAAHKVARRFKAGIVYVNCFDADDITTPFGGVKQSGFGRDKSLHALDKYCDLKTVWTRL

SEQ ID NO: 21653 - protein, 495 aa, Aspergillus nidulans FGSC A4
MLGTAVPSEPVYQSSSRQPAQSSSNLETGSSISTSSNTTPTFPAPPSASAAGSSRFSTQDVPAYIRASSHPSSRSSESSTVTPGPTPIPTSAQMNPPSVVPSGQGGQTGTAPPGFGGRHTASHSSPASPQLRPTLRSLRSLGGSEASSPSRIKIRDLSHIQSFASEEFLAPPQRTRASGHWAQERQFEISSMPVTDIIEMVAGLLTKITTTNDSHHEQVHRQIPSVDGSSNLSQQAHSVLAFHGKNVPSISILSYLTRIHKYCPTTYEVFLSLLVYFDRMTEMVNKGQLDRLRGRYNRTDALQSDVAFRPRSSESSITQRSHTSPMVTPPPSAGITAQDSASTSPVSPAMNPLQGEDYLSHFFVVDSFNIHRLVIAGVTCASKFFSDVFYTNSRYAKVGGLPLAELNHLELQFLLLNDFRLSIPVEELEAYGTMLVEFYAREIVAQQQQQQQQQQQQQQHSQSQAGPMARESESDAMYMRRQPAHPEVRQTSTPP

SEQ ID NO: 21654 - protein, 167 aa, Triticum aestivum
  misc_feature (133)..(133): Xaa can be any naturally occurring amino acid
  unsure (1)..(167): unsure at all Xaa locations
APDSLLTEECDVLIPAALGGVINKDNANDIKAKYIIEAANHPTDPEADEILSKKGVLILPDILANSGGVTVSYFEWVQNIQGFMWDEEKVNAELRTYMTRAFGDVKQMCRSHSCDLRMGAFTLGVNRVARATXLKGWEHDSSVSPCALLLYLWPGPCFVICITSRKR

SEQ ID NO: 21655 - protein, 479 aa, Agrobacterium tumefaciens str. C58
MRRKEQPWFSTGAAGGGINTATPMRIETIIFDCFRQAAEKPQEISIFRHKFTLHLHAAVASICQTCLWVYAKRRAMMAKQKVAMLTAGGLAPCLSSAVGGLIERYSDIAPEIDIIAYRSGYQGVLLGERIEITKDMREKAHLLHRYGGSPIGNSRVKLTNAADCAKRGLVKEGDNPLRVAAERLAADGITILHTIGGDDTNTTAADLAAYLGANGYDLTVVGLPKTVDNDVVPIKQSLGAWTAAEVGAAFFDNVSNEQSAAPKTFVIHEVMGRHCGWLTAATARAYIQKTRGNDYVEGLMMNTQMKNIDGIYLPEMAFDIEAEAERLKEVMDKHGYVTLFVSEGAGLDAIVAEREAAGEAVKRDAFGHVKIDTINVGGWFQKQFAGLIGAERSMVQKSGYFARSAPANGDDLRLIQGMVDLAVESALNKVSGVTGHDEDQNGKLRTIEFPRIKGGKHFDLSAKWFTEVMEHVGQPFTAA

SEQ ID NO: 21656 - protein, 419 aa, Gloeobacter violaceus PCC 7421
MIREVTMPALSSTMTEGKIVTWKKQEGDAVSRSDILLVVESDKADMDVESFDEGILANILVSDGGSAPVGSVIALIAETEAEVAEAKKRPPSGTAAAPPATVPTPAPAPSAPAPVAAATTPVSSGSNGGRIVASPNARRLAEQLGVDLASITGSGPGGRIVGEDVERAAAGAKAPAPAPAAKPASAPAPLPAAAASGQPVAFSALQQAVNRNMEAALAIPAFRVGYTITTDAFDELHKSVKSKGVTVTTMLVKAVAITLAKHPLLFAAYTESGLRYHSAVNVAVAVAMEEGGLITPVLRAADSKDLYTLAREWKDLVERARLKKLQPEEYTSGNFTLSNLGMFGVDRFDAIVPPGTSAILAIGAAKPTVVVTEAGHIAIQKQMQVNLSGDHRVFYGTDGARFLQDLAKLIEQSPQQLTL

SEQ ID NO: 21657 - protein, 499 aa, Populus tremula x Populus alba
MVLSKTASESDVSVHSTFASRYVRASLPRFKMPENSIPKEAAFQIINDELMLDGNPRLNLASFVTTWMEPECDKLIIASINKNYVDMDEYPVTTELQNRCVNMIAHLFNAPLGDSETAVGVGTVGSSEAIMLAGLAFKRKWQNKRKAEGKPYDKPNIVTGANVQVCWEKFARYFEVELKEVKLSDGYYVMDPEKAVQMVDENTICVAAILGSTLNGEFEDVKLLNDLLVEKNKSTGWDTPIHVDAASGGFIAPFIYPELEWDFRLPLVKSINVSGHKYGLVYAGIGWVIWRNKEDLPEELIFHINYLGADQPTFTLNFSKGSSQVIAQYYQLIRLGYEGYKNVMENCRDNMLVLKQGLEKTGKFNIVSKDKGVPLVAFSLKDNSLHNEFEVSDMLRRFGWIVPAYTMPPDAQHVTVLRVVIREDFSRTLAERLVIDIGKVLHELETLPSRISAKIVLANEEKDAVAAGKEKKDVQNETREIITAWRKLVVQRKKLNGVC

SEQ ID NO: 21658 - protein, 320 aa, Oryza sativa (japonica cultivar-group)
MSGRRDDSAKMAKLKELLHRSENCICADCSAPDPKWASANIGVFICLKCSGVHRSLGTHISKVLSVTLDQWSDNEIDNVIEVGGNSHANAIYEAFLPQNHSKPHPDSTQEEREKFIRSKYELQEFLEPSLRIVSHQSSDSGKHAGSASHSVSSKSEVGMIEFIGILNVKVKGGTNLAIRDMSSSDPYVVLTLGQQKAQTSVIKANLNPVWNEELKLSVPQQYGPLKLQAFDHDMLSKDDLMGEAEIDLQPMINAAAAFGDPGLLGDRQIGRWLKSGDNALVRDSAVVVPGGEVRQELALKLQFTESGEVELEMQWFPLNM

SEQ ID NO: 21659 - protein, 1166 aa, Ustilago maydis
MQAVTASRPNADSASASHRIPSQPNASNPPSASLRPPDQQLPTTAASLMREGPRDFTVIKDVGDGSFGTVCLADWKSPLPSGTMLSPMQHPTTRPEYIGKRLVAIKKMKKPFPSWQECMKLKELKSLLTIPPHPNIIPLYDAFLMPTTKELHFVFECMEGNLYQLTKSRKGRPLAAGLVASIYEQIVLGLDHIHQHGYFHRDMKPENLLITTTGLADYPNLQPALAAERDVLVIVKLADFGLARETLSKPPYTEYVSTRWYRAPEVLLRSRDYSNPVDMWALGTILAELVNLKPLFPGHSEVDQVLQICDILGDPSHSYGHDSRNRRNGGGPWDRGIRMARAVGFTFPIRKPAKFSRFFSDRVPQNLIDCIEDLLRYDPQARLTSKDCLQHDYMRLDAPRLRPPQAKPLVSATAPLRPQQNASRPLPSSHSTLLSSNHARPPFGAADSNLKPLAVLRQPDGSPIVRVNAAATSDPSLANGTTPASPMQEDATEVHWAPPVVSSSRDVSLSGYPAFPDSASLYAASSSTHPDGPPSGAPSSDATMVMSDAQLTDSTLKHTDPRHAQALQAHQYEQYQRQYRHDAGQSQSPGYDAHAAAAYDRDAALRGAAFVPFVASYPGSAATGQLAAATSSGELSQKNDSNASNETISSRDKERRRSKVWGLNISSKFGGSGSSGTLAGSSSGGAANATGTHLYAVGNAAAGRLPPNGPMQESRVSLEPTPAQRIAAEHSNATLATLPNGAPAKTADSKKARKEAEKAAREAEKAKREAQQKAARDRARAVMQKRNQLLASSNSKDPVEWLAGAIQSDEPYRSSPSEKARGKQPAIPGSQLSPSMPSFASGEFPRSPLQQPIHGLSPDYGMNANPAVMGSMAWRGVGAARYSRSNKARRREHDDDHSMSSFEDAVDPRRASMQSYQTGDSDPGPGTGQQVAQGHYVQRASSSSSLASAPSLVDQRRFAPSLESHRSSADTRSISSLDHQLITNMERMTAVEARARTPGNVSPGPAHVVGARQSLSRQSRTNSRASSTSAHRQGSASPLHHASGIPRFHPYSHGGPVTPSTGYHANYQLPPLHQSLAHPSGAQRSDTAGDRSVSPAFYSNASQPQQHVHQHHINPIFHVPAGNSGHGTTLPPFSSIAASIDVPAIDEKATQMLYAQARSPGPLPQS

SEQ ID NO: 21660 - protein, 142 aa, Acidobacteria bacterium Ellin345
MPAILELLKQNHHDLHVVQHDQSVIEAVHFMVENNVGAVPVLDHGHLVGIFSERDVMTRVVVRGMDPHSTTVETVMTPEPLAVAPETSVHDCMVLMKQHKFRHLPVCEGRRLVGFLSLRDLLLYEVDEKDVEVRMMRAYIAS

SEQ ID NO: 21661 - protein, 186 aa, Debaryomyces hansenii CBS767
MSQVEISELAKEIRASLKQFPNFPSEGILFEDFLPVFTKPDLFQKLVRAFQLHVGEQKVDYVVGLESRGFLFGPTLALALGAGFVPVRKAGKLPGPVFTAEFQKEYGSDKFQIQKDVIEEGAKVLIVDDILATGGSASSAGELVKQTGGDIVEYLFVMELDFLNGRDKLDKPAFTLLSGQAEKLQN

SEQ ID NO: 21662 - protein, 240 aa, Coccidioides immitis RS
MSGKLDTSLDEIINTTRASRRQRRRDSRSTRGKAASAPVGGVRKPARQAKAAAKAIPTAPSTGTGESKIIVSGLPSDVNEANIKEYFHQSAGPVKKVMVTYNQNGTSRGIASITFARPDTAAKAAKELNGLLIDKRPIKIEVVVDAARAPPVPPVKPLGERVVLPKAQPKPVSAAKSGRRDPRGRTRRGRNANRPKPKTAAELDAEMADYFEASEAAGAPTNGTAQPAANNEDMGMDEIS

SEQ ID NO: 21663 - protein, 251 aa, Desulfotalea psychrophila LSv54
MKRKALIAGNWKMHMTVLEGCRLAAEIVASCKDYTDREVLLAPPCTIISEVSHILAGSKIILSSHNVCWEEKGAFTGEISPTMLQDAGASCAIVGHSERRQVFFESDEVINKRLKGALAFGLMGILCIGETLEEREAGNTQAVLERQVRKGLADVPASQMKQVVLAYEPVWAIGTGVTASKEQVQETHAALRQLISEIYEKDIAEGLRILYGGSVKATNVDELMSQQDIDGALVGGAALDSISFARIINFE

SEQ ID NO: 21664 - protein, 314 aa, Clostridium perfringens SM101
MKKVLCPGEALIDFVSNEHGKALKDTSGFIRKAGGAPANVAAAISKLGADAYFCGTVGDDFFGEFLEETFKKNNINTEMMIKLKDKSTTLAFVSLKEDGDRDFKFMRNADSDLTFDEIKNNLDQFDLFHFGSATAFLEGELKNTYYKLKDYALKNNKIITFDANYRDALFGEDKDTFVSCCKDFIKDSKIVKLSDEEACLISGMENIEEAAKYIIDLGCENLIITLGKKGALLTTKEKQILIPTNEMKMVDATGAGDAFIGAVIAQVLDIPNKSIEDIIKTANLVGGITTTRIGALESIPTWDEVKQYSKLDQI

SEQ ID NO: 21665 - protein, 392 aa, Desulfotalea psychrophila LSv54
MKSLRELELAGKRVLVRVDFNVPMDDKQRITDDIRIRMVLPTLRYVLEQGGRLIICSHMGRPKGKRVEEYSLAPIARHLAGLLGRDVGIAPDCIGAEVEAQVAALGVGEVLLLQNLRFYGEETENDAVFAGKLAGLADVYVNDAFAVSHRAHASVVGVAERVAEKCAGFLLQTEIDYFHKSMNDPIRPLVALVGGAKVSSKIGALENMLGKVDKMIIGGAMANTFLMSQGVDVGASKVEDDLLVTARNFLQAAGERGMKVYLPVDFVVADRFAADAVHKTVPADSVPEGWMALDVGPASSILFREALQGAGTIVWNGPMGAFEMDAFAGGTMSLCRDVAASQALSITGGGDSNAAVKKSGEADNISYMSTGGGAFLQLMEGKTLPGVDALEA

SEQ ID NO: 21666 - protein, 512 aa, Clostridium perfringens SM101
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVSRIKDGDSVIFFNFRPDRAREITRAIVDPEFKGFERKQLHVNFVCMTQYDKTLECVDVAYRPENYTNTLGEYVASKGLNQLRIAETEKYAHVTFFFNGGVEQPNTNEDRALIASPKVATYDLKPEMSAYEVTDELIKRLDEDKYDMIILNFANPDMVGHTGVQEAAVKAIEAVDECLGKVADKVLEKEGTLFITADHGNAEVMIDYSTGKPMTAHTSDPVPFLWISKDAEGKSLKDGGKLADIAPTMLTVMGLEVPSEMTGTCLLNK

SEQ ID NO: 21667 - protein, 482 aa, Xanthobacter autotrophicus Py2
MSSDVTYPDVQLHIDGVWRDADGGKRIPVINPATEEEIGSVAHCSIADLDEALAATERGFATWSRTSAFERSKLMRKAADILRERANSIARLMTLEQGKPLPEARMETLAAADVIDWFAEEARRAYGRVIPARAPGVYQLVIKEPVGPVAAFTPWNFPINQVVRKLCGALAAGCSIIVKAPEETPASPAELIRAFVDAGVPKGVIALVYGVPAEVSEYLIPHPVIRKITFTGSTPVGKKLAALAGAHMKRVTMELGGHSPVIVFDDADVQAAAKQIATAKFRNAGQVCVSPTRFLVQEKVYEQFVDTFVTVAKAVKVGNGLDEGTTMGPLANDRCIPAMEALIADARQKGAEVKTGGSRIGNKGYFFEPTVVTGVTREMRMMNEEPFGPLAMLLPFADFDEAITEANRLPYGLASYAYTSSAKTAQAVAHQVQAGMMTINHLGLALPEVPFGGVRDSGYGSEGGSEAIEAYLNPKFVSQAGV

SEQ ID NO: 21668 - protein, 232 aa, Glycine max
MASSSDSWVKEYNEALKLADDISGMISEQSSFPASGPETQHHSSAIRRKITILGTRLDSLQSLLSKLPGKQPISEKEMNRRKDMLSNLRSKVNQMASTLNMSNFANRDSLLGPERKPDAMTRMVGLDNNGLVGLQRQIMKEQDDGLEQLEETVASTKHIALAVNEELDLHTRLIDDLDQHVDVTDSRLRRVQKNLAVLNKRTKGGCSCMCMLLSVVGIVALIVVIWLLVKYL

SEQ ID NO: 21669 - protein, 214 aa, Pseudomonas fluorescens PfO-1
MQLKNPILGLCQQSTFMLSAAKVDQCPDDEGFEVAFAGRSNAGKSSALNTLTHASLARTSKTPGRTQLLNFFKLDDERRLVDLPGYGYAKVPIPLKQHWQRHLEAYLGGRESLKGLILMMDIRHPMTDFDLLMLDWAVAAGMPMHILLTKADKLTYGAAKNTLLKVQSEIRKGWGDQVTIQLFSAPKRMGLEEAYTVLAGWMELADKGAELPAE

SEQ ID NO: 21670 - protein, 960 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQVWHLSQCVNLISTRIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMIVCIQMFNVVFGLVFKFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 21671 - protein, 509 aa, Coprinopsis cinerea okayama7#130
MDFFGNIQGPGGLFQQFGGLHGQHTGHGPRANPRAYDEYLKAYSVAMMQGRERENVSYGGKILQVIMPPSALARLTQLDIEGPWTFQLRNPSNPAASTHAGVLEFIAEEGVVHLPFWMMKTLRLNEGDPIRITGTELPKGKFVKLQAQTVHFLEISDPKAVLEQALRNFSALTQGDIIEISYNSIIFGLLVMETKPGGAGISVLDTDLEVDFAAPVGYVEPERPKPQAPPTMASKLKIDLNEHSPGSSRPGSSLSGGFAGTSTGQPTLSKGGDHWESFKGKGETLSGRKTKGKGISHRKVEPVPEGSKIIRTDNRKIVSNATLETDTKVPAALNLPFGQLFFGFNVVPYSPPAAAPGSPEALPQSPPAFSGSGNRLTGRSVGQSSASSSAKAEEKKPASTYNWGSGGNTLGASTPRELGSVGAGGARVPRLPHRTSAQQKARERSPTPDFGVSDDEIIDIDNVSLFNASRLETTMTYAPEHANSSKEGAATALSVLTAATMAQYSNSSE

SEQ ID NO: 21672 - protein, 729 aa, Coprinopsis cinerea okayama7#130
MSLSPTSIRVRLSSSHHDLTYQWTDTELIVAHDRKKDKASKQVKSHRIPHENVLRVSYDPKGSSLSVSYIKPKKKKKPASLVVLTGAVQDGEEKAAAENWAETAMKCLYDNRGIKPARRLLVFVNPHGGSGRAVKIFNKTVKPILQAAGCSLKVIQTERHKHAYEVVKAMDLEYDAIVTVSGDGLVHEVLNGLAQHAQPLKALTTPVAPIPAGSGNGLSLNLLGLDNGFDATQAALNAVKDLDLDTEHLRWMGDTRFMYGFLRGACPVQLSIKVAEKDKDKMAEIAHARNQEVCVCNLEDDKTAAAHASLPALRYLPDDNDGWYTIDEPILFVYAGQGPYVGRDYMAFPVSLPDDGLIDIAAMPLSSRKDALANISTAPTGECFWFPKLHYFKAEAYRIKTLGKKGNLSIDGERFPFEEYQVEVHPGLGTLLSPHAVRALDEWIANPPTLSLSDGVTLDHLTDLYATLPTRDGTRRRYETPKDGDVLGYGHHLAFFHCKSPEHRLRADGTDEELSPPPPFSTRMWAGGKITWDNDNPLTVGVQSKTSASVLEVLKKGFDRGKPLVFVTQRINFFKKGKDKPSIVEERQHVYIPDGLRVVRKEPRVVPDIPENVDFSFQYQPSPVTLFRYSSLMFNAHHIHLDKDYTTRVEGYPERLVHGPLTATMLLETVNFHNPLVHLKEFEYRATNPMYVNRVLTINGTWIGPSKAKVWCVDDEGAVGMVGLVTTAE

SEQ ID NO: 21673 - protein, 175 aa, Triticum aestivum
  misc_feature (6)..(6): Xaa can be any naturally occurring amino acid
  misc_feature (67)..(67): Xaa can be any naturally occurring amino acid
  misc_feature (111)..(111): Xaa can be any naturally occurring amino acid
  misc_feature (115)..(115): Xaa can be any naturally occurring amino acid
  misc_feature (127)..(127): Xaa can be any naturally occurring amino acid
  misc_feature (133)..(133): Xaa can be any naturally occurring amino acid
  misc_feature (135)..(135): Xaa can be any naturally occurring amino acid
  misc_feature (143)..(143): Xaa can be any naturally occurring amino acid
  misc_feature (147)..(149): Xaa can be any naturally occurring amino acid
  misc_feature (161)..(161): Xaa can be any naturally occurring amino acid
  misc_feature (164)..(164): Xaa can be any naturally occurring amino acid
  misc_feature (166)..(167): Xaa can be any naturally occurring amino acid
  misc_feature (169)..(169): Xaa can be any naturally occurring amino acid
  misc_feature (171)..(171): Xaa can be any naturally occurring amino acid
  misc_feature (174)..(174): Xaa can be any naturally occurring amino acid
  unsure (1)..(175): unsure at all Xaa locations
LLEAVXRERNIRTNQTRNTTIFHHPALGDFELQHLPVGNDAELEERILQHLAAAAAMGRAHHLGRRXGHRGRSGSHGRPHFLVFSTQPNSPSAGTISSSSAHMEGENDSNXCHTXASESSSTSYSHXEWGNQXPXMLTYDAEXDAVXXXSGNRPPYSSPRXFFXRXXSXGXLTXE

SEQ ID NO: 21674 - protein, 399 aa, Brassica napus
  misc_feature (11)..(11): Xaa can be any naturally occurring amino acid
  unsure (1)..(399): unsure at all Xaa locations
AGEKEVEATRXNNLGWAYEPFQVPEDVKSHWSRHTPEGAALEADWNAKFSAYEKKYPEEAEELKSIISGDLPAGWEKALPTYTPESPGDATRNLSQQCLNALAKSLPGFLGGSADLASSNMTLLKAFGDFQNATPEGRNLRFGVREHGMGAICNGVALHSPGFIPYCATFFVFTDYMRAAMRIAALSEAGVIYVMTHDSIGLGEDGPTHQPVEHLSSFRAMPNIMMFRPADGNETAGAYKIAVARRNTPSVLALSRQKLPQLRGTSIENVERGGYIITDNSNGNKPDVILVGTGSELEIAAKAGEELRKEGKSVRVVSFVCWELFDEQTDAYKESVLPSEVSARVSIEAGSTFGWGKVVGGKGKSIGIDSFGASAPAGKLYKEFGITVEAVVAAAKSLI

SEQ ID NO: 21675 - protein, 508 aa, Debaryomyces hansenii CBS767
MPQTVNNENEYRLTRSKAMQNQSLRGNEGGPKTHAQTQMEAQSQKGGRGEAVMGDGNGDTKDGLYNLSQHSSEEVLAGTRSYLGDVSNQYGSSGVKPNMGSKRRPLGGDNAPLQQHQRIMLKPNNSSTNTNHLLASQPKDTVTTTTATINDNTNGNITTNNHTSASSSNSSTQNLAVPARMPQKRQATESSTNLVEKLHISGPHSNHVSYKKSRIIDYEWQDLDEEDIDDPLMVSEYVNDIFPYLSELEHKTLPDSQYLFKQKHLKPKMRSILVDWLVEMHTRFRLLPETLFLAINIMDRFMSLEIVQIDKLQLLATGSLFIAAKYEEVFSPSVKNYAYFTDGSYTEDEILQAEKYILTILNFDLNYPNPMNFLRRISKADDYDVQSRTLGKYLLEITIIDYKFIGMLPSLCSASAMYIARLILGKTPVWNGNLIHYSGGYRVSDMKDCIELLVQYLIAPVEHDEFFKKYATRKFMKASILCRSWAKKIVSENKDIFANDLFINKAEN

SEQ ID NO: 21676 - protein, 309 aa, Triticum aestivum
MSPAEALVATLPTREGWSTPLTLYNNCWLRSHMLRRFMLVRDNFKPRRDDIILATHPKSGTTWLKALAFTISTRSRCDFTDSPLLTNNPQRVVPFIGAVGGDLDFLETLPSPRLLATHLPPSLLPPAISTVGCRVVYLCREPKDAFVSRWHFDNKMGKGAPITLDDAFSMFCEGFSPFGPFWDHYLQYWKESLARPQEVMFLKYEEIVSDPLTVVRKLASFLDVPFTEEEEKSGIVDQVVSFCSFESLRNLDVNKTGGAERAGGKIFIQHSSLFRKGKVGDWVNHMSKEMGEKMDRLVEEKFRGSGLEF

SEQ ID NO: 21677 - protein, 321 aa, Stellaria longipes
MENFPIINMENIERKNTRDMIKDACENWGFFELVNHGIPHSLLDKMEKLTKDHVRKCLEERFKEMVASKGLEAVEAEVTDLDWESIFFLKHLPVSSISELPDLDEEYREVMIDFSKRKEKKAETKKDKKCENKGKEKSYLKNTFYGSKGPNFGTSVSNYPPLPKPDLIKGLSAHTDAGGIILLSEDDKVSGLELLKDGDWIDVPPMRHSIVVNLGDELEVITNGKYWSVEHRVQIDTNITRMSTASFYVPGNDRVIAPAEALPKEFKKDEVYPKFVFKSYMKAYAKLIRQSGLKFEAKEPRFEAMKAHRIGSSCNSHLEHD

SEQ ID NO: 21678 - protein, 333 aa, Thermus thermophilus
AYRICLIEGDGIGHEVIPAARRVLEATGLPLEFVEAEAGWETFERRGTSVPEETVEKILSCHATLFGAATSPTRKVPGFFGAIRYLRRRLDLYANVRPAKSRPVPGSRPGVDLVIVRENTEGLYVEQERRYLDVAIADAVISKKASERIGRAALRIAEGRPRKTLHIAHKANVLPLTQGLFLDTVKEVAKDFPLVNVQDIIVDNCAMQLVMRPERFDVIVTTNLLGDILSDLAAGLVGGLGLAPSGNIGDTTAVFEPVHGSAPDIAGKGIANPTAAILSAAMMLDYLGEKEAAKRVEKAVDLVLERGPRTPDLGGDATTEAFTEAVVEALKSL

SEQ ID NO: 21679 - protein, 851 aa, Listeria monocytogenes str. 4b H7858
MTNIGLPVPPGFIISTDACNDYTANNKHLSEAIFEEVKIHLAELEKQTGKIFGFAENPLLVSVRSGAPFSMPGMMDTVLNLGLNDQAAEGLANLTGDARSAYDSYRRFIQMFGDVVFEIPSYQFEQALSRIKKANNYRLDTELTATDLSNLIDAYKLIFSQATGIDFPQDPLEQLRLAIIAVFDSWMNPRAVIYRRLHDIDASFGTAVNIQAMVFGNTGETSGTGITFTRNPSTGEKKVFGEFLLNAQGEDVVAGIRTPEPISALEERMPTVYKELLQTCELLENHYLDMQDIEFTIEKGKLYVLQTRSGKRTAKAAIQAAIDFVHEGKITRQEAIMRVETKQLNQLLHPTFLESALKNGQVIATGLPASPGAATGQIFFEAKEAVQAAERGIPVILVRNETSPEDIEGMARSNAILTAHGGMTSHAAVVARGMGKCCIAGCAELTINEKDKTIILPTGDTLHEGDALSLDGSSGKVYLGEIALREAKIGGYFDELMAWADAEKRLMIRVNADTPADFKKALLFGAEGIGLCRTEHMFFDEKRIPYVRQMILAESLNERESVLAILKEMQKADFNELFRIADGRSVNIRLLDPPLHEFLPTMKQEIEQLAGAMNRTVPQITNRINGLREANPMLGHRGCRLAITFPEIYRMQAEAIIESAIIVHNEGIDVHPEIMIPLIATKNELSYIKKELQQAVQAIFDREQVLIPYDIGTMIEIPRACVTAAEIAEEAAFFSFGTNDLTQLTYGFSRDDATKFLADYYEKDILPKDPFVSIDKNGVGALVEMAVTRGRMTSEHLKMGVCGEHGGDPESIQFFHQLGLSYVSCSPYRVPIARLAAAQAALAEKQLVPTI

SEQ ID NO: 21680 - protein, 307 aa, Synechococcus sp. WH 5701
MSITVEQAITGQPHPPFGRMLTAMVTPFSPDGAVDLELAARLAEHLVDHGSDGLVLCGTTGESPTLSWQEQHELFEAVKQAVGGRALVLAGTGSNCTAEAIEAIGRAAEEGADGALVVVPYYNKPPQEGLEAHFRAIAQAAPGLPVMLYNIPGRTGCSLEPRTTARLLDLPNVVSYKAASGSTDEVSQLRLLCGDRLAIYSGDDALTLPMLAVGAVGVVSVASHLVGREIQRMISAFFAGELAAALALHERLLPLCRALFATTNPIPVKAALELEGWPVGSPRLPLVSADSDVRARLTSALAALRPT

SEQ ID NO: 21681 - protein, 206 aa, Glycine max
IPFRSFSDARIGEVKRVTKETNVSVKINLDGSGVADSSTGIPFLDHMLDQLASHGLLDVHVKATGDIHIDDHHTNEDVALAIGTALLHALGDRKGINRFGNFSAPLDEALIHVSLDLSGRPHLSYNLDIPTQRVGTYDTQLVEHFFQSLVNTSGMTLHIQQLAGKNSHHIIEATFKAFARALRQATEYDPRRRGTIPSSKGVLSRS

SEQ ID NO: 21682 - protein, 1100 aa, Candida albicans SC5314
MLESLNRRNSIDSNQGDNDNDNDNHSNDELSPSELYYSPSGSPPKSQLLLRKSSSPSSYSPIKSDLPNIYSHLRSNDSESPPQPSPKQQSSLSSSSSSSSSSNTKSSTTKNIFKKLLRINKSSDNIDESRSIVSNNGGSPMSDSTTVTSTLSTDTAPKRGKSIQRSQILHHTDSDSLYLENQIELRPEISKSIGNIKIPSIFTNDGMPLLKISHKSKKRILFWIDPSCFKFSWRMANSTTTTTSATTSATTSGLPQGITNTTALSNSAIISTPAIATSAIHRLSITNRTTHEFALDDIKSIYIQNEGSGYREELNISQKLEKNWITIIYFNHKKNSLKSLHLITDNDHDFKKLISAIYNLKQLRSQLAKEFLIDLNELDENYVKMLLNKELLAGDNGNVDGNEVDIQKSHKHVREFLSFNDILKYSKRLNINVNTNHLQQIFDQVLLLSSATTEKPVSTPLFEKGLNFEQFKQFVSILKDRKDLQEIWDSLAQGKEVLQFDEIKNFIINIQKENFSDDDDNSTINLIFQKYCSNDNGWNKESLNEYLLSSYSTPYREITQTQTNYYDYPLNEYFISSSHNTYLTGRQVAGDSSVEGYIRTLQRGCRCVEIDIWNGDSNTTTTTVIGTKDDDDKNEYEPIVNHGRTFTKPISFANVIRAIKKFAFIVSPWPLILSLEIHCSPECQIKVVNILKDILGENMIIAPIDIDSVILPSPAELKHKFIIKVKKTTSFQNLIETENGSFTTSTTTTTTTTTTTTTTATSLSEDNENNKSNSSSTSSFIIRRRKNKSPKIINELSNLGIYTQGIKFRNFSLPESKTFNHCFSLGEKSINRMIKDDDKKISLDKHNRRYLMRVYPSGTRLKSSNFNPLPYWSHGVQMVATNWQTYDLGQQLNEALFENKIFQGYVLKPSVLRKPTLKSSSSNVDTRTSLTTTNSKTIRFNFEIISGHQLPKFPKDDYKDQAINPYISFEIIGAQDVQWDNNDSSPIAPTTSSSPFIRTTKIIRENGFNPNFNTKFSGSIITTTNDLIFIKFVVYASTSLNYPDYGENFPIAILVTKLNYLKQGYRYIYLNDLLGEQLVYSSIFIKIEYDEDLLNEFINK

SEQ ID NO: 21683 - protein, 475 aa, Candida albicans SC5314
MGKITTSDTKTKQRHNPLLKDISSQGGNLRTVPRSSSSSSSQKKKSSKKQRHNDEDDEENGGGEGFLDASSSRKILQLAKEQQDELEQEDEIQNKPSFAQSFKNQQIDSEEEEEEDEYSDFEEEEEVEEIVYDEEDAEVDPKDAELFNKYFQSNGEANNNDDDNSFQPTINLADKILAKIQEKESQQQQQQQSSPDNSNEDAVLLPPKVILAYEKIGQILSTYTHGKLPKLFKILPSLKNWQDVLYVTNPNSWTPHATYEATKLFVSNLSSNEATVFIETILLPRFRDSIENSDDHSLNYHIYRALKKSLYKPGAFFKGFLLPLVDGYCSVREATIAASVLTKVSVPVLHSSVALTQLLTRDFNPATTVFIRVLIEKKYALPYQTLDELVFYFMRFRNATINQDENMENMDIDQEKTTKVNNGPQLPVVWHKAFLSFATRYKNDLTDDQKDFLLETVRQRFHPLIGPEIRRELLS

SEQ ID NO: 21684 - protein, 476 aa, Yersinia pestis CO92
MVRFESTDSLMLARQLPNKTVALILAGGRGSRLKDLTATRAKPAVHFGGKFRIIDFALSNCLNSGVRRIGVITQYQSHTLVQHIQRGWSFLNEEMNEFVDLLPAQQRLSTEQWYKGTADAVCQNLDIIRRYDAEYIVILAGDHIYKMDYSRMLLDHVEKGAECTVACIPVPISEGSEFGIMEVTADYQITAFYEKPANPPPIPGDPSNALASMGIYIFNADYLFKLLEEDNNTPGSSHDFGKDIIPQLTARKVVWAHPFDLSCVTSNAELPPYWRDVGTLDAYWRANLDLASVTPELDMYDRAWPIRTHMEPLPPAKFVQDRSGSHGMTMNSLVSGGCIVSGSVVVHSVLFPRVRVNSFCTIDSSLLLPDVHVGRSCRLRRCIIDRACHIPEGMVIGENADEDSARFYRSEGGGGVSDSGYAGKVRGKIEPLGFLFVRLDLLIRLSLLIRLNLFIRMNLLIILTLFFKLASIQASH

SEQ ID NO: 21685 - protein, 125 aa, Kineococcus radiotolerans SRS30216
MTERTKPEIDFPGGEPPTELEITDQIVGDGAEATPGKTVSAHYVGVAFSTGEEFDSSWNRGQPLDFPVGAGMVIKGWDQGLLGMKVGGRRKLVIPPHLGYGDRGAGGAIKGGETLIFVVDLVDVK

SEQ ID NO: 21686 - protein, 662 aa, Yersinia pestis CO92
MAVLTHGSPTPSGAHFDGKGINFTLFSAHAEQVTLCLFDEQGQERQIAMPARTGDIWHGYLPGGKPGQRYGYRVSGPFEPSRGHRFNPHKLLIDPRTRALEGKVGDDPRFTGGVSQPDVRDSAAALPKCLVIHEEYDWQGDKPPAIPWGNTVIYEAHVRGLTQLHPDIPPELRGTYAALAHPALIEHLKTLGITTLELLPVQFHIDEPRLQKMGLSNYWGYNVLAPFAVDPDYASGREGISPLRELRDAVKALHNAGIEVILDVVFNHSAELDVFGPTLCQRGIDNASYYWLTPDGEYDNITGCGNALRLSHPYVTQWVIDCLNYWRDSCHVDGFRFDLGTVLGRTPAFDQHAPLFAALAADERLSACKLIAEPWDIGLGGYQLGNFPTGFSEWNDQYRDAMRGFWLRGEVPRGTFAQHFAASSRLFEQRGRLPSASINQITAHDGFTLLDLLCFNQKHNQMNGEENRDGSDNNHSNNFGCEGLVADAAIWQRRKACQRALLTTLLLSQGTPMLLAGDEQGHSQQGNNNAYCQNNILTWLDWGSADRALMTFTADLIRLRQQIPALTQDQWWQSGDSNVQWLDSQGQALSDAAWEQGCQQQLQILLSQRWLVLINATDHECEMHLPEGEWEGIPPFGVSDHAERLTTWRGSAHTICVLIKRD

SEQ ID NO: 21687 - protein, 374 aa, Prochlorococcus marinus str. MIT 9312
MADFYQILGVSRDADADTLKRAYRKLARQYHPDVNKEPGAEDKFKEIGKAYEALADPETRARYDQFGEAGLGGAAGMPDMGDMGGFADLFETFFNGFGGQTPQGGRTQRRGPQQGDDLRYDLNVDFKDAIFGQQREITIPHLETCEVCRGTGAKPGTGPKTCSTCGGSGQVRRATRTPFGNFTQVAECPSCNGAGQIIADPCTSCGGNGVKQVRKKLRINIPAGVDTGTKLRVSGEGNVGLKGGPPGDLYVFIKVKNDSKLKRDGVTIYSEIAVSYLQAILGDTVEITTVDGNVNLKIPSGTQPNTTLSLENKGVPRLGNPVARGNHEVLVKVKLPTRITDEERELLEGLASQYSDKNINSSSGLFSKLFGKES

SEQ ID NO: 21688 - protein, 268 aa, Xanthobacter autotrophicus Py2
MNIDLSGATRLYIIVGDPIAQVKSPAGMTAAFLSRNHDGILVPVQVGTGDLGDLLAVSGKLKNLGGVVVTVPHKFGCFSHCAEASDRAAFIGSVNIMRQRPEGGWYGDIVDGLGFVSAAVNAGFDPDGKRALLVGAGGAGSAIALALIDAGVAELAIHDADVARRDALVARLNTLGKGRAVAGSTDPAGFDLVANATPMGMKEGDPLPVDVTRLVPATHVGCVITQPAVSPLIAAARAAGCPTSTGTEMYFALQEKMVDFLLHTDSNA

SEQ ID NO: 21689 - protein, 217 aa, Vibrio fischeri ES114
MTFKAAIFDMDGLLLDTERVCMSVFQQACEAENVPFLEDVYLSGIGCNAKRIEELFRAGYGPDIDYPALNKAWRIRYFSIVQNQAIPVKEGVIELLEWLKANKIPMAVATSTQNDIAIKKLALAGLDGYFDVLATGCEVENSKPHPEIYFLAAERLGIAPETCLAFEDSNNGTRAAVTATMITYQIPDLVQPSQDVIELGHRILPSMVEVLAELKAR

SEQ ID NO: 21690 - protein, 393 aa, Glycine max
MNISTTRKDFMIVNMGPHHPSMHGVLRLIVTLDGEDVIDCEPILGYLHRGMEKIAENRTVIQYLPYVTRWDYLATMFTEAITVNGPEQLGNIQVPKRASYIRVIMLELSRIASHLLWLGPFMADIGAQTPFFYIFRERELIYDLFEAATGMRMMHNFFRIGGVATDLPYGWVDKCYDFCDYFLTRIVEYQKLITRNPIFLERVEGVGVVDIKEVINWGLSGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 21691 - protein, 340 aa, Prochlorococcus marinus str. MIT 9312
MTLRVAINGFGRIGRNFMRCWLSRGAYTNIEVVGINVTSDPKTNAHLLKYDSVLGQLDGVDIQYTDDTFVINNKTIKCFSDRNPMNLPWKDWGVDLVIESTGVFNTDVGASKHLEVGAKKVILTAPGKGDGVGTYVVGVNADQYNHKDYDILSNASCTTNCLAPVVKVLDQNFGINKGLMTTIHSYTGDQRILDNSHRDLRRARAAATNIVPTSTGAAKAVALVYPEMKGKLTGIAMRVPTPNVSAVDFVFESSKSVTSEEVNNALKEASLGSMQGIIKYGDEPLVSSDYAGTNESSIVDSDLTMCIGDNLVKVLAWYDNEWGYSQRVVDLAEIVAKKWE

SEQ ID NO: 21692 - protein, 132 aa, Brassica napus
WCVSRGTHILYGYNCGRHPPRNESLSALCLKNTPPFHVWYFEPICKRTFGFLIEKDALVYLPFVDEVFERSRVLEFLETLRDELENAHENISRGLFSGSIFFNCVQDPLVRTLISSLERVAESTNPLTCLPI

SEQ ID NO: 21693 - protein, 482 aa, Nicotiana tabacum
MKETKKIELVFIPSPGIGHLVSTVEMAKLLIAREEQLSITVLIIQWPNDKKLDSYIQSVANFSSRLKFIRLPQDDSIMQLLKSNIFTTFIASHKPAVRDAVADILKSESNNTLAGIVIDLFCTSMIDVANEFELPTYVFYTSGAATLGLHYHIQNLRDEFNKDITKYKDEPEEKLSIATYLNPFPAKCLPSVALDKEGGSTMFLDLAKRFRETKGIMINTFLELESYALNSLSRDKNLPPIYPVGPVLNLNNVEGDNLGSSDQNTMKWLDDQPASSVVFLCFGSGGSFEKHQVKEIAYALESSGCRFLWSLRRPPTEDARFPSNYENLEEILPEGFLERTKGIGKVIGWAPQLAILSHKSTGGFVSHCGWNSTLESTYFGVPIATWPMYAEQQANAFQLVKDLRMGVEIKMDYRKDMKVMGKEVIVKAEEIEKAIREIMDSESEIRVKVKEMKEKSRAAQMEGGSSYTSIGGFIQIIMENSQ

SEQ ID NO: 21694 - protein, 661 aa, Coprinopsis cinerea okayama7#130
MSALANLVIAASGTHRGYNQVKAANNAGTPIVTLEWLLDSIEGGKKEDETSYLLSSGPPPPPAPSTRPKRKAAAPAVATADDADSDEPPAKKVKTTAAPKGNAKGKAKPRSKAKVVSEDEEMEDVEDEEEEEKEPTPPPPKMKTVIRKGKAPVDELCPLAGSHHVYVDETGVAWDATLNQTDLLERDNSPMTYAVFCRWGRVGDRGQSKMYAESVSLPAAKSVFDKQMKAKTGKSWAQRKEALGGNKKYAYLERNYDDDDDDEEEETTPTSNKPGAEDSKPPPKPTIAPELVRLMELIFNSSFMQQTMASMSYDSNKLPLGKLSKDTILRGFNLLKQIGEVIGDPANAVQNFSEYGNSYQQILSQLSSRYYTVIPHNFGRSVPPVIGDQSMLKREAELVENLIDMKISTEIMTASVKDSDVHPVDKQFASLGLNEAIPLDKTSSEYKYLEAYVKKTQGHTHYMKLQVEEIFRIRRDSEEARWKEKKWHEYENDNRMLLWHGSRTTNFSGILSQGLRIAPPEAPVSGYMFDKGIYLADIVSKSANYCYPQISANTGLLLLCEAQLGDPMYESKGADYYAATNSKKSGAIATKGLGRTVPLEWEDASIIHEDLEGVQIPKVSSKKDNITGNSSDSGLYLQYNEYIVYDISQVKLRYLFRVKMT

SEQ ID NO: 21695 - protein, 440 aa, Glycine max
MAESAVVNRKRSGTDDVVSENDGKRKNVVAPDMDPAAALALTRHEFGEHGGVNMSIEASATFTVMEPETLCRMFTGELGPDRDFFIYSRHFNPTVLNLGRHMAALEGTEAAYCTASGMAAISSVLLQLCSSGGHVVASTTLYGGTHALLTHFLPGKCNISTTFVDISDLESVESAIVEGKTNVLYFESMANPSLKVANIPELCRVGHAKGVTVVTDNTFAPMVISPARLGADVVVHSISKFISGGADIIAGAVCGPASLVNSMMDLHDGSLMLLGPTMNAKVAFELSERIPHLSLRMKEHCHRALVFATRLKKLGLKVIYPGLEDHPQHELLKSIANREYGYGGLLCIDMETVERANLLMAHLQNDAQFGFMAVSLGYYETLMSCSGSSTSSGMTEEEQKLAGISPGLVRMSIGYIGTLEQKWSQMEIALDRFQEKQPLV

SEQ ID NO: 21696 - protein, 443 aa, Acidobacteria bacterium Ellin345
MAINRHVVKSTFVSALGGLLFGFDTAVIAGTTHQLTEVFKLTPNALGITVSSALLGTVLGAITAGYPGQRIGRRDSLRIMAIFYMLSALGCALAWNWSSLLVFRVIGGLGIGGSSVLAPMYIAELSPPKWRGRLVGFFQVNIVIGILVAYLSNFVIGRMNFGAMEWRWMLGIAAAPAVLFFVMLFFIPRSPRWLAMKGRTAEALRVMRLTGTDNPEEELNGIVRSIHLERSTKSESLLQRKYLLPIFLAVSAGAFNQLTGINACLYYLNDIFAAAGASKYSAGMQSVLIGCTNLFFTLVAMTMIDKLGRKKLLLVGTTGVCIFLAIIGQIFHSGGHGGSLIWLLIGFMGFFAISQGAVIWVYISEVFPTRVRAQGQALGTSTLWITNALISWMFPVLAAKSSATPFFFFAAMMFIDVLIIAMIYPETSGVSLEQLEQKLGVVE

SEQ ID NO: 21697 - protein, 545 aa, Solanum tuberosum
MPMDTETKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIVITQACFAGKVKDYAIENDLKVICVDSVPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVDNYDLSSVRTVMSGAAPLGKELEDAVRAKFPNAKLGQGYGMTEAGPVLAMCLAFAKEPFDIKSGACGTVVRNAEMKIVDPDTGCSLPRNQPGEICIRGDQIMKGYLNDPEATARTIEKEGWLHTGDIGFIDDDDELFIVDRLKELIKYKGFQVAPAELEALLINHPDISDAAVVPMIDEQAGEVPVAFVVRSNGSTITEDEVKDFISKQVIFYKRIKRVFFVETVPKSPSGKILRKDLRARLAAGISN

SEQ ID NO: 21698 - protein, 545 aa, Solanum tuberosum
MPMDIETKQSGDLIFRSKLPDIYIPKHLPLHSYCFENLSEFNSRPCLIDGANDRIYTYAEVELTSRKVAVGLNKLGIQQKDTIMILLPNCPEFVFAFIGASYLGAISTMANPLFTPAEVVKQAKASSAKIVITQACFAGKVKDYAIENDLKVICVDSAPEGCVHFSELIQSDEHEIPDVKIQPDDVVALPYSSGTTGLPKGVMLTHKGLVTSVAQQVDGENANLYMHSDDVLMCVLPLFHIYSLNSVLLCALRVGAAILIMQKFDIAQFLELIPKHKVTIGPFVPPIVLAIAKSPLVHNYDLSSVRTVMSGAAPLGKELEDAVRAKFPNAKLGQGYGMTEAGPVLAMCLAFAKEPFDIKSGACGTVVRNAEMKIVDPDTGCSLPRNQPGEICIRGDQIMKGYLNDPEATARTIEKEGWLHTGDIGFIDDDDELFIVDRLKELIKYKGFQVAPAELEALLINHPDISDAAVVPMIDEQAGEVPVAFVVRSNGSTITEDEVKDFISKQVIFYKRIKRVFFVETVPKSPSGKILRKDLRARLAAGISN

SEQ ID NO: 21699 - protein, 449 aa, Pseudomonas sp. ND6
MSNAMRTIDVSALIDGARFNAFHARVLVWCALIIIFDGYDLVIYGVVLPSLMTEWGLSSLQAGALGSCALVGMMLGALFFGSISDRIGRRKTIVICVLLFSGVTALNGFASSPEIFALCRFIAGLGIGGVMPNVVALMNEYAPKKSRSTLVAIMFSGYSLGGMLSAGLGMLFIPQWGWQAVFYVALIPLLMLPLLLRQLPESMDFLLRSGQIEQAKSVLALTTPSYLPEADDQLVHAVSRGATASIGELFRDGRLISTLALWVAFFCCLLMVYALSSWLPKIMSSAGYGLNSSLAFLLVLNGGAILGAIAGGWLGDRVGIARVLLLFFACGALSLSLLAIKAPLAVLYLLIAIAGACTIGTQILANACAVQYYPPHVRSTGLGWAMGIGRTGAIIGPVLGGVLHGSSLPLQASFLFFAIPGVIGAAAILVFLKRRKEIPPVQISPQTVS

SEQ ID NO: 21700 - protein, 211 aa, Brassica napus
MDGGGEDASKVIHVKFVTKLDSPFQAPSSSVVIPSNVTRLGLSSIVNSLLTLEKHEAFDFLIDGELIRMSLEQFLLAKGISAERTLEIEYIRAVAPRKEEKPSLHDDWVSAVDGSSSRFILTGCYDGLGRIWSSPESCTHILEGHSGAISSMALVSSEGAENVTIATAARDRTLRLFKVDTAESGDPTTRVGAYKILRGHKASVASVAAQE

SEQ ID NO: 21701 - protein, 560 aa, Listeria monocytogenes str. 4b H7858
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLDIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGEYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCKEHGIPFSLTEVWEKGGDGGLELADKVIAAVESGEADYKRIYDDAWSMEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 21702 - protein, 301 aa, Mycobacterium tuberculosis H37Rv
MARQRFRDQVVLITGASSGIGEATAKAFAREGAVVALAARREGALRRVAREIEAAGGRAMVAPLDVSSSESVRAMVADVVGEFGRIDVVFNNAGVSLVGPVDAETFLDDTREMLEIDYLGTVRVVREVLPIMKQQRSGRIMNMSSVVGRKAFARFAGYSSAMHAIAGFSDALRQELRGSGIAVSVIHPALTQTPLLANVDPADMPPPFRSLTPIPVHWVAAAVLDGVARRRARVVVPFQPRLLMVGDAFSPRYGDRVVRLLESKIFGRLIGSYRGSVYRHQPTESAKAQAAQPERGYSSAR

SEQ ID NO: 21703 - protein, 1064 aa, Clostridium perfringens SM101
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEEEVLSIENSLKGVTLENGFLKINEEVASGTKIIVKAYDSLNDMTAYKEIEVREDGEKGTFVQFLKNDGLYYGENFSWNIWGFGENSSGKEFNLNIKTDLGVGAFVDEEKFIVRRRTWGYDWVNDWDEQTYTFYLGKEDRNLFCIYENNKILTSLKTAIEETTPKIQVALMDHKNTIKAYLSHKPLIGVKYGLYINGIKAKGVSTLVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVPRKENEGKYYLYRLYFNGLSKKGKHVNKITYAVDPYAVSVGVNGEKGALVDLFNKECVPEGWNKYNKPKLINKEDSIIYEMHIRDFTINENSGVSESLRGKFLGTVEEGTFYIDKESGNKVKTGLDHLKELGITHVHLLPVFDFASVNEEITKDENNRNWGYDPKNFNAIEGSYSTDPYTPSRRIIEFREMIKKFHDNGIRVILDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKVWQVIEGIKGSINSITYKPMESINYLEAHDNYTLWDQIVKSQNHSVEKGHYRDFNEENILDNLYVKEDLLGASILFTSQGIPFIQSGAEFLRSKDGDHNSYKSPDSINALNWAEKEKYIDVFNYYKDLISLRKNHSAFRMKNPEDIIGNLEVYFYDNNDTSGVIIAHYKNNANEDLWKDIVVIYNGTTIDDYNVISSMPKSSNGFWNIAVKSWALNQFGIERVSEDEIPKIKSHSMMILYDE

SEQ ID NO: 21704 - protein, 204 aa, Cyanidium caldarium
GGIAEMSGAEPDVRRITDRLDECGNSTKAFTKGFAVGSAALAGYLLFSSFMEEMSAQLPGKMEFRTVDLAKPEVFTAGLLGAAVVFLFASLAMTAVGRAAQQVVGEVRRQFREHPGIMSGTEKPEYERCVALVATAALRQMVLPGLLPVLAPILIGVVFREIGTLTAQPLLGLECAAGLLMVATITGVLMALFMNNAGGAWDNA

SEQ ID NO: 21705 - protein, 2284 aa, Coccidioides immitis RS
MPLFTSPSDAKPPQTPTSPQRTSRSDSLFPSAPSAGGAVAYVQNEQQPAQSAQSPIAPAVIPPACAQITEDAGRSILLELEDGAIYHGLSFGAERSVAGELVFQTGMVGYPESITDPSYRGQILVVTFPLVGNYGVPSRETMDELAKDIPKHFESSQIHIAGLVVASYCGEDYSHFLAESSLGKWLKEQDVPAIYGVDTRALTKRIREEGSMLGRMMLQKSTSGKDLVNGVPTTADGEDSEMWRENFEEIAWVDPNKRNLVDEVSIKEPRLYSPPKAGLLHPSGRPVRVLCVDVGMKYNQLRCLLARGVEVLVVPWNYDFHSLAKDYDGLFVSNGPGDPAMVSSTVANLAKALEECRTPIFGICLGHQLLARAAGAGTTKMKFGNRGHNIPCTNLLSGRCYITSQNHGFAVDSSTLPEGWEELFVNANDGSNEGIRHVSKPYFSVQFHPESTPGPRDTEFLFDVFINTVKKSIESPSGLNEPVSFPGGTIEENRAAHPRVSVKKVLILGSGGLSIGQAGEFDYSGSQAIKALKQEGIYTILINPNIATIQTSKGLADKVYFLPVNADFVRKVIKHERPDAIYVTFGGQTALQVGIQLKDEFEELGVKVLGTPIETIITTEDRELFARSMESIGEKCAKSASASTLEEAMEVVKGIGFPVIVRAAYALGGLGSGFADNAEQLRDLCAKAFAASPQVLIEKSMKGWKEIEYEVVRDAQDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLNEISNSVTKVTCACFEPSLDYVVVKIPRWDLKKFTRVSTQLGSSMKSVGEVMSIGRTFEEAIQKAIRAVDYTNLGFNATNALMSIKTELQTPSDQRLFAIANAMHSGYTVDDIWELTKIDKWFLRKLEGLSKFGKLISTFSASTVPVSLVRQAKQLGFSDRQLSKFLSSNELAIRRLRVEAGIMPVVKQIDTVAAEFPAYTNYLYLTYNGSESDISFNDNGVMVLGSGVYRIGSSVEFDWCSVRAIRTLREQGHKTVMVNYNPETVSTDYDEADRLYFENITLETVLDIYQLESSSGVIISMGGQTPNNIALPLHRLNVNILGTSPEMIDAAENRYKFSRLLDRIGVDQPAWKELTSIEEATAFCDKVKYPVLVRPSYVLSGAAMNTVYSQDDLANYLNQAAEVSRDHPVVITKYIENAKEIEMDAVAKNGVMVGHFISEHVENAGVHSGDATLILPPQDLDPETVRRIEEATRKIGNALNVTGPFNIQFIAKDNEIKVIECNVRASRSFPFVSKVMNVDLIEMATKAMIGKPFVEYPPVNIPKNYVGIKVPQFSFSRLSGADPVLGVEMASTGEVACFGRDRYEAYLKALISTGFKLPNKNILVSIGSYKEKMEMLPSIRKLHQMGYNLFATAGTADFIREHGIPVKYLELLAGEEEDLKSEYSLTQHLANNLIDLYINLPSSNKFRRPANYMSKGYRTRRMAVDYQTPLVTNVKNAKILIEAISRQFEMAVQPIDFQTSHRTVVLPGLINVAAFVPGVANPDSSDFQSVTKASISAGFSMIRVMPVGVDSFLTDARALKIAQHNSQKGTWCDYNLSVAATTSNADQIGQVAADVGSLYIPFNHLAGNINKVGTVTSHFAAWPPTKPIITDAKATDLASVLLLASLHSRDIHVMSVTSKEDINLIALSKEKGLRVTCDVAIYSLFLSTEDYPQCTHLPSKEDQEALWEHLSTIDIFCIGGLPYELAGKEAKPEVGIADALPLLLTAVWEGRLTLDDVTSRLYDNPKRIFELHDQPDASVEIEVDRPYVFQSEGVWSPFNGKTLRGSVQRVTFQGKTSCLDGELVGDAARGTDMSAHRLAPPASPSIKEPPRSPRRDVSVGRRLSFSTTPVARSSRLRPSDAAITSPGNELGPPLYTQLLSVPTASPSLMELLAQSSFKQKHILSVNQFNRADLHLLFTVAQEMRLGVQRHGVLDILKGRVLSTLFYEPSTRTSASFDAAMQRLGGRTVAVATEHSSTQKGESLQDTVRTLACYADAIVLRHPLESSAATAARFSPVPIINGGNGSMEHPTQAFLDLFTIREELGTVSGITVTFIGDLRYGRTVHSLIKLLQFYEVRVQLVAPKDLALPEDVRQHLVTSGQLVLETEELTPEVVARSDVLYCTRVQKERFEDLKEYERLKNSFVVDNSVLKHAKSQMVVMHPLPRNAEIGEEVDFDQRASYFRQTRYGLYCRMALLALVMAP

SEQ ID NO: 21706 - protein, 879 aa, Gloeobacter violaceus PCC 7421
MVASAQLDLLQLFPFDLDDFQREAIAALDENESVVVCAPTGSGKTVIAEYMVYRALAREKRVFYTTPLKALSNQKFRDFCSQFGPEQVGLLTGDISLNRDAPVVVMTTEIFRNMLYGMPLGEMGTTLAQVEAVILDECHYMNDSQRGTVWEESIIYCPANIQLVALSATIANAGQLTDWITRVHGPTRLIYSDFRPVPLEIHFCSPKGLFPLLDRGNQRINPHFKNIKKHLRGERNLQADAPSHKYVIGQLARRDMLPAIYFIFSRRGCDQALEELGDLCLLDAHEQEQLARQVDDFVREHPEAVRTHQLSQIYNGLAVHHAGVLPAWKALIEELFQQGLIKVVFATETLAAGINMPARTTVISMLSKRTDSGHRPLNASEFLQMAGRAGRRGMDEVGHVVTLQSPFESAPEAAALALSQADPLVSQFTPSYGMVLNLLERHSLETAQRLVGNSFGQYLATLHLEPVRREHAEVSAELEALAGGDAPVSEAELAAYEKLRGQLREARRLQMILKEQADREREQALEGQLKFALVGSLVVLTDPLDRVAKTAVLVRKVPGPPLMLVCLTADNRWVVTGVGGVLDFQPHSGRFDEAEGLSIPTYLMLRPGGHIAGGSESLDLSCRLPSLPVPEPPEAVTAQKNEVEQLRLAQENHPAHRWSGRSAHQRAQHHREKLLKRHQRLAEQLSGESDRYWQEFLRLVRVLEKVEFLDNHKPNALGAVAAAIRGDNELWLALALLNPEVEKLNAVQMAGLAAALVSEPPRPNTWATVTPSPQVEEAIAALQQTRRNLVRLQRRQQVLISVWLEERLVGLVELWAKGVDWQTLCGSTNLDEGDLVRLLRRTADLLRQVPHVPYLTDTVRQTCAESQRLLDRFPVSEAV

SEQ ID NO: 21707 - protein, 543 aa, Mycobacterium tuberculosis H37Rv
MYGTMQDFPLTITAIMRHGCGVHGRRTVTTATGEGYRHSSYRDVGQRAGQLANALRRLGVTGDQRVATFMWNNTEHLVTYFAVPSMGAVLHTLNIRLFPEQIAYVTNEAEDRVILVDLSLARLLAPVLPKLDTVHTVIAVGEGDTTPLREAGKTVLRFAELIDAESPDFGWPQIDENSAAAMCYTSGTTGNPKGVVYSHRSSFLHTMAACTTNGIGVGSSDKVLPIVPMFHANGWGLPYAALMAGADLVLPDRHLDARSLIHMVETLKPTLAGAVPTIWNDVMHYLEKDPDHDMSSLRLVACGGSAVPESLMRTFEDKHDVQIRQLWGMTETSPLATMAWPPPGTPDDQHWAFRITQGQPVCGVETRIVDDDGQVLPNDGNAVGEVEVRGPWIAGSYYGGRDESKFDSGWLRTGDVGRIDEQGFITLTDRAKDVIKSGGEWISSVELENCLIAHPDVLEAAVVGVPDERWQERPLAVVVVREGATVSAGDLRAFLADKVVRWWLPERWAFVDEIPRTSVGKYDKKAIRSRYAEGAYQITEVHT

SEQ ID NO: 21708 - protein, 422 aa, Roseovarius nubinhibens ISM
MTQTDWPARARAVLPGGGFGNFDPSITIREGRGSRVWDEEGRDYVDYLIGSGPMLLGHGHPEVLEAVIEQLPKGQTFFANNAAGIELAEVICAAVPCAEQLRYVSSGGEADMYAIRAARAFTGRDKIVKFEGGYHGMSAEAQMSLAPTNRLNFPQAQPDSAGIPQSVADEMLIAPFNDAEFIRSLLAEHGDKVAGLIVEPLQRIIPPAPGFLQLLREECDRYGIVLIFDEVVTGFRFAYGGAQDLYGVTPDLCTLGKVIGGGFPLAALAGRADIMAHFDKSAVGAERWLMQLGTLSGNPVAAVAGLKTLEILRRDGQYEQLRANGRRVMEMMTRALDAEGIAHRIVGDETLFEPVFTATDPRDYRDVQSADAAASARFNAVLRAEGIFKSGGKTYPSLALTEEDFARTEAAITRAAQALSER

SEQ ID NO: 21709 - protein, 419 aa, Gloeobacter violaceus PCC 7421
MDPRLQECLQVAIGGRDPGPEAWEWLGEATRSDIWQAEATPIESRVELLTAGWPRLNAPPSALEAAWRLWVPLALDIDRRCRSGTLFCQGILGPQGSGKSTLAGALTVLLAHLGRRAVDLSIDDLYLTAPERRRLRTERPALRWRGPPGTHDLALGVRTLEALRSGPAPFWLPRFDKAAGGGEGDRYAWVKLGAEMTLAGPVREGCFFLERCRVQGLDLPLPENMGSPVPLNFLEAPEDGWAVWSCEAGEARLHLAGLVYSVAVDRLPVGWQVLSARPDAVIFEGWCVGVRPVAQDLLKDDLAGQSNRELPAYEALWEFLDRLLVLKPGDLDWSRQWRWTAEQERVGCAQGGMTAAEIAEFVEYFQRSLPWAVFVEPLIAAGCCNLVVEIDAAHRPGRIWRPDESGGSPCIKPGGRRTF

SEQ ID NO: 21710 - protein, 577 aa, Debaryomyces hansenii CBS767
MQLIYHKKLSVITGLFILSLINLVSGYVTKFNELNSQVCSGIYSKHDWGGSFKPSIEIKLLSYGKDKYDSKSKDQKEKEDISVSYVIFEYKDLGNIGYDLGDGKYRYICDDYAINDLGICEKKQKGKFIIQLTSPNSTIMTSSFNHLGEANIHYNVSRSGYYCISTVSMNDKSYSGTMNFQNAFGHLSASEIPKLPAYGILTIFYAIALALYGFQFYKKRNQNQILPLQRYLLAMLGFLTFDTIVVWSYYDLVNRTRNPLAGFVTFYMFFLSFMNAMKISFSFFLLLCISLGYGVVVLKLKKSVMLKCKILAGCHFVATMVYLVSNYYNGSAYTTSSGSSRSMNNSGAGDFLGLLPLIPVTITLTAYYLAVLISIKKTTANLHKQRQIIKLQLYQNLFRIIFLSVILTFGGLILSSFIYLSMSTTEMIEEHWKGAFFIFDFWPSVVFYGVFMGVAWLWRPTETSYMLAISQQLSTEETADNEDGEADIGQGYHRGHEFELDDLSLISHSDNENQPPADHDSFELSRDENPPPQYSETDDDNKKSKKKEEPSETGNTLFELGEESDDENKDDDRLNSK

SEQ ID NO: 21711 - protein, 343 aa, Mycobacterium sp. JLS
MPDPMNRQIVLRRRPVGLVEPSDTELVESPAPEPADGEALLRTTFVGIDAAIRTWLNDQRGYLPPVQLGEVIRAAGIGEVVRSRCDAFAVGDVVTTLTGFQEYAIIRDDLFSTPIAGREKVDQRAVMSVYGPTGATAYFGMTDIGQPRPGETVVVSAAAGATGSVAGQIAKIAGARVVGIAGGPLKCRTVVEDFGFDACIDYRSADLAAALKEHCPKGVDVYFDNVGGAILDAVLGRLAQNARVVLCGVISSYLTGEHPGPANYVNLLSRTALMQGFNALDQWGRFQEAFAALRSWDEQGLLVHREHVFEGIGSCVDALNGLFAGVNIGKMLVKIGEPTVQTG

SEQ ID NO: 21712 - protein, 448 aa, Streptococcus suis
MSNAKAYIQASFEAVKARNPHETEFLQAVEELFSTLEPVFEAHPEYIEENILARIVEPERIISFRVPWTDKDGNVQVNRGYRVQFNSAVGPYKGGLRFHPTVNQSILKFLGFEQIFKNVLTGLPIGGGKGGSDFDPKGKTDAEIMRFCQSFMTELQKHIGPSLDVPAGDIGVGGREIGYMYGQYKRLRQFDAGVLTGKPLGFGGSLIRPEATGYGLVYFTDNMLAANGKSFKDQTVLISGSGNVAQYAVQKATELGAKVISVSDSNGYIIDETGIDFDLLVDIKEKRRARLTEYAAEKSTAKYFKGSVWNYDGKADIALPCATQNEINGKQAAALVKNGVYCVAEGANMPSDLDAIKVYKENGVLYGLAKAANAGGVAVSALEMSQNSLRLSWTREEVDGRLKDIMANIFNTAKETAEKYDLGTDYLAGANIAAFEQIADSMIAQGLV

SEQ ID NO: 21713 - protein, 378 aa, Arabidopsis thaliana
MSSSTASATTGMKGKKPSIEIATSNPSLPEDLVVSCLARVSRLYYPTLSLVSKSFRSLIASPDLYKTRSLLGRTESCLYLCLRYSPEDNPRWFTLCRKPNRRTLSKEKNESSGNLLVPIPIINSPPLEWSSIVAVGSHLYAINGPIEDAPCSNVSFLDCRSHTWLEAPSMRVAHTNSQLDGKMYLAGSSENVDSLNCIQVFSTKTQTWKPVPFQKRIFGVGDLEGKIYTICRTECGQGVTIKPKDLTCDVVGFCGEKDWSSVCMIGNIVYFYRPNGEFLWIYSGKGESARRNLKGLEGLPKFDDYASVKLVDYGGKLMVLWDTYVPESESKEKMIWCAEISLQKKCNNEEIWGTVEWFDAVLTVPEDCKFVRAIAATV

SEQ ID NO: 21714 - protein, 205 aa, Oryza sativa
  misc_feature (191)..(191): Xaa can be any naturally occurring amino acid
  unsure (1)..(205): unsure at all Xaa locations
LNVAIRHNKSISRLSSLSFHTSSLVNSAAANTQQQQQSGPGHFGFYRQVELFYDRAAKILEEKLVADMTKTRLPDEEKLKKVRGILKIIKPCNHVLEIRFPIRRDNGELHMIEAYRAQHSQHRTPCKGGIRYSLDVNLDEVKALAALMTYKCACVDVPFGGGKAGVKINPKDWSEAELERITRRLTVELAXKGFIGPGIDVPAPD

SEQ ID NO: 21715 - protein, 160 aa, Oryza sativa
IVVVTTLAEVMAMAMRRVVLVAAVLCAVVAMVTAQEASNVRATYHYYRPAQNNWDLGAPAVSAYCATWDANKPLSWRQKYGWTAFCGPVGPRGQAACGKCLLVTNTATGAQITARIVDQCANGGLDLDWDTVFTKIDTDGQGYQKGHLIVNYKFVDCGDN

SEQ ID NO: 21716 - protein, 175 aa, Triticum aestivum
  misc_feature (132)..(132): Xaa can be any naturally occurring amino acid
  misc_feature (134)..(134): Xaa can be any naturally occurring amino acid
  unsure (1)..(175): unsure at all Xaa locations
MAPTVMASSGTSVAPFQGLNSTDGLPVSRRSNGASLGTVSNGGRIRCMQVWPIEGIKKFETLSYLRPIRTEALLKQVEYLIRSKWVPCLEFSKVGFIFREHNASPGYYDGRYWTMWKLPMFGCTDATQVINXCXEVKNEYPDAYVRIIGFDNMRQVQCVSFIAFKPPGCKESGKA

SEQ ID NO: 21717 - protein, 536 aa, Acidobacteria bacterium Ellin345
MYNPFAPMHPPRTKLYADPQGKLLHDLVFATAERSPEKIAIVDTSTTPPREVTYAEYADLVERMARGLIAADIRPQQVVAIYLPNCWEFCAAFHAISYAGAVSTLLNPSYREREVRYQLENSEAVALITDGPLIHEMDLKGLPALKNVFYTRTGAGAAEPFSKLLKDRANALPWREFDPLTTLACLPYSSGTTGLPKGVMLTHANLVVNVFQTLIPGEAGALTPDDRMLCFLPLYHIYGLTVALDMMLALGGTLVLMPRFDPRRSLELLIEQQITMAPCVPPVLLNWSQQAEEGRFPKDSSLRWVKSGAAPLAPELALRFTAQTGVQIRQGYGMTEASPVTHLGFLEPEWYRPTSIGYPAAQTECRILDEYGNEVAPGECGELVMRGPQFMRGYWKADAATASVLRDGWYWSGDVARRDDEGFYFIVDRRKEMIKYCGFAVAPAEVEGVLLEHPAVRDCGVIGRPDAEHGEIPMAFIILRNPQQESPQLAEDLKDFVAQRITRYKQPREIVFTDSIPRTASGKILRRELRQRLETS

SEQ ID NO: 21718 - protein, 167 aa, Yersinia pestis CO92
MAGQSIIVMGVSGSGKTTVGEAVARQIHAKFIDGDDLHPRANIQKMGSGQPLNDADRMPWLERLSDAAYSLSHKNETGIIVCSALKRCYRDRLREGNQGMVFLYLKGNFDVIMARLQARSGHFMPSDLLRSQFDALEEPGPDEPDVICVDIDTDIDEVVRRCVGALA

SEQ ID NO: 21719 - protein, 369 aa, Arabidopsis thaliana
MITVLRRGGADVTVASVETQVGVDACHGIKMVADTLLSDITDSVFDLIVLPGGLPGGETLKNCKSLENMVKKQDSDGRLNAAICCAPALALGTWGLLEGKKATGYPVFMEKLAATCATAVESRVQIDGRIVTSRGPGTTIEFSITLIEQLFGKEKADEVSSILLLRPNPGEEFTFTELNQTNWSFEDTPQILVPIAEESEEIEAIALVDILRRAKANVVIAAVGNSLEVEGSRKAKLVAEVLLDEVAEKSFDLIVLPGGLNGAQRFASCEKLVNMLRKQAEANKPYGGICASPAYVFEPNGLLKGKKATTHPVVSDKLSDKSHIEHRVVVDGNVITSRAPGTAMEFSLAIVEKFYGREKALQLGKATLV

SEQ ID NO: 21720 - protein, 494 aa, Sinorhizobium meliloti 1021
MQNLPKLSMYIDGQWVAPASGEYIETVDPFTARPWALVPRGNAEDADRAVRAAHRAFSQGPWGKMHPTERGRIIQRFAALIEEHADALADIEVRDNGRLLAEMTHQIRYIPRWYHYYAGFADKIEGTLHPCDKPALSFSRHEPLGVCVGIVPWNAPLLLFSLKAAPALAAGNTLVMKPAEFTSATALKLMELVEKAGFPTGVINVVTGYGPEVGEPLVTHPLTRHVGFTGSTKTGAHLYSLAAKDVKRVSLELGGKSPNIVFGDADLDNAVRGVVGGIFGAVGQTCIAGSRLLVHRSIHDEFLEKLAVFTKTARIGDPRKVETQIGPIANSMQFEKVLGYIDIARREGAELILGGGRPDLEECGTGYFIEPTIFAGVSNDMRIAREEVFGPVLSAIVFDEPEEALAIANDSEFGLGAGVWTSDMRLALKMSERLEAGSVWVNTYRDISYTTPFGGYKKSGIGRENGVAGIYEYLQTKAVWLSTAEEIANPFVIG

SEQ ID NO: 21721 - protein, 393 aa, Glycine max
MNISTTRKDFMIVNMGPHHPSMHGVLRLIVTLDGEDVIDCEPILGYLHRGMEKIAENRTIIQYLPYVTRWDYLATMFTEAITVNGPEQLGNIQVPKRASYIRVIMLELSRIASHLLWLGPFMADIGAQTPFFYIFRERELIYDLFEAATGMRMMHNFFRIGGVATDLPYGWVDKCYDFCDYFLTRIVEYQKLITRNPIFLERVEGVGVVDIKEVINWGLSGPMLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPGFINLQILPQLVKRMKLADIMTILGSIDIIMGEVDR

SEQ ID NO: 21722 - protein, 528 aa, Prochlorococcus marinus str. MIT 9312
MSQTSLKKERDPSILILDFGSQYSELIARRIRETNVFSLVVSNCISIEEINDINPKGIILSGGPNSVYEKNAPKCDEKIFNLGIPILGICYGMQLMVKELGGSVTSATKKAEYGRAPINIDQESELLSDVEDKSIMWMSHGDSINCLPDGFNKIAHTENTLHAAISNDRKKLFGVQFHPEVIHSEFGITVIKNFVYGISSCVADWTTETYIEETIPRIRDQVGNKKVLLALSGGVDSSTLAFLLNKAIGNQLTCMFIDQGFMRKGEPEFLMNFFDKKFHIKVEYINARERFISKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKLGAALGLPDEIIKRHPFPGPGLAIRILGEVNNEKLDCLRDADWIVRDEIKKAGLYNDIWQAFAVLLPVKTVGVMGDKRTYAWPIVLRCVSSEDGMTADWSKIPFPILERISNRIVNEVVSVNRVVYDITSKPPGTIEWE

SEQ ID NO: 21723 - protein, 549 aa, Porphyromonas gingivalis W83
MAKSALHLARMSYQPKMPASLQGAVKIIEGKATEAVSDKEEIAAIFPRTYGLPLISFAPGGERTEYPPTNVGVILSGGQAPGGHNVIAGLFDEMKLLNPDSRLFGFLMGPDGLIEHKYRELTAEVIDEYRNTGGFDMIGSGRTKLDKPEQFEAGLEILRELDIKALVIIGGDDSNTNACILAEYYASIDAGIQVIGCPKTIDGDLKNKQIETSFGFDTAAKVYSELIGNIQRDCNSARKYWHFIKLMGRSASHITLECALQTHPNICIVSEEVEANNYYLDDVVTYIAETVVRRSEAGMNFGTVLIPEGLIEFLPAMKRLIKELNEFLSQNDAEFKLIKRSAQRQYIKNKLSPENSRLYDSLPVDVARQLIADRDPHGNVQVSLIATEKLLADMTAQKLAEWAEEGRFQGRFSTLTHFFGYEGRCAMPSNFDANYCYCLGRAASILIAAGKTGYMAAIKNTADPVSEWEAGGVPMTMMMNMERRSGKMKPVIRKALVDMDGEPYRALREMRREWALSTEYVYPGPIQFFGPEHVCDSPTMTLRLEKNDR

SEQ ID NO: 21724 - protein, 342 aa, Bacillus anthracis str. Ames
MTRVAINGFGRIGRMVFRQAIKESAFEIVAINASYPSETLAHLIKYDTVHGKFDGTVEAFEDHLLVDGKMIRLLNNRDPKELPWTDLGVEVVIEATGKFNSKEKAILHVEAGAKKVILTAPGKNEDVTIVVGVNEDQLDITKHTVISNASCTTNCLAPVVKVLDEQFGIENGLMTTVHAYTNDQKNIDNPHKDLRRARACGQSIIPTTTGAAKALAKVLPHLNGKLHGMALRVPTPNVSLVDLVVDVKRDVTVEAINDAFKTVANGALKGIVEFSEEPLVSIDFNTNTHSAIIDGLSTMVMGDRKVKVLAWYDNEWGYSRRVVDLVTLVVDELAKQENVQHI

SEQ ID NO: 21725 - protein, 503 aa, Spinacia oleracea
MGRHSSRKIRFSACRIVAEKLDIDFSDPDWKTEYQKDLENTFNLPHLKDVLDVKPRPSTFSLMHRDGSRWLRNENVTDRAEGPEDRKNDYVDIDDRTLLKVIKYASPTSAGAECIDPNCTWVEQWVHRAGPRKEIYFEPTKVKAAIVTCGGLCPGLNDVIRQIFFTLERYGVQKIFGVRYGFRGFFDPELPMKKLSREHVQDINLEGGSLLGTSRGGASTSDIVDSIEAKEIDMVFILGGNGTHAGANAIHNECRKRKMKVSVICVPKTIDNDILLMDKTFGFDTAVEAAQRAINSAYIEAHSAYHGIGLVKLMGRSSGFIAMHASLASGQVDICLIPEVPFTLDGPNGVLSHLEHLIRTKGAAVVCVAEGAGQELLAAPDLKDLSGNAVLGDIGVHFKNQIKSYFNEKGIHADVKYIDPTYMVRSVRANASDAILCTVLGQNAVHGAFAGYSGITMGICNTHYVFLPITEVIHTPRAVNPNSRMWHRCLTSTGQPDFSPRNC

SEQ ID NO: 21726 - protein, 100 aa, Triticum aestivum
MTKKQRREAGARRQQQARQRLRPPPPLQARDERSVSCTTFNILAPIYKRMDSENGRESQNRANWFSRNEKIIDRLLGDRSSIICLQEVWLGNDELVNMYE

SEQ ID NO: 21727 - protein, 499 aa, Spinacia oleracea
MEPKIVTGEGGYALDDVPHFSDYLTNLPTYPNPLQTNPSYSVTKQYFVDFDDTVVQKAVQHKDGPRGIHFRRQGPRQKVYFKPDEVTACIVTCGGLCPGLNTVIRELVCGLDYMYGVKNILGIECGYKGFYARNTLPLTPKTVDSIHKRGGTILGTSRGGYVTSKIVDSIQDRGINQVYIIGGDGTQKGASVIYQEVRKRGLKVAVVGIPKTIDNDIPIIDKSFGFDTAVEEAQRVGNAAHTEAESVENGIGLVKLMGRDSGFIAMFATLASRDVDCCLIPESPFYLEGEGGLYEFIGRRLRENGHMVIVIAEGAGEKVEERDPSGNKAFKDVGLWLSFMIKEHFAKTKLNITLKYIDPTYMIRAVPANASDNVYCTILAQSAIHGAMAGYTGCTVGPVNGRQCYIPFYRVIEKPNKVVITDRMWARLLSSTNQPSFMHPPKGAIIEGKQDEVVLSESAAEESNENEKCTPTSTSLSIHDNHVDDQYSMSNGSSELLLK

SEQ ID NO: 21728 - protein, 853 aa, Ipomoea trifida
MRNAAEDHRYPLWFFLISQIFIGNLAVALAVDSITPTQPLAGNRTLVSSDGLFELGFFTPNGSDQSYVGIWYKEIEPKTVVWVGNRDGASRGSAGILKIGEDGNIHLVDGGGNFIWSPTNQSAARNTVAQLLDSGNFVLRREDDENPENYLWQSFDYPTDTLLPGMKLGWDSKTGLNRYISAWKSLNDPGEGPISFKLDINGLPEIFLRNRDKIVYRSGPWNGVRFSGVPEMKPTATITFSFVMTKNERYYSFELHNKTLYSRLLVTRNGNLERYAWIPTSKIWSKFWYAPKDQCDSYKECGTFGFCDTNMSPVCQCLVGFRPKSPQAWDLRDGSDGCVRYHELECRKDGFLTMNFMKLPDTSSSFVDTTMNLDECMKMCKNNCSCTAYTNSNISNGGSGCVIWTTELLDAAVRGGRRWPSCLHPRSASDVAQGGDSGDASGRTKRIIIACGIAVGVGILLFALSALFILKRRQSKRALGKNTELRGFRDRSQDLLMNAAVIPSKREYSGETMTDEFELPLFDFSTIVVATDNFADVNKLGQGGFGCVYKGMVEGEEIAVKRLSKNSGQGVEEFKNELRLIARLQHRNLVRLLGCCVDMEEKILIYEYMENKSLDSTLFNKQRSSLLNWQTRFNIICGIARGLLYLHQDSRFRIIHRDLKASNILLDKEMNPKISDFGMARIFGGDETDANNTKRVVGTYGYMSPEYAMDGLFSVKSDVFSFGVLVLEIVTGKKNRGFYNQNNQQNLLGHAWRLWRERRGSELLDSAIGESYSLCEVMRCIQVGLLCVQEQAEDRPNMATVVLMLGSESATLPQPKHPGFCLGSRPADMDSSTSNCDESCTVNQVTVTMLDGR

SEQ ID NO: 21729 - protein, 236 aa, Glycine max
EFLKGLSLLTSLRHENIVKMRGFCCSRSRGEWFFVCDFATRGNLSQYLDKEDGSAHVIEWSKRVSIIKGIAKGIGYLHNNEASKPTIVHQNISVEKVILDHEFNPLITDAGLPKLLADDVVFSALKASAAMGYLAPEYLTTGRFTEKSDIYAFGVIVLQVLSGKVLMGGTIRVAVEAFRFEDFVDTNLKGDYSKSEAAILSKLAIQCTLEVPEQRPTMVEVIQELTMLPNPSSHSS

SEQ ID NO: 21730 - protein, 127 aa, Trichodesmium erythraeum IMS101
MKAQEIISSIEAEEIEKLKQNSKKKIPLLYVGDTVKVGVKIIEGGKERVQPYEGTIIAMRNGGINETITVRRVFQGVGVERVFLLHSPRIANIKLIRRGKVRRAKLYYLRGRVGKATRVKQRFDRSL

SEQ ID NO: 21731 - protein, 325 aa, Trichodesmium erythraeum IMS101
MSINLSQTSEPKMNCIPRSFDVNAIENFYTTTFITKSGIENVFNHFVPRDSDIYVTTYPKSGTTWTMSILEHLVKKVSEKGISLGFSTEHFCPWLDRAASTENWRLIFSKFEKATSPRFFKSHASVGLIKQPARIIQCLRHPLDTFVSAWHHVRGKEEVFNYNGSWHHFFSKIALKGKFESSDWFDYHEEFLKASEEGKIEVLFLRYEEMKKDNAISAIHKLAEFIGVESYDAEEISRATNFTKMKEKSNQGHIEPDGSLSDMLVSQEVGDKNTPSKAHIRKGIVGDWKNYLSDSELNLWQNYVHIKKETCPRVIDFFSLEGLLC

SEQ ID NO: 21732 - protein, 185 aa, Zea mays
  misc_feature (16)..(16): Xaa can be any naturally occurring amino acid
  misc_feature (41)..(41): Xaa can be any naturally occurring amino acid
  misc_feature (46)..(46): Xaa can be any naturally occurring amino acid
  misc_feature (61)..(61): Xaa can be any naturally occurring amino acid
  misc_feature (69)..(69): Xaa can be any naturally occurring amino acid
  misc_feature (83)..(83): Xaa can be any naturally occurring amino acid
  misc_feature (135)..(135): Xaa can be any naturally occurring amino acid
  misc_feature (149)..(149): Xaa can be any naturally occurring amino acid
  misc_feature (164)..(164): Xaa can be any naturally occurring amino acid
  unsure (1)..(185): unsure at all Xaa locations
KCTRHREAISFARRIXAAPEAPVRQSLRRDAFRLRRGTGPXHCSPXRRVVDAGAAHSMTTXRGSFHLTXGKSEGNKDMNELRXGKGANLVDMASITLSVPAEFTVSTEASHQYQDAVCTLPAGLWPEIYYRLQWXEEYMGATLVDTQKXLMLFVRSGSRHVHAXMMDTVLNLLLNDRTGQRTGGQ

SEQ ID NO: 21733 - protein, 447 aa, Yersinia pestis CO92
MNGLVSLESFLESLQRRDANQPEYLQAVREVFTSLWPFLEQNPHYREQSLLERLVEPERVIQFRVAWTDDKGHVQVNRAWRVQFSSAIGPYKGGMRFHPSVNLSILKFLGFEQTFKNALTTLPMGGGKGGSDFNPKGKSQAEVMRFCQALMTELYRHLGPDTDVPAGDIGVGGREVAFMAGMMKKLSNNTACVFTGKGLSFGGSLIRPEATGYGLVYFTDAMLKRHGLGFEGRKVSVSGAGNVAQYTIEKAMELGAKVVTASDSGGTVVDEVGFTPEKLAHLAEIKNKRYGTIEDYARERNLVYLAGQQPWSVPVDIALPCATQNELDLPAALQLIANGVKAVAEGANMPTTIQATDAFLEAGVLFAPGKAANAGGVATSGLEMAQNAARMSWKSEKVDVRLHHIMLDIHQSCVEYGGEGKQTHYVHGANIAGFVKVADAMLAQGVL

SEQ ID NO: 21734 - protein, 551 aa, Gloeobacter violaceus PCC 7421
MTSSPTAAARTEGEAAPTVPTQVESGTAQRPGLAREMVAILDFGSQYSELIARRIRETKVYSEVLSYQTPIAEIRRLAPKGIILSGGPNSVYEAYAPQCDPALWELGIPILGVCYGMQLMVQQLGGAVERAERAEYGKASLFINDPTDLFTNVEDGTTMWMSHADSVLRMPEGFELLAHTENTPCAAIAHHSRHLYGVQFHPEVVHSRGGMALLRNFVYHICGCEPEWTTAAFIEEAIREVRARVGDKRVLLALSGGVDSSTLAFLLHRAIGDNLTCMFIDQGFMRKNEPERLVKLFKEQFHIPVAYVDAAERFIVRLEGVSDPEQKRKIIGAEFIRVFESESQRLGPFDYLAQGTLYPDIIESAGENIDPKTGERVAVKIKSHHNVGGLPENLRFKLVEPLKRLFKDEVRQVGRALGLPEEIVQRQPFPGPGLAIRVLGELTKDKVDILREADFILRQEVNRSGRYNDYWQSFAVLLPVKTVGVMGDRRTYAYALALRFVTSEDGMTADWARVPYDLLEQIANRIVNEVPGINRVVLDITSKPPGTIEWE

SEQ ID NO: 21735 - protein, 938 aa, Porphyromonas gingivalis W83
MVREAKNLRARTKKISLHICRKHAPQSEDFRCVFLRQQVIDRDIEAMAKPYDFYIVWKLSYNHVFTIHPRHTILELPPVYPDTALVPFFIMRFSFFDHMISCEYIFHRKLFVCLHRKNKQKQKSNMRYVIVGGVAGGATAAARLRRIDEKAEIILFEKGQNISYANCGLPYYIGGVIKERENLFVQTPEKFGRLLNLDVRVQSEVLSIDRSDKQIRVREANGREYSEHYDKLLLSPGALPFVPPLPGVDSPGVFTLRNVEDTDAIKSYLDTHKVKRAIVVGGGFIGLEMAENLHARGIAVNVIEMAPQVMAPVDFSMATIVHAHLQEKGIGLYLGKAVKSIEKRGEVLTASLDSGEKIEAELILLSIGVRPNTKLAADAQLAIGPARGIRVNEYLQTSDPDIYAIGDAIEYPHPLTGKPWTNFLAGPANRQGRIVADNMHGQTLRSYEGAIGTAIAKIFDLTVAATGLPAKALKREGLPYESVTVQPNSHAGYYPNAYPLTLKITFHPESGMLYGAQCVGIEGVDKRIDSIAQIIKRKGGIADLMQTEQAYAPPFSSAKDPVALAGYVADNIITGRMKPLHWREMKEVDPNRVTLIDARPRQAYEVEHIPGAISMPVEEIRARIGEIPHDKPIYVYCAVGMRGYFASNILRQCGFSNVRNLIGGYRLYSTITADYSSAGQPATAQLPAKDSPSSHTQVPEVDACGMSCPGPILKLKQSIDQIAVGEQLCILATDPGFARDAQAWCDTTGHNLIRQETIKGKYKVTIEKTACKEEGTCVNETPSKGKTFILFSDDLDKALATFVLANGAAAMGQPVTIFFTFWGLNAIKKPHAVKAKKDIWGKMFGMMLPKNSKGLGLSKMNMFGLGAKMMRMVMKEKHVDSLESMRKQALENGVEFIACQMSMDVMGINREELLDEVSIGGVATYMNRAEEANINLFI

SEQ ID NO: 21736 - protein, 152 aa, Prochlorococcus marinus str. MIT 9312
MTKERTFIAIKPDGVQRGYVSEIIGRFEKKGFKLVGLKQLIPSKDLAQNHYGVHRERPFFGDLVDFISSGPVVAMVWEGEGVILSARKLIGATKPLEAEPGTIRGDLAIDIGRNIIHGSDGEDTAKFEIDLWFNEEELCEWYTSDSKWRSEN

SEQ ID NO: 21737 - protein, 346 aa, Triticum aestivum
PSEQVCTKKQVATGPEFPGYRRPTRPFMFCDPQLRGLKITGRTVWRNPHGYIPGKMAPMMTFFGFMSLAYLALGLLWFLQFVRCWKDILQLHYHITAVIALGMCEMAFWYFEYANFNSTGTRPMGITLWAVTFTAVKKTVSRVLLLVVSMGYGVVRPTLGGITYRVAALAIIYFTASEALELVENLGNINDFSGKTRLFLVLPVAILDATFIIWIFSSLSRTLEKLQLRRSMAKLELYRKFTNSLAMSVVISIAWIGYELYFNATDPLSELWRRAWVIPAFWNVLSYVLLAIICTLWSPSRNPTGFAYSEETGDEADEEGLSLVGSAVKGTGDIVNMHVFTEDKRA

SEQ ID NO: 21738 - protein, 270 aa, Oryza sativa (japonica cultivar-group)
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGGMTVNGLYPS

SEQ ID NO: 21739 - protein, 388 aa, Brassica napus
GIKSKGIRPDLIGVDPRVRASKWLPDLSGNVSAITTPPPTESVTASVMKKRFFVETLIGILPPEKDSVPCNFLLRLLRTAKMVGANANYLTELENRVAWQLDQASLKELMIPSFSHTSGTLLDVELVTRLVKKFVGLDSEGVKTGAALVKVAKLVDSYLAEAALDGGLTLPEFISLIEALPSYARTTEDGLYRAIDTYLKAHPQVLKQERKELCRLIDSRKLSPEAALHAAQNDRLPVRSIIRVLFTEQTKLSRHVDWSGSLTRSPTNPSGSHYFEQGGSGARCLSKREMNVQQAEIKRLREDVARLQSECSAMHLQVERLLEKKSGGSKGFFRWKRLGLVPSIRGSVSVEEMTNCENGEGFEPQTPGNMKTRLVKGRTPSRWRKSMS

SEQ ID NO: 21740 - protein, 556 aa, Oryza sativa
  misc_feature (395)..(395): Xaa can be any naturally occurring amino acid
  misc_feature (409)..(409): Xaa can be any naturally occurring amino acid
  unsure (1)..(556): unsure at all Xaa locations
MGGYEYATNGYHRGMEDDYEDEYYSEDPYDEEGEGAGQEYAEEDDEPPEGQQEFLQIRERLKEQIRRKAQAASASAAGRSSSSHDRKPQSTFGSFFGPSKPVISQRVIEERKSLKELQNTASMSRDRRPSAKEIPSSSKVQSKTNGHHHKQKIVNEAKRKAEALKDNRDYSFLLSDDADISPSPMEKPVARSSLSQKSDRESTHSAVKSRAPTGQTARLSNGYGLKNTSSSQRHTEGRVDSNRKVAGANRERVVLPDNGRMHSVVRNGSTQATTSKAASQKLPSKAPIANRPPIKSVSDQSLRANHSASKQLLSQNGRPQSSQSQRMQSTSHGQRPHQPVQSQWPLQSLQGRRPQQSPQNTRPQLMSKSQRPQQSLQRQRPQLSSQNERLESSEXQRPPSQSYRPQSSXQGQRPSSVQGRQYSEQRRIQANDRVKSAERQIRPPSKPMPSRQIPSNGMRDAHAKKKQPMKRRFNDLSEDEEDPLAMIRSMFRYDPSKYAGRDDDDSDMEADFATIEMEEQRSARIAKEEDDEQLRLIEEEERREQERKRRKMARGR

SEQ ID NO: 21741 - protein, 307 aa, Triticum aestivum
MAFLQKVGNALKRSAGSGSAMLQAVRSMSSSKVFVGGISYGTDDQSLADAFSNYGQVVESKVIMDRESGRSRGFGFVTYTSAEEAGAAITGMDGKDLQGRIVRVSYAHDRGSRPSFGGGGGYGGGGGGYGGGDGGYGGAGGAYGGGGGYSGGGGYGGGGRGGGYNSGGNYNSGYNSGGNYGAPQGGQGGYGGDAGFTGVGGGGYDAAPANNYGGDSLNQGGGAPPAFGGGNYGVGNDSYANDAPVDLPPGKLNDLLKDLKFDVGGKEDGAGEDAGLVDADIKRSEGQDDFLDDDFSKDEDDYANKRS

SEQ ID NO: 21742 - protein, 213 aa, Candida maltosa
DQSLNILLAGRDTTAGLLSFAVFELGRNPEVWSKLRQEIGDKFGLDSDSRIEDISFELLKLCEYLKAVINETLRLYPSVPRNGRFAAADTTLPHGGGKDGMSPILVRKGQTVMYSVYALQRDEKYYGKDANEFRPERWFEPEVRKLGWAFLPFNGGPRICLGQQFALTEASYVLVRLIQSFETLELSPEAAYPPAKLTHLTMCLFDGAPVRIE

SEQ ID NO: 21743 - protein, 389 aa, Bacillus sp.
STHFDVIVVGAGSMGMAAGYQLAKQGVKTLLVDAFDPPHTNGSHHGDTRIIRHAYGEGREYVPLALRSQELWYELEKETHHKIFTKTGVLVFGPKGESAFVAETMEAAKEHSLTVDLLEGDEINKRWPGITVPENYNAIFEPNSGVLFSENCIRAYRELAEARGAKVLTHTRVEDFDISPDSVKIETANGSYTADKLIVSMGAWNSKLLSKLNLDIPLQPYRQVVGFFESDESKYSNDIDFPGFMVEVPNGIYYGFPSFGGCGLKLGYNTFGQKIDPDTINREFGVYPEDESNLRAFLEEYMPGANGELKRGAVCMYTKTLDEHFIIDLHPEHSNVVIAAGFSGHGFKFSSGVGEVLSQLALTGKTEHDISIFSINRPALKESLQKTTI

SEQ ID NO: 21744 - protein, 244 aa, Brassica napus
  misc_feature (227)..(227): Xaa can be any naturally occurring amino acid
  misc_feature (238)..(238): Xaa can be any naturally occurring amino acid
  unsure (1)..(244): unsure at all Xaa locations
ERFMTAEPPEVVEARNDNSHGTNFVDSPEPIYGTQFLPRKFKIAVTVPTDNSVDLLTNDIGLVVVSDENGEPQGFNIYVGGGMGRTHRMESTFARIAEPLGYVPKEDILYAVKAIVVTQREHGRRDDRKYSRMKYLLSSWGIEKFRDVVEQYYGKKFEASRDLPEWEFKSYLGWHEQGDGAWFCGLHVDSGRVGGNMKKTLREVIEKYKLDVRITPNQNIVLCDIRXEWKRPITTVLXQAGLLQ

SEQ ID NO: 21745 - protein, 524 aa, Triticum aestivum
  misc_feature (478)..(478): Xaa can be any naturally occurring amino acid
  unsure (1)..(524): unsure at all Xaa locations
MALLLRHSRKLRRVHGVLDCERGSIARHFSVAAAKEDAVTSSSVHGEYGKKVGRSSIFLDRQSEKDLHTFKVSTREARGSYSSKRMPIAATGVNSLFSCGQVVSARHFSSGADLPPHEAIGMPSLSPTMTEGNIARWVKKEGDKVSPGEVLCEVETDKATVEMECMEEGYLAKIVCGDGAKEIKVGEIIAITVEEEGDIEKFKDYKASSSPSAESKPQSEPVEPKEEKKEVSKAPEPTATKTEESSQSGDRLFSSPVARKLAEDNNVPLSSLKASAAKGSKKEAAAAPGLGYVDLPNTQIRKVTANRLLQSKQTIPHYYLTVDSRVDKLIKLRSELNPDAGCILVGKKISINDLVIKAAALALRKVPACNSSWMNDFIRQYHNVNINVAVQTEHGLFVPVVRDADKKGLATIADEVKQLASRAKDNSLKPEDYEGGTFTVSNLGGPFGIKQFCAIVNPPQSAILAIGSAEKRVIPRGXAEGQYEIGSFMSATLSCDHRVIDGAMGAEWLKAFKGYLEDPTTMLL

SEQ ID NO: 21746 - protein, 209 aa, Oryza sativa (japonica cultivar-group)
MAAAAAADSTSAVPPAVVSAAEDTLAAAESVGDHLAEMVAAAGEDPDAIAELPPLRRARAFLAMAKAAASLFAGRQLSRCSGVDPDEHPIKKEFERLSLWEEKLNRFEDWDKAPLRPTTTVNTQAAARFIGHSLPHLTTDQKRSMQAISRGEGGSYSGNKRKPQPPRPNKKSVRAATEEFLAKAALELSGHNDSKVKGPIRLLSDEDED

SEQ ID NO: 21747 - protein, 604 aa, Arabidopsis thaliana
MDEVMTAADVGSLGGGNRALYGSPPSHNLFPHNLPIFSAFLAFALAQFLKVFTNWYKEKRWDSKRMISSGGMPSSHSATVTALAVAIGFEEGAGAPAFAIAVVLACVVMYDASGVRLHAGRQAELLNQIVCEFPPEHPLSTVRPLRELLGHTPIQDMKSHLDNIYEKNKVVNLLKSPSIFRTTMLKFTLVIVMYPSSFTEQPTSNSFHEQYIRLLREHSLSRRKKQADKKMGCFGPSKASRTRNNEHDKMTRQNPSHQPQTMRAEEVLLQIPRCRVHLIGESEAVELASGDFKLVKVSDNGVTLAMIVRIGHDLQWPVIRDEPVVKLDARDYLFTLPVKDGDPLSYGVTFSGDDRDVALVNSLKLLDQFLSENSCFSSTASSKVNNGIDWQEFAPRIEDYNNVVAKAIAGGTGHIIRGIFSLSNAYSNQVHKGGDIMITKAEESQRNGSYNNGNSSGNEKKNGINTHLQRVRKLSKATENLSKTMLNGAGVVSGSVMVPMMKSKPGMAFFSMVPGEVLLASLDALNKILDATEAAERQTLSATSRAATRMVSERFGDNAGEATGDVLATAGHAAGTAWNVLKIRKTFYPSSSLTSGIVKNAPRK

SEQ ID NO: 21748 - protein, 389 aa, Trichodesmium erythraeum IMS101
MAKNLLEQLRKVTIVVADTGDIQAIEKFQPRDATTNPSLITAAAQMPQYQEIVDETLKTARQELGTDATASDVANLAFKRLAVAFGLKILQIVPGRVSTEVDARLSYDTEATIAQGRDLIAQYEEAGVSRDRILIKIASTWEGIKAAEVLEKEGIHCNLTLLFGLHQAIACAEAGATLISPFVGRILDWYKKETGRDSYPPAEDPGVLSVTKVYNYYKKFGYKTEVMGASFRNTGEITELAGCDLLTISPGLLGELESTIGELPTKLSDEKAAQSDAEKILMDKETFDQMHAEDRMASQKLDEGIKGFSKALESLEKLLAERLTRLEGVTHAAEDIFYIYDLDGDGFITREEWAGSDAVFDALDINKDGKISPAEMASGLGAVFELAKV

SEQ ID NO: 21749 - protein, 327 aa, x Doritaenopsis sp.
MESGSFPVINMELLQGSQRPAAMALLRDACENWGLYELLNHGISHELMNRVETVNKEHYRRFREQRFKEFASKTLDTVENVEPENLDWESTFFLRHLPTSNISQIPDLDDDCRSTMKEFALELENLAERLLDLLCEDLGLEKGYLKKVFCGGSDGLPTFGTKVSNYPPCPKPELIKGLRAHTDAGGIILLFQDDKVSGLQLLKDGEWIDVPPVRHSIVVNIGDQLEVITNGKYKSVLHRVVAQTDGNRMSIASFYNPGSDAVIFPAPALVEKEAEEKEEKKKEIYPKFVFQDYMNLYIRKKFEAKEPRFEAMKSMEIVMSSQPIPTA

SEQ ID NO: 21750 - protein, 113 aa, Oryza sativa (japonica cultivar-group)
MGCAGSTPKVDENSKKLKKPKPWKHTQAITPTQLSKMREEFWDTAPHYGGQKEIWDALRAAAEAELPLAQTIVNSAGIVVSNSDMTLCYDERGAKYELPKYVLSEPTNLIREP

SEQ ID NO: 21751 - protein, 338 aa, Borrelia garinii PBi
MKVLGIETSCDDCCIAVVENGIHILSNIKLNQKEHKKYYGVVPEIASRLHTEAIMSVCIKALKKANTKISEIDLIAVTSRPGLIGSLIVGLNFAKGLAISLKKPIICIDHILAHLYAPLMSSKIEYPFISLLLSGGHTLIAKQKNFDDVEILGKTLDDSCGEAFDKVAKHYNMGFPGGPNIEQISKNGDENTFKFPVTTFRKKENWYDFSYSGLKTACIHQLEKFKSKDNPTTKNNIAASFQKAAFENLITPLRRAIKDTQINKLVIAGGVASNLYLREKINKLKIQTYYPPLDLCTDNGAMIAGLGFNMYLKYGESPIETDVNSRIENYKNQYRRRK

SEQ ID NO: 21752 - protein, 612 aa, Zea mays
  misc_feature (54)..(54): Xaa can be any naturally occurring amino acid
  misc_feature (278)..(278): Xaa can be any naturally occurring amino acid
  misc_feature (294)..(294): Xaa can be any naturally occurring amino acid
  unsure (1)..(612): unsure at all Xaa locations
MGGFEDDEPPSKRARASSVESASLPDCFLFSKSANPLGRTIARLLPFGKYNGLXPLPSQGKEVMVGSKGVIKKEEFVRIITKTLYSLGYEKSGAVLEEESGIILHNPMVKLFREQVIDGNWDNAVVTMNTIGLQDENILKSAAFLILEQKFFELLKNDNVMGAMKTLRCEITPLGVNRKRVHELSTCMISCSSQQLFLGFSKLGIDSSSSRLKLLEELQKVLPPAVMVPERRLENLVERALTVQRDACYFHNSVDGLSLYIDHHCGKDQIPSCTLQVXLRAHHDEVWFIQFSNXNGKYLASASNDKSAIIWEVDEDGELLLRHTLSGHQKSVMMVAWSSDDCQLLTCGQEEAIRRWDVKSGKCLHVYEHPGIGLRSCAWFRDGKQILSGLADQTFCIWDLDGKEVDCWKGQRSATTSDFAVAKDGNLIISLSRDNAILLFDRETKHERIIEEGSTITSFSLSEDGDFLLVNLVSEEIHLWNIRNDPVRVNRYNGHKHSRFVIRSCFGGSEQAFIASGSEDSQVYIWHRATGDLIETLAGHSGTVNCVSWNPVNPHMLASASDDHTVRIWGAKVSLKRKDVGSSNCNSNGFHHSNGNAHGNGFAHQCNGNSTK

SEQ ID NO: 21753 - protein, 319 aa, Bacillus anthracis str. Ames
MKRIGVLTSGGDSPGMNAAIRAVVRKAIFHDIEVYGIYHGYAGLISGHIEKLELGSVGDIIHRGGTKLYTARCPEFKDPEVRLKGIEQLKKHGIEGLVVIGGDGSYQGAKKLTEQGFPCVGVPGTIDNDIPGTDFTIGFDTALNTVIDAIDKIRDTATSHERTYVIEVMGRHAGDIALWAGLADGAETILIPEEEYDMEDVIARLKRGSERGKKHSIIVVAEGVGSAIDIGKHIEEATNFDTRVTVLGHVQRGGSPSAQDRVLASRLGARAVELLIAGKGGRCVGIQDNKLVDHDIIEALAQKHTIDKDMYQLSKELSI

SEQ ID NO: 21754 - protein, 178 aa, Triticum aestivum
  misc_feature (46)..(46): Xaa can be any naturally occurring amino acid
  misc_feature (69)..(69): Xaa can be any naturally occurring amino acid
  misc_feature (100)..(100): Xaa can be any naturally occurring amino acid
  misc_feature (159)..(159): Xaa can be any naturally occurring amino acid
  unsure (1)..(178): unsure at all Xaa locations
MLEDFEDETDLNLVFGNVGSWAAQLITEAGGEVVSIRDVTGAVKNXNGIDVAKLMKHSAENRRIKGSDXGDAVDPTSLLTEECDVLIPAALGGVINNKAXYIIEAKYIIEAANHPTNPEAEEILAKKGVLILPDILAKLRGVMVSYFKWWVQNIQGVMXDKEKVNSGVKKYITRALKH

SEQ ID NO: 21755 - protein, 702 aa, Bifidobacterium breve
MTEFKETELDERAIKMAKALSADAVENAGSGHPGSPVSLAPIAYTLYQHFIKHDPNDPNWEGRDRFILSGGHASLTQYVQLYFSGYGLTLDDLKHFRGGADTRTPGHPEYGLTPGIEMTTGPLGQGFASAIGFAYGERFQRGLLDPETPKEDSPFYHKIWAICGEGDIEEGISGEAAALAANQKLGNVTVIFDANRIQIEGDTNLVLAEDVLKRFQAYGWYTDEFSFIQPDGSYKEDVEGLADVIAKAEAAAPDQPKLIKVDTLIAWPTPGKTNDPSSHGSKLGAEAVAGLKEVLGYDPAENFHVDEEALAHARKVAERGLEAHKEWDEKFDAWRKANPDKAALYDRIKAGELPEGFDKAIDDLEATFEVGKGVATRGASGSVLNAIAAVMPELWGGSADLGGSNKTDLKGAATFAPAECATKQWPVCNEFGRQLHFGVREFTMGCITNGILLGSHTRPFGGTFFMFSDYERSAVRLAALMEIPNLYVWTHDSVAVGEDGPTHQPVEHLASFRAIPQLEVVRPADAFETAEAYRYFFEKKNTLPAAMVLSRQGVPVLAETAAKAKDGVRKGAYVLVDTEGTPDVILMATGSEVQLAVKAAKTLAEEGVKARVVSVPSLEWFEEQDAEYKEAVLPAGVKARVSVEAGVAMPWYKYLGSYGKPVSIEQFGLQGDGAQNLIDLGITAEHVVEAAKASIAEVEAAK

SEQ ID NO: 21756 - protein, 509 aa, Candidatus Desulfococcus oleovorans Hxd3
MILIIDFGSQFNQLIARRVRENKVYCQIEPPTITISRIRALAPEGIILSGGPSGIYEKHSPKVTKAVFDLGVPVLGICYGMQFMVGALGGAVHAATKREYGFAELAVKAQAKIFKGVGKKTTCWMSHGDSAETVPPGFKIIGSTENTKIAAIADTRRKFYGLQFHPEVAHTAEGTTMIANFLFDICKCRPTWSMAAFAEETIAEIRERVGEKRVILGLSGGVDSSVAALLIHHAIGRQLTCIFVDNGLLRKDEAKKLKAVFAEKLQLNIRFVNAAGRFLKALAGVADPEKKRKIIGKIFMDVFEAEAKKIKGADFLAQGTLYPDVIESQSAFGGPTSIIKSHHNVGGLPAKMKLSLIEPLRFLFKDEVRLLGKTLGLDDDMVHRQPFPGPGLAIRIIGKVDRRQLTLLREVDAILLEEIRKAGYYRKLWQSFAVLLPLKSVGIMGDKRTYENIAAIRAVTSVDAMTADWARLPHDLMGRISNRIINEVKGVNRVVYDISSKPPSTIEWE

SEQ ID NO: 21757 - protein, 402 aa, Bacillus anthracis str. Ames
MHKVHQGKLETVSKVKVENAKDLSLAYSPGVAEPCKEIYDDKSKVYEYTMKGNMVAVVTDGTAVLGLGNIGPEASLPVMEGKAVLFKSFAGVDAFPIALNTNDVDKIVETVKLMEPTFGGVNLEDIAAPNCFIIEERLKKETNIPIFHDDQHGTAIVTVAGLVNALKLVGKKMSDIKVVANGAGAAGIAIIKLLYRYGVRDIIMCDRKGAIYEGRPTGMNPVKDEVAKYTNKNRIEGSLADVVQGADVFIGVSAEGALTEEMVRTMNDDAIIFAMANPVPEIMPELAKAAGAAVVGTGRSDFANQVNNVLAFPGIFRGALDVHATQINEEMKMAAVQAIAELVAEDELNADYIIPAPFDARVAPQVAAYVAKAAMETGVARRQVDPNEVAEKTKQLALIGKE

SEQ ID NO: 21758 - protein, 479 aa, Klebsiella pneumoniae
MTAPVQHPMYIDGQFEPGRGDAWIDVINPATEALLSRIPDGSAEDARRAILAAERAQPGWEALPAIERARWLRKIAAGIRERAEEIAALIVAEGGKIQQLAAVEVSFTADYLDYMAEWARRYEGEIVQSDRTGENILVFKRALGVTTGILPWNFPFFLIARKLAPALITGNTIVIKPSEFTPNNAIAFAQIVHDIGLPKGVFNLVLGRGETVGQELASNPKVAMVSMTGSVAAGEKIMAAAAKNITKVCLELGGKAPAIVMDDADLELAVKAVVDSRVINSGQVCNCVERVYVQKGIYDRFVNRLGEALKAVQFGDPASRDDIAMGPLINAAALARVEQKVAKAVAQGARVALGGKAVTGRGYFYPPTLLLDVRQEMDIVHEETFGPVLPVVAFDTLEEALAMANDSDYGLTSSIYTRDLNVAMKAIKGLKFGETYINRENFEAMQGFHAGWRKSGVGGADGRHGLNEYLQTQVVYLQA

SEQ ID NO: 21759 - protein, 381 aa, Bifidobacterium breve
MADYYETLGIDRNASDDEIKKAYRKLSRKYHPDIAGPEFEDKFKEVNNAYDVLSNPDKRRMYDSGVDPNDPNAGAGGFSGAGFGDMGDVFSTFFGSAFGGGSQGPVPRTQPGRDALASASIDLKTAVFGGTAHVKINTFSLCQECGGSGAQGGAQPVTCPDCHGQGFMQKVVRTMLGQMMTSAPCERCEGHGTIIQNPCPSCMGHGRVRTTRNVGVTVPAGINDNARLRLANQGEVGEGGGAAGDLYIDIRIKADKQFTRDGDDLHCWIQVPMSWAVLGHDLSIDTFDGEQTVSIPAGCQPEDTVTLKGLGVTNIRNKDERGNLVAHVNVLIPTKLSESERGLIEQFAASHDSDATHVSQASRPQTGQKKGFFSKLKDVLS

SEQ ID NO: 21760 - protein, 350 aa, Bacteroides thetaiotaomicron VPI-5482
MLAYTYIEHGKFELREKPEPKITDARDAIVRVTLGSICTSDLHIKHGSVPRAVPGITVGHEMVGVVEEVGAEVTSVRPGDRVTVNVETFCGECFFCHHGYVNNCTDPNGGWALGCRIDGGQAEYVRVPYADQGLNRIPDTVSDEQALFVGDVLATGFWATRISEITEKDTILLIGAGPTGICTLLCSMLKNPKRIIVCEKSPERIQFVREHYPDVLITTPENCKEFVLQNSDHSGADVVLEVAGTEDSFRMAWDCARPNAIVTIVALYDKPLLFPLPEMYGKNLTFKTGGVDGCDCAEILSLIEEGKIDTTPLITHRCSLNEIEEAYRIFENKLDGVIKVAIVCQTESNK

SEQ ID NO: 21761 - protein, 369 aa, Oryza sativa
  misc_feature (275)..(275): Xaa can be any naturally occurring amino acid
  unsure (1)..(369): unsure at all Xaa locations
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQIVHPGDLCFKLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVAXALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 21762 - protein, 193 aa, Vibrio fischeri ES114
MENNQVTKHVAVLLADGFEEGEAVVFIDIMRRLDIKVDVLSCMETTALETYFETRISADYTLKDKKDVLYDAVMMPGGPKGTDNLSANSMVIDFLKCHIEKDKYICALCSSGAKVLAANHLLNGRNYTTGGGLEKKFTDGCFQDKKVVVDGKFISGKGLGVSFEFAFTVAKYLLFDNVEKVEWQAQHIYFDHF

SEQ ID NO: 21763 - protein, 252 aa, Paraboea crassifolia
MADYQHHELKSEEPYAPTPVKIEEIDQPVEASDRGLFDFIGKKKDEEEEKKCDEGKFASEFDDKVQICDEKKEEPKFEVYEDPKLEVSEEPKEEEKKHESLLEKLHRSNSSSSSSSDEEEVEEGGEKKKKKKGLKDKVKEKITGDKKEEAAETKCEETSVPVEKYDEIHTLEPEEKKGFLDKIKEKLPGGKKTEEVYAPPPPKEDVAEYSTAPEAEGKEKKGFLDKIKEKLPGYHPKAEEEKEKEKREEACH

SEQ ID NO: 21764 - protein, 511 aa, Streptomyces coelicolor A3(2)
MSTPEPVLAGPGILLVLDGWGSADAADDNALSLARTPVLDELVAQHPSTLAEASGEAVGLLPGTVGNSEIGHMVIGAGRPLPYDSLLVQQAIDSGALRSHPRLDAVLNEVAATSGALHLIGLCSDGQIHAHVEHLSELLAAAATHQVERVFIHAITDGRDVADHTGEAYLTRVAELAAAAGTGQIATVIGRGYAMDKAGDLDLTERAVALVADGRGSPADSAHSAVHSSERGDEWVPASVLTEAGDARVADGDAVLWFNFRSDRIQQFADRLHEHLTASGRTVNMVSLAQYDTRTAIPALVKRADASGGLADELQEAGLRSVRIAETEKFEHVTYYINGRDATVRDGEEHVRITGEGKADYVAHPHMNLDRVTDAVVEAAGRVDVDLVIANLANIDVVGHTGNLAATVTACEATDAAVDQILQAARNSGRWVVAVGDHGNAERMTKQAPDGSVRPYGGHTTNPVPLVIVPNRTDTPAPTLPGTATLADVAPTILHLLGHKPGPAMTGRPLL

SEQ ID NO: 21765 - protein, 390 aa, Trichodesmium erythraeum IMS101
MKLAARVGKVPLSLTLAISAKARAMKADGKDVCSFSAGEPDFDTPEHIKVAAQKALDSGYTKYGPAAGEPKLREAIAHKLSQENGLNYKAENIIVTNGGKHSLFNLMLALIEPGDEVIIPAPYWLSYPEMVKLAGGEPIILTTDPETGYKVTPEQLRQSITDKTKLFVLNSPSNPTGMVYQPAEIKALAEVLVEKDILVVSDEIYEKIIYDDAEHLSIGAVNSEIFKNTIISNGFAKAYSMTGWRIGYLAAPVELINATVKIQGHSTSNVCTFAQYGAIAALESSQDCVEQMRQAFAKRRKIIYDLLKTLPGISCNQPEGAFYMFVNISKISSSSLEFCNALLEDQNVAVIPGIAFGADDHIRISYATDLETIEKGMDRLERFIRSQSSG

SEQ ID NO: 21766 - protein, 776 aa, Streptomyces coelicolor A3(2)
MTPDKTVATACQFCNSNCRLNVDLKAGRVLAVRGEDSDPVQQGQVCVKAELMPQLVYNTERLTRPLRRVSGAKGSPHSKFEAVSWEEALHTIAKKFLALRDAGQAHTIANRTTGRMPRGTGSLVARMFAMLGSPNNTDVGPVCNDAGGNALAMTFGLGNFTNGYGTDGSTGKDDLGSARHYLFLGTNQAETHPVTFDYLLRGRKENNATLTVVDPRLTPTGAAADRWVAPKPHTDLALLLAMLHHIVQEKLYDKAFVKRWVAGFDELRRHLAKHQYTPEWAAKVTGVKADVITKMAVEYAKAKPAAIFCNAGISHQLGAFDTYRVATFLAAVTGNIGQPGGGCNFMHNTWPGDLQLPPLDADLPERREALPVGPDYFAESILTDNPYRLRAVVTQGNPLVSSANTTKVKKAFEQLDFYVYTGLFMEEAAYYADIILPVCSGLEMEGVYMRRDDRAIRWQDQAVDRVGESRPDWEIWVGLAHALAELDSRRPAAEWRAAFPERWMNYRELWDAFVTHTPGVGGMTRARMRQRTEPLRWPCPTEDHPGVSTLYLDHPSWYQAAESLDPANRGKRFLTPSGKVEISTPDLEKKLAVTGHSALPIFYTHPEVTGRNPTLSYSRKFVTNPINPQAVTHPVRLGVPGSDAVHHDFPLMGMTGRPSVVHFAEVTHWTPTGKQLNGIRFIQIHPDTARRSGIADGDEVTVESPRGSVTGTALLWEGIRADTVFVPNTFGPAQKQGDLFDDPRYEAANTLPDDRFYDNLSGQQAFKCFACRVVKA

SEQ ID NO: 21767 - protein, 176 aa, Borrelia garinii PBi
MKNKTEYYDQFIAKVPDFPKKGVLFYDITSVLLKPEVYTSLINEAYSFYNLKKIDCIAVVESRGYLIGAPLSLKMQLPLVLIRKEGKLPREVFGEEYELEYGFGKIEVHKDDVRMYSNILLIDDILATGGTLKSSAILLERAGGRVKDIFCFIELCGINGRRILEDYDVNSLVRYN

SEQ ID NO: 21768 - protein, 323 aa, Gibberella zeae PH-1
MDAILEILDPYVFDYGYAYLFPQQTTQPSYGNSTGFAPSSASKNFDDEYSLNFGSSLPRDDIYRQSASILMIAGFGAAFIYVISAALSYYFVFDRRLEHHPRFLKNQIKQEIQSSFFAIPIIDLLTLPFFLGEVRGHSLLYTNIDEYGWSWLAISTILYMVFNDLGIYWIHRLEHHPSIYKYVHKPHHKWIVPTPWAAIAFHPVDGYVQSVPYHVFVYLCPMQKHLYMFLFVCVQIWTILIHDGDMITGHWLERFINSPAHHTLHHMYFTCNYGQYFTWADNYWGSHRAPMPELDPIHEAIRVMQEKGLADKDGNPIEKSKSE

SEQ ID NO: 21769 - protein, 528 aa, Glycine max
  misc_feature (176)..(177): Xaa can be any naturally occurring amino acid
  misc_feature (208)..(208): Xaa can be any naturally occurring amino acid
  misc_feature (211)..(212): Xaa can be any naturally occurring amino acid
  misc_feature (235)..(235): Xaa can be any naturally occurring amino acid
  unsure (1)..(528): unsure at all Xaa locations
LIELGGVKDLQERSQNNFATEGRSENITAAYAGSKNASLASSTNVSTTEPVNLDDNDKLLGGLLTSGFDEASCKSRMQSHLYRKASPHKPSPYLISKLRKYEEIHRRCGPNTRDYDKSMKKIVSSKNNGAATKCKYIIWNTANGLGNQMISIAATFLYAILTDRVLLVKFNKDKHXXFCEPFLNSTWILPQKSPFSSWNEHNTETYRXHAXXRIGLAIQRRVYHLFSLLIYNSAXENPEKYFHCDHSQDLLRKIPMLILRSDQYYVPSMFMNPFFNLEIANMFPERDIIFHHLGRYLFHPSNDAWELISSYYQAHLASASERIGLQIRVFNAATTPKQAIMNLVLSCTLQQKILPEVDLKTSVSSAGKNMTTVKAVLVASLHKEYGDNLRSMYLKKPTVSGEVIEVYQPSHEGKQKFNDNGHNLKAWTDMYLLSLSDVLVTTSLSTFGYVAQGLGNLKPWLLYRLVGNHSGDFPRCERDFSTEPCFHMPPKHYCNGEPMNDIVSSFPNLRECKDLRFGVKLAAVNGSM

SEQ ID NO: 21770 - protein, 455 aa, Zea mays
  misc_feature (115)..(115): Xaa can be any naturally occurring amino acid
  unsure (1)..(455): unsure at all Xaa locations
MGRHGVDQIGAVAAFVWVTLLPLLLVCVVWPGAQAGHTSEYRRQLGSAIDMPLDADVFRPPSGYNAPEQVHITQGNHDGTAMIISWVTTSEPGSSTVIYGTSEDNLNYTANGKHXSFDTKYYYAVGIGQTVRKFWFLTPPKSGPDVPYTLGLIGDLGQSFDSNVTLTHYESNAKAQGVLFVGDLSYADNYPYHDNVRWDTWARFVERSVAYQPWIWTAGNHEIDFAPELGETKPFKPFSHRYPTPYKASGSTAPYWYSIKRASAYIIVLASYSAYGKYTPQYKWLEAEFPKVNRSETPWLVVLMHAPWYNSYNYHYMEGETMRVMYEPWFVKYKVDVVFAGHVHAYERTHRISNVAYNVVNGLCTPIPDQSAPVYITIGDGGNQEGLATNMSQPQPSYSAFREASFGHAILDIKNRTHAYYTWHRNQDGSAVAADSMWFTNRYWEPTDDSADDFQ

SEQ ID NO: 21771 - protein, 113 aa, Prochlorococcus marinus str. MIT 9312
MTETTIFQKILNEEIPCDKLYEDEFCIAFNDIQAQAPVHFLVIPKKPIISLLECIEKDANLLGHLLFVGSKIAKSKNLTNWRTVINTGAESGQTVFHLHIHFLSGRKMNWPPG

SEQ ID NO: 21772 - protein, 745 aa, Bradyrhizobium sp. BTAi1
MDQRTDRGDALTRAALNLRKAKISEGRPFPLGATWDGLGVNFAIFSAHATKVELCLFDETGDTELERIELPEYTDEVWHGYLPTARPGTVYGYRVHGPYEPDAGHRFNPNKLVIDPYAKQLIGNLRWGPELFGYQLDHADKDLSFDDRDSAPLMLKCRVIDPAFTWGTSRKPEIPWERTIFYEMHVKGFTKLHPLVPEADRGTFAGLAHHDIPAYLRSLGITSAELLPIHAFIDDSYLIEKGLRNYWGYNSIGFFAPEPRYLKTPLATEFKTMVNQFHANGIEVILDVVYNHTAEGNELGPTLSFKGIDNASYYRLMPEQKRYYINDTGTGNTVNLSHQRVLQLVADSLRYWATEMRVDGFRFDLATILAREPYGFDEGGSFLDACRQDPVLSSVKLIAEPWDIGPGGYQVGQFPPGWAEWNDKFRDTARAFWKGDGGTLADFAKRISGSGDLFNKRGRRPWASVNFITAHDGFNLNDLVSYNDKHNEANGEDNRDGHSNNHSWNCGVEGPTDDPQIIGLRERQKRNLLATMLLSHGTPMLLAGDEFGHSQGGSNNAYAQDNETTWLDWMGIAPQGRALREFTRKLIAMRKAFPILYRSRFLVGSHNEDLGVKDVTWLAPSGEEMTTEQWTDDNARCFGMLLDGRAQETGVKRRGSDATLLLIYNAHFDVVNFTLPAVPEGHNWLALIDTNQPDAQLQSFSFGHVYAVTGRSMLALGLSSEQQPMRSLRHGLGALLDIAEAPLPG

SEQ ID NO: 21773 - protein, 508 aa, Medicago truncatula
MVLSKTASESDVSVHSTFASRYVRTSLPRFKMPEESIPKDAAYQIINDELMLDGNPRLNLASFVTTWMEPECDKLIMASINKNYVDMDEYPVTTELQNRCVNMIAHLFNAPLEENEAAVGVGTVGSSEAIMLAGLAFKRKWQNKRKQEGKPYDKPNIVTGANVQVCWEKFARYFEVELKEVKLSEGYYVMDPAKAVELVDENTICVAAILGSTLNGEFEDVKRLNDLLVEKNKETGWDTPIHVDAASGGFIAPFIYPELEWDFRLPLVKSINVSGHKYGLVYAGIGWAIWRSKEDLPEELIFHINYLGADQPTFTLNFSKGSSQVIAQYYQLIRLGYEGYKNVMENCRDNMIVLKEGLEKMGRFNIVSKDDGVPLVAFTLKDPHNFDEFQISDLLRRFGWIVPAYSMPPDAQHITVLRVVIREDFSRTLAERLVADIEKVLHELDSLTAKIKMLSGTSSVTVHEVVKDNGQVVVAKKSALETQREITAIWKKFVLDRKKLNDKMNGVC

SEQ ID NO: 21774 - protein, 174 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGNTPGYYDGRYWTMWKLPLFGCTDSAQVLKEVEECKKEYPGAFIRIIGFDNTRQVQCISFIAYKPPSFTEA

SEQ ID NO: 21775 - protein, 347 aa, Bacillus cereus ATCC 14579
MKDLIIIGAGQAGLTMGYYLKQEGYNFLLLEAGKRVGDSWRNRYDSLQLFTPRSYSSLPGMALIGEKNEFPYKDEIATYLEEYARHFQLPVQLQTEVLKIKKEKEIFELHTPTEILQTKKVIIASGAFQQPFIPSVSANLSSHIFQIHSSQYKSPSQIPKGKVLVVGGGNSGMQIAVELAKTHEVTVSISHPLTFLPLQLFGKSIFNLLEKVGLLYAEINTKRGRWFQKRKDPIFGFEGKKLIRNGAIKLQEKVVSASRNNIMFQNGDTYSAESIIWSTGFVQNYNWIEIEQAVNEKGFPNHIKGISPVKGLYYIGLPWQSQRGSALICGVGKDAEYVLSEIKKIDQ

SEQ ID NO: 21776 - protein, 445 aa, Pseudomonas fluorescens Pf-5
MTISRVHPVDEVLPVRQLFTFGLQHVLVMYAGAVAVPLILGNALGLTPAQVVLLINANLLTSGIATLVQTLGFWRFGARLPLIQGCSFIALAPMIMIGKQFGLTEVFGAVIAAGVITIALAPLFSRLLRFFPPVVIGSLITIIGISLMPAAAIWLGGGNPAADDFGAPANLLLGLATVAVTLVIYGKFSGFIGNLSVLIGLLVGSLIAAAFGMTDFAQVSQAAWFELSRPMAFGAPQFSLVPILIMTLAMLVIMAETTGNCLAIGKLTGKPTTQRTLGDAFRADGLSTLLGGLFNSFPYNAFTQNTGLIALSRVKSRFVVAAAGAIMVLMGLFPKLGALVAAVPTPVLGGCAIVMFGMTTVAGIQELSRVPFEGTRNAIVVAVSVSVGVLPMSFPALFAHLHGPLRLVLESGIFLGAITAIVLNLLLNPREAAAQVLAAHVELND

SEQ ID NO: 21777 - protein, 458 aa, Bacillus cereus ATCC 14579
MKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGIIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGAEMKDHPFKMPFAPVTNYLTIAFLIMVLIGMWFNDDTRISLVVGIIFLAIVTISFYAFGIGKRAPLDVQNNKEISSK

SEQ ID NO: 21778 - protein, 203 aa, Triticum aestivum
MFSLLHGLWNHVFSKTEFRVLILGVDKAGKTTLLEKLKSIYLKGEGLPHDRIGPTVGLNIGRIEDANVKLVFWDLGGQPGLRTIWEKYYDEAHAIVYVIDSASASTFEDAKSALEKVLRHEDLQEAPLLVFANKQDLPAAVTEEELDRHLHLKEFDERPYMFVAGSAYDGTGIKLGIDWLVEEMGKSRRTEALRARTDTYAKI

SEQ ID NO: 21779 - protein, 554 aa, Kineococcus radiotolerans SRS30216
MVRLPDSCWFRRVFAGTLWVDHEGGAPGAGTAPARRGRRGVASGFPAAAPSGRAPAPGRPRPLLAGPTSVPLRRVVSALLRAPAPTPPNRRTPVNDQPTPAGAPAVDPSTWSFETLQIHAGQAPDPATGARALPIYQTTSYAFRDTDHAAALFGLAEAGNIYTRIMNPTQDAVEQRIAALEGGIGALLVASGQAAETLAILNIASVGDHVVSSPRLYGGTHNLFHHTLPKMGISVTFVEDPDDAASWAAAVRPETKLFYGETISNPAGDVLDLEVVAAVAHEHGVPLVVDNTIATPYLIRPFEHGADVVVHSATKYLGGHGTSVAGVVVDSGRFDWAASGRFPGLTTPDPSYHGVVFTDAVGPAAYLTKLRVQLLRDLGPAVAPFNAFLIAQGLETLSLRMERHVRNAQAVAEFLDARDDVLSVNHASLPSSPWHAQQRKYAPKGSGAVLAFEIAGGVAAGKAFVDALVLHSHVANIGDVRSLVIHPASTTHSQLTPEAQLASGVTPGLVRLAVGLEGIEDVLADLRVGFAAAAAAVDASTALTAAPALNDTPA

SEQ ID NO: 21780 - protein, 636 aa, Oryza sativa
MLRRSLVAHAVLLFAAVALPLAAAQPWPVCGTSGGNYTAGSTYESNLLRLASTLRANASASPTLFASGVRGVGPDAVYGLLLCRGDMNPSDCFDCGTNVWRDAGPTCNRTKDAILVYNQCYAQFSDRGDFLAATNNSGAYSLLISGTNISSADVAGYDRAVTELLNATVRYAVENSTRLFATGQRVGADPGFRNIYSMAQCSPDLSPAQCRSCLDGLVGQWWTGFLFPRNGEGARVAGPRCYLRSELGSGFYTGAPMVRLPVKAVLRADGLSPASAPAPDVVPATTLVKKNSASKILLIVLPIVAVAIVAAISVCMWTVRKKSRATKAEHLSELDASEDLESVKSTLLTLGSLQVATDNFDESKKLGEGGFGAVYKGHLFGQEVAVKRMAKGSNQGLEELKNELVLVTKLHHKNLVRLVGFCLEDGERLLVYEYMPNKSLDTFLFDVEQRRQLDWATRFRIIEGVARGLQYLHQDSQKKIVHRDMKASNVLLDADLNPKIGDFGLARLFGQDQTRDVTNRIVGTFGYMAPEYVIRGQYSTKSDVFSFGILILEIVTGQRNSGPYFAEQNEDLVSLVWRHWTEGNIVEMVDYSLDRNYPEAEVLKCVNIGLLCVQQNPVDRPTMADVMILLLIYSHD

SEQ ID NO: 21781 - protein, 130 aa, Sinorhizobium meliloti 1021
MFLEQVVTKPDPYAPFLLSQAIKANGFVFVSGQAAIGDNGEIVGEGDFDRQAGQAFGNLDRALKAAGSGLDKVVKVTIFLRSMENFAKIVELRRKWFSAPYPADSIIEVSSLYSPKAMIEIEAIALDGSH

SEQ ID NO: 21782 - protein, 710 aa, Triticum aestivum
MPTLLQPFREDELRILRGDDPRQKNGAYEEHDRVYRYDLYNDLGDPDHKNPRPTLGGPDSLYPYPRRGRTGRKPMVTDPTCESRNVLPVLQQFYVPRDENFNHVKKADFTAYLIKAISGGILPLLRQQFDSVSPREFDDFEDMYKLYEGGLKIPDIPALDELFKSFPPLRSIMPAGGDFLLKMPMPHVIKEDKLAWRTDEEFAREMLAGLNPHIITRLNVFPPRSTLEGYGDQTSKITVEHIQHNLGKLNVDKAIDAKRLFILDHHDNFMPHLLKINSLPNTFVYATRTLLFLQDDGTLKPIAIELSKPLLNDLGTKVVGADSKVYTPPSCGSESEWAVQDTIWQLAKAYAAVNDSAWHGLISHWLHTHAVIEPFVIATNRQLSVTHPIHKLLQPHYRDTMTINALARQVLISAGGFFEMTVCPGEHALRISSEVYRNWNFTEQALPVDLIKRGVAKADTESPCGVSLHIKDYPYAVDGLAVWSAIETWVDEYCRIYYPCDDVLRSDVELQAWWKEVREVGHGDIKDQPWWPKMTTVNELVRSCATIIWIASALHAAVNFGQYSYAGYLPNRPTVSRRQMPEPGTKEYKEVETDPDLAFIHTITSQLQSIIGVSVIEVLSNHSSDEVYLGQRDEPKWTSDVKAKKAFEDFSQKLIDIEKRIMNMNANRQLKNRNGPAKFPYMLLYPNTSDIDGESATGITAKGIPNSISI

SEQ ID NO: 21783 - protein, 745 aa, Candida albicans SC5314
MNFIKKFIGTTTTDEVASIPSGKLYLTRSKQSPKGAIECLYNDAFASIKKTTSPYYYQLCITKVYQEGEADFNRFDDSEEEYDGEESAPTNDTRRQSKDEWIFPIADELKIHVCEKEDGSRAIAWKDVNGDLGDKFEFVIDEEVRGSEVEAFGMTIYKCLFENKYQTSYAKVNDPNQLKEFIYNPKGELLTFDELKDLNDLEEYETDEYEDCETSPIDAPKGETKYASTDVDLHLYDTRTGTFILHLAKPDFELKLIDLGNWEYTLYIHGETTRINTTLSKNMNPTFNYQHLSFIFNDYTVDEGGINACSWLVKFPDYNDMSKFQTVFLGLMYETLNRRKWGETEEHDYFVDAFSRVSIGDAKDLESEEEEESEEENEGDGPVKWETEKNEKNSSLTVGYAKDRSYVVRGDKIGVFSEDDAGQLNFQTAIINVADLKGKHFSPEKMLLHQQDQYMIISNPQFDDKALYKMDLTRGKIVEEWEVSKDVPVKSYAPTSKFAQLTDEQTLTGISSNGLFTIDPRLSGTKLVNDKTYKAYKTTNNQFQTLATTDKGYIALGSGKGDIRLFDRLGANAKTALPSLGDPIIGIDVSKDGRWLLATCKTYLLLIDNKISDGQKNAGKLGFTNYFDKDKKPTPRRLALKPEHEAYMVRENGGKQLSFTPAYFNTGRDSKETTIVTSLGKYVVTWSMGKVLLDKENPYLVKRYTQNVIADNFKFGSNNEVIMALQDDVSMVSRRSLANPKNVFK

SEQ ID NO: 21784 - protein, 479 aa, Oryza sativa (indica cultivar-group)
MSWSGDYEKYMATAAAVAGTAMVVRGVVSELVPDELREMLRSAARGIRARVSSTHTVVIDETEGLSTNQIYDAARTYLAARINTDMQRLRASRVDDAQGIMITMDQGEEMLDVHDGVEYTWRLVSRDTAAAATAHAAPYGIGGGGAANRRGRSRFEVKSFEVSFHKKHKEKALRSYLPFVIDTAKAMNDKHRNLKMHMIEYDAWTAVDLRHPSTFDTLAMDHSLKHSVMYDLERFVKRKDYYRRIGRAWKRGYLLYGPPGTGKSSLIAAMANYLKFDIYDLELTEVKSNSDLRRLLVGMSNRSILVVEDIDCTIDLQQRDEGEIKRAKPTYSGEENEDKVTLSGLLNFVDGLWSTSGEERIIVFTTNYRERLDPALLRPGRMDMHIHMGYCTREAFRVLASNYHNVENHAMYPEIEQLIEEVLTTPAEVAEVLMRNDDVDDALQVLAEFLKAKRNEPGETKAENKNGNQKINKYEQSMV

SEQ ID NO: 21785 - protein, 357 aa, Bradyrhizobium sp. BTAi1
MRTHSIAAIPADGIGPEVISAGVRVLEALAKRSGDISFNVKTFDWGSDYYKKNGVMMPADGLAELKKFDAIYFGAVGAPDVPDHITLWGLRLPICQGFDQYANVRPTKILPGVSSPLRNVGVGDLDWVIVRENSEGEYAGMGGRAHRGLPEEVGTEVAVFTRIGVTRIMRFAFKLAQSRPRKFLTVVTKSNAQRHGMVMWDEIAAEVAREFPDVTWDKMLVDAMTVRMTLQPKSLDTIVATNLHADILSDLAGALAGSLGVAPTGNIDPERRFPSMFEPIHGSAFDITGKGIANPVATFWTGAQMLEHLGEKEAATRLMAAVEKVCAAGILTPDVGGKATTKEVTDAVIDAIHGSNV

SEQ ID NO: 21786 - protein, 484 aa, Oryza sativa (indica cultivar-group)
MASYDKAIESYKKAITTAASVAASVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDTDVALLGLLELLKSKIKDASETKAESKDANKQTEENKDGKAMENKNDSSTDECT

SEQ ID NO: 21787 - protein, 545 aa, Prochlorococcus marinus str. MIT 9312
MTEVSVININSPFLDQKPGTSGLRKSTLKFQQKNYLEIFIEAILQSLEDLQVSTLVVGGDGRYGNIEAIEKIVQICVAHKVQKVIVPKCGLLSTPATSHLIRKENAIGGIILSASHNPGGIDGDFGVKLNISNGGPAPEMITNKIFKASQLLTSYKICKIQLPNFTEYGAYSFGETTLEIIDGLKDYSDLMEEIFDFDQISDFLKKDFSLIFDAMNAVTGPYATNIFVEKMGLSNDCVMNGTPLKDFGGLHPDPNLTYASHLADLLLNKKSYSFGAACDGDGDRNMILGSGCFVNPSDSLAVITANTKCVPGYKDGITGVARSMPTSSAVDNVARALNIPCFETPTGWKFFGNLLDSNLITLCGEESFGTGSNHVREKDGLWAVLYWLQVLAEKNCSVSDLIQSHWKQFGRNYYSRHDYEAIPSNIANQIFGDLTSRLENLKGSNFAGHLVQVADNFSYLDPVDDSISENQGLRLILDDNSRIIVRLSGTGTKGATLRLYFEKFFNSKQNLSLNPQVALKPLIDNLDDLLNISKLTQMQTPTVIT

SEQ ID NO: 21788 - protein, 316 aa, Brassica napus
LLMMMMTSLGGGGGGGGGGGVGPVGGGGGGGRYMPYPPPLSVPPSAPQSPNFSGGLRSQPSFLVEQEKYLTELLAERHKLTPFLTVLPHVCRLMNQEILRVTTLLENAISQSRFDHPSPLSSGGIFQNSRADMNGWPSQFPSERSVSSSPAPNWLNSPGSSSGLIVKRTIRVDIPVDQYPNYNFVGRLLGPRGNSLKRVEASTDCRVLIRGRGSIRDPVKEEMMRGKPGYEHLNEQLHILIEAELPIELVDARLMQAREILDDLLTPVEETHDFYKKQQLRELALLNGSLREEGSPMSGSVSPYNSLGMKRAKTRD

SEQ ID NO: 21789 - protein, 559 aa, Burkholderia sp. 383
MYQYDQYDQTIVDERVAQYRDQVRRRLSGELSEEEFRPLRLQNGLYMQRHAYMHRIAIPYGNLRSDQLRMLARIAREHDRGYGHFSTRSNIQFNWIELEDTPEILAKLASVQMHGIQTSGNCIRNITADQFAGVAQDEEIDPRPWSEILRQWSTFHPEFAWLPRKFKIAVSGSKDDRAAVQIHDLGVYLKKNAQGEVVASILAGGGLGRTPIIGAVIKEDLPWQHLLTYCEAVLRVYNRYGRRDNLYKARIKILVKALSPAKFAQQVEEEWQHLKDGPSTLTQAEVDRVSQYFQPPVYEKLADTDASFEQHLLENKAFARWVERNVAPHKVAGYAAVTLSLKDHRVAPGDATDQQMELVADWADAYSFGELRVSHEQNLILANVKKRDLFAVWEKAKAAGFATPNIGLLTDIIACPGGDFCSLANAKSIPIALAIQQRFDDLDYVYDLGDLSLNISGCMNSCGHHHVGNIGILGVDKDGAEWYQVSLGGEQGTGQNGARLGRVIGPSFSAEEVPDVIAKLIDTFVESRVDGERFVETYDRIGIAPFKERVYAARQAVNA

SEQ ID NO: 21790 - protein, 553 aa, Daucus carota
MNRNSINILNYMQFTDAYLDKYGVLMTLELYSNNISGPIPSDLGNLTNLVSLDLYMNSFSGPIPDTLGKLTRLRFLRLNNNSLSGPIPMSLTNITTLQVLDLSNNRLSGPVPDNGSFSLFTPISFANNLNLCGPVTGRPCPGSPPFSPPPPFIPPSTVQPPGQNGPTGAIAGGVAAGAALLFAAPAMAFAWWRRRKPREHFFDVPAEEDPEVHLGQLKRFSLRELQVATDTFSTILGRGGFGKVYKGRLADGSLVAVKRLKEERTPGGELQFQTEVEMISMAVHRNLLRLRGFCMTPTERLLVYPYMANGSVASCLRERQPSEPPLDWPTRKRIALGSARGLSYLHDHCDPKIIHRDVKAANILLDEEFEAVVGDFGLARLMDYKDTHVTTAVRGTLGYIAPEYLSTGKSSEKTDVFGYGIMLLELITGQRAFDLARLANDDDVMLLDWVKSLLKEKKLEMLVDPDLENNYIDTEVEQLIQVALLCTQGSPMERPKMSEVVRMLEGDGLAEKWDEWQKVEVIHQDVELAPHRTSEWILDSTDNLHAFELSGPR

SEQ ID NO: 21791 - protein, 454 aa, Colwellia psychrerythraea 34H
MTQHFDYLAIGGGSGGIASANRAAKLGKKAAVIEAKYIGGTCVNVGCVPKKAMWYAGQISDALKYASDYGFAQHLTQDTPQFDWAKLVANREAYIERIHAAYQRGFDANDVTVIDGFAKFVDKNTVEVNGELITADHITIATGGRPTLPNIEGADYGIDSDGFFALTEQPKSVAVVGAGYIAVELAGVFHALGTKAHLLVRKEKPLRGFDNMLSDTLVEQMAKHGPTLHNHSTPERIEKLADGSLVIHLTNGKTIGPVETLVWAIGREPATDNINLAAAGVAMNERGFIETDKYQNTNVDGIYAVGDNTGRAQLTPVAVAAGRRLCERLFNNKPEEHLDYSGIATVVFSHPVIGTVGLTENEAIAQYGEENITVYKSQFTALYQAITEDHRDPTRMKLICAGKEEKVVGLHSIGFGSDELLQGFAVAMKMGATKADFDNTIAIHPTSAEEFVTM

SEQ ID NO: 21792 - protein, 400 aa, Glycine max
MLVPHHPSMLIAPQNTSAENHDNIMEGQKQLHHFDESLMPNQSNIPSQFIWPDHEKPCLTPPELHIPPIDLKCFLSADPQALSTVCAELSEACKKHGFFLVVNHGVDSKLIAQAHKLIDDFFCMQLSQKQKAQRKIGEHCGYANSFIGRFSSKLPWKETLSFHYSADKSRKTVEDYFLNVMGEDFKQFGSVFQEYCEAMSKLSLGIMELLGMSLGVGRECFRDFFEGNESVMRLNYYPPCQKPELALGTGPHCDPTSLTILHQDQVEGLQVFVDGRWYSVAPKEDAFVVNIGDTFMALSNGMFKSCLHRAVVNNKIVRKSLAFFLCPNRDKVVTPPKDLISYENSRTYPDFTWPSLLEFTQKHYRSDTKTLDAFSRWLLEKNNPNRGAPTNVPWPTKSIN

SEQ ID NO: 21793 - protein, 201 aa, Oryza sativa
  misc_feature (145)..(145): Xaa can be any naturally occurring amino acid
  misc_feature (179)..(179): Xaa can be any naturally occurring amino acid
  misc_feature (187)..(187): Xaa can be any naturally occurring amino acid
  unsure (1)..(201): unsure at all Xaa locations
RSMAASYWKSSQYEQWLFDRQELLSVRLRDIASWPSNNNSPPITEDDYMKIMIFYSNIIQNIGEHYKVRQQVIGTAIVYMKRFYARYPLKSIDPWLLCPTCLFLAAKVEEFSTLNHQKVCFAATAIYKKYAHLLGGPSEYPYQIXHILECEFYLLEVMDCCLIVYHPYRSLDLYTRKFXIDQQLFEXTWRIINDSFETDAA

SEQ ID NO: 21794 - protein, 354 aa, Streptomyces coelicolor A3(2)
MTQHTDVVVIGGGQAGLAAGYHLRRQGLDFVVLDAQAAPGGAWQHTWDSLHLFSPAAFSSLPGRLMPPQPGKEYPDAGHVVAYLNDYEKRYDLPVQRAVRVIGVHDDGRLLRVETDSGTWRARAVISATGMWWRPFLPAVPGREDFEGRQLHTVSYRRPQDFAGQRVIVVGGGNSGAQIAADLAHDTELTWVTQRPPRYLADDIDGRALFDAATARRRALDDGRTDTGGVASLGDIVAVPPVREARDAGRLKASPMFARLVRDGVVWDDGTRAPADAVIWCTGFRPALSHLSPLGLRGSRGHIDTVGTRAAADPRLHLLGYGDWTGPASATLIGVGRPARDAAREIAEFLGGEG

SEQ ID NO: 21795 - protein, 572 aa, Saccharomyces cerevisiae
MSPLTRTVAIKKTVKVLSKCQSGREYTQKFLQRAYSTSHANSTYYSRTKLFISSHSKALNIALLSGSLLLTYSYYSPKKILSLDTINGIKDYSTNTSGNINMPSPNPKGTETQKSQRSQNDQSVLILNDSKIEAKLHDREESHFVNRGTGIFRYDVAQLPSNHPIEDDHVEQIITIPIESEDGKSIEKDLYFFGIFDGHGGPFTSEKLSKDLVRYVAYQLGQVYDQNKTVFHSDPNQLIDSAISKGFLKLDNDLVIESFRKLFQDPNNTNIANTLPAISGSCALLSLYNSTNSILKVAVTGDSRALICGLDNEGNWTVKSLSTDQTGDNLDEVRRIRKEHPGEPNVIRNGRILGSLQPSRAFGDYRYKIKEVDGKPLSDLPEVAKLYFRREPRDFKTPPYVTAEPVITSAKIGENTKFMVMGSDGLFELLTNEEIASLVIRWMDKNMNLAPVKAEPGKLPKVIDVSEDKEAQRPAFRYKDNNSSSPSGSNPEYLIEDKNVATHLIRNALSAGGRKEYVSALVSIPSPMSRRYRDDLTVTVAFFGDSGTPSIVSNATSIVMNPEATTKPKPRL

SEQ ID NO: 21796 - protein, 325 aa, Colwellia psychrerythraea 34H
MAQINLLHAINSALDIAMADDKSTVCFGEDVGHFGGVFRATSGLQEKYGKARCFNTPLVEQGIIGFANGLAAQGSVAIAEIQFADYIFPAFDQIVNEAAKFRYRSGNEFNVGKLTIRSPYGGGIAGGLYHSQSPEAYFAHTPGLKVVIPRNPYQAKGLLLASIRDDNPVIFFEPKRLYRASVGEVPEEDYQLPLGKAEVVQTGTDITLLAWGAQMEIIEKAAQMASNDGISCEVVDLRTILPWDIETISNSVMKTGRLLISQEAPLTAGFASEIAATIQSECFLHLESPIARVCGLDTPYPLALEKEYVSDHLKVYEAIIKSVNF

SEQ ID NO: 21797 - protein, 339 aa, Synechococcus sp. WH 5701
MTTMPQVLCFGEAIVDRLGPPGGDPATDLPVEDCLGGAPANVACALARLGTGSALLGRLGEDAIGAAFGDLFAARGVDTRAVQWDPVRPSRTVLVRRNSTGDRSFGGFAGERGDGFADQAVEASALAGPLEELIAAARWLLVGTIPLASEASAAALHLAQRRAESAGIPLALDVNWRPTFWPGSPEQALADIRPLLAGAALIKVSAEEADWIAGSRDPQRISASLPQGPAVLITDGPGALSWWLGGHAGRLGAFRVPVVDTTGAGDAFLAGLLHRLCQEPELLASGSAERVREAMRFASACGALVCRGAGAIDPQPTQAQVLAFLADIGSQNDGSMGGC

SEQ ID NO: 21798 - protein, 477 aa, Trifolium pratense
MAASRRLRELQSQPGNKICVDCSQKNPQWASVSYGIFMCLECSGKHRGLGVHISFVRSVTMDAWSEIQIKKMEAGGNDNLNAFLARYSIPKETDIVTKYNTNAASVYRDRIQAMSEGRPWRDPPVVKENFGPKGRPPLSQTRRNNDSSWDDWDGGSSVDVRSKSTGDFRSLNGGGAPVRSRSTEDIYTRSQLEASAANKEGFFAKKMLENESKPEGLPPSQGGKYVGFGSSPAPSQRSNPQNDYLSVVSQGIGKLSLVAASAANVVQASTKDITSKVKEGGYDQKVNETVSVVTQKTSEIGQRTWGLMKGVMALASQKVEEYTKENSNSTTNNWQRNENDRNGYYQDFNQENKGINSTTGREQSLSGQFKTNSSNSWDDWDHKNSWKEGQTKGSTPYSSGGQSGTHNPSSWDDWDNKDSRKEEPAKGSAPHNNDAGWAGWDNAKDDGFDNFYDGASNKKTVGHNGKSDDAWTGGGFL

SEQ ID NO: 21799 - protein, 316 aa, Trifolium pratense
MESPMEFWGAEVKVGESVKVDPELGYIHISQAALGEVKKDKATEPVVVYVKVDGQKLVLGTLIKDAIPHTTLNIVLDRVAELSHNSKNAAVYFSGYKVLDDGDFDDSDESDSEAELAPLTEPAEAAKELGKPAAETGAVAKQVVKRVKVEGESDSDSSEEFDSDSEDSESEEETPTPVKKVDQGKSMKGTNKNAPKAPVPTKKTKIATPEKTDSDSDDDISDEDISDDDISDEDSSDEETPVQKGKNNKRPNEAAPQTPVSAKRAKNATPGKTDDKKAVHIATPHPNKKGGKTPQNGAKDQSPSSSKSKKSNQGRR

SEQ ID NO: 21800 - protein, 258 aa, Saccharomyces cerevisiae
MAAGVPKIDALESLGNPLEDAKRAAAYRAVDENLKFDDHKIIGIGSGSTVVYVAERIGQYLHDPKFYEVASKFICIPTGFQSRNLILDNKLQLGSIEQYPRIDIAFDGADEVDENLQLIKGGGACLFQEKLVSTSAKTFIVVADSRKKSPKHLGKNWRQGVPIEIVPSSYVRVKNDLLEQLHAEKVDIRQGGSAKAGPVVTDNNNFIIDADFGEISDPRKLHREIKLLVGVVETGLFIDNASKAYFGNSDGSVEVTEK

SEQ ID NO: 21801 - protein, 221 aa, Streptococcus pneumoniae TIGR4
MAGITAAEFIKDGMVVGLGTGSTAYYFVEEIGRRIKEEGLQITAVTTSSVTSKQAEGLNIPLKSIDQVDFVDVTVDGADEVDSQFNGIKGGGGALLMEKVVATPSKEYIWVVDESKLVEKLGAFKLPVEVVQYGAEQVFRHFERAGYKPSFREKDGQRFVTDMQNFIIDLALDVIENPIAFGQELDHVVGVVEHGLFNQMVDKVIVAGRDGVQISTSKKGK

SEQ ID NO: 21802 - protein, 254 aa, Triticum aestivum
  misc_feature (139)..(139): Xaa can be any naturally occurring amino acid
  unsure (1)..(254): unsure at all Xaa locations
MGRKFFVGGNWKCNGTVEQVESIVNTLNAGQIASTDVVEVVVSPPYVFLPTVKAKLRPEIQVAAQNCWVKKGGAFTGEVSAEMLVNLGVPWVILGHSERRSLMGESSEFVGEKVAYALAQGLKVIACVGETLEQREAGXSTMEVVAEQTKAITGKIKDWTNVVVAYEPVWAIGTGKVATPAQAQEVHANLRDWLKTNVSPEVAASTRIIYGGSVTGASCKELAGQPDVDGFLVGGASLKPEFIDIINAATVKSA

SEQ ID NO: 21803 - protein, 149 aa, Trifolium pratense
DGFQKTMLILGLLAMVLLISSEVSARDLTNKEAVEETNDVNDAKFGGHGGHGGHGGHGGHGGHGGHGGGGHGGHGGEAVEETNDVNDAKYGGYHGGSGYHNGGGSYHNGGGSGYHNGGGYHNGGGYHHGGGHGGHGGGGHGGHGEDVQN

SEQ ID NO: 21804 - protein, 401 aa, Magnetococcus sp. MC-1
MGILSNRVAKVKPSATLAVTAKAKELKAAGRDVIGLGSGEPDFDTPDHIKQAAIDALNAGYTKYVAVAGTPELRQAIADKYKRETGLDYSAEQTVVTVGGKQAFFNLAQATLNSGDEVIIPAPYWVSYPDMTLLADGTPVIVDTQESHGFKITPAELEAAITPRTKFVVLNSPSNPTGNAYSIAELHALAEVLRKHPHVWVISDDIYEKIIYDGFEFATMVKVAPDLQDRTVILNGVAKAYSMTGWRIGYAVGPLDVIKAMTKIQGQSTSNATSFAMKGALEAITGPQDCVEPMVKAFKERRDYVVARLNAMPGISCLTPEGAFYVYPNVAGLVGKKAPDGSDLKDSVDLASYMLEAEGVAVVPGVAFGLDPYLRLSYATSMEDLIKAMDRIEKIAQQLAG

SEQ ID NO: 21805 - protein, 154 aa, Zea mays
PSCYVVAYIYLDRFVRRRPALAVDSFNVHRLLITSVLTAVKFVDDICYNNAYFARVGGISLVEMNYLEVDFLFGIAFDLNVTPAAFASYCAVLQSEMAYLDDAPAPAPVVEAPPRLHYCYGAAGTSDRHDDPAAVAAAAAACHRHSSQQPQLTV

SEQ ID NO: 21806 - protein, 299 aa, Vibrio fischeri ES114
MLTDQKILIAEDEPVSRLVLQRLLKAFTCISVTNGQEALDVIHQERIDLVLLDIHMPIMGGFEVIEKLKNSETTKDIPIIVITVNQSTEDEIRALDLGAVDFVTKPFHAVILQKRIRNQLALKLKSDLLEKHASLDGLTNLLNRRMFDFDLENRWAESQRLQANFSLIMFDIDHFKLYNDNYGHSAGDEVLVRVAKALMKTLQRKTDRVYRYGGEEFILIQFDTDLEQLRQTAELLRQCIYDLNITHDFSFHKRISISVGATLINAEQIQPIPYLLEITDQQLYKAKKQGRNCVSTITI

SEQ ID NO: 21807 - protein, 349 aa, Treponema denticola ATCC 35405
MKVAINGFGRIGRLVFQALVNQNLLGKDKFDVVAVVDLSTDAKYFAYQLKYDSVQGKMDAKIGTDGDDVLVVNGHKIKCISGKGLTPAQLPWKELGIDVVIESTGIYTNEKAYEHLEAGAKKVIISAPGKSKDPAKPIKTFVMGVNENEYKASEHHVVSNASCTTNCLAPVVHVLLKEGFGIETGLMTTIHAYTATQKTVDGVSLKDWRGGRAAAVNIIPSTTGAAKAVGEVLPTTKGKLTGMSFRVPTPTGSVVDLTIRTEKDTSIEEIDKAIKKASESYLKGVLAYCDEEIVSTDIIHDPHSSIYDSKATLQNNLPGEKRFFKLVSWYDNEWGYSNRVIDLLKFITK

SEQ ID NO: 21808 - protein, 254 aa, Arabidopsis thaliana
MSTREENVYMAKLAEQAERYEEMVEFMEKVAKTVDVEELSVEERNLLSVAYKNVIGARRASWRIISSIEQKEESKGNEDHVAIIKDYRGKIESELSKICDGILNVLEAHLIPSASPAESKVFYLKMKGDYHRYLAEFKAGAERKEAAESTLVAYKSASDIATAELAPTHPIRLGLALNFSVFYYEILNSPDRACSLAKQAFDDAIAELDTLGEESYKDSTLIMQLLRDNLTLWTSDMTVTGDEIKEASKPDGAE

SEQ ID NO: 21809 - protein, 219 aa, Salmonella enterica subsp. enterica serovar Typhi str. CT18
MTQDELKKAVGWAALQYVQPGTIVGVGTGSTAAHFIDALGTMKGQIEGAVSSSDASTEKLKGLGIHVFDLNEVDSLGIYVDGADEINGHMQMIKGGGAALTREKIIASVAEKFICIADASKQVDILGKFPLPVEVIPMARSAVARQLVKLGGRPEYRQNVVTDNGNVILDVYGMEILDPIALENAINAIPGVVTVGLFANRGADVALIGTPDGVKTIVK

SEQ ID NO: 21810 - protein, 175 aa, Glycine max
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIDFQPPGCEESAKA

SEQ ID NO: 21811 - protein, 507 aa, Robiginitalea biformata HTCC2501
MNSKAILMILDGWGISPDPKVSAIEQADTPFVDSLYEKYPHATLLTDGMHVGLPDGQMGNSEVGHMNLGAGRIVYQDLAKINLAVSNNSLKDAPALKEAFRYAVENDKPVHFLGLLSDGGVHSHIDHLKGLIRAADEAGVPASYVHAFTDGRDVDPKSGVGFVRDLMEFARPTRTRLASVVGRYFAMDRDKRWERVKKAYDLLVNGTGTATDNPVAALEASYAAGTTDEFVEPIAVAGTDGKPLAQIRDGDVVVFFNFRTDRGRELTLALSQEAFHEQNMHPLKLHYVTMTNYDDTFKDVHVVYDKENIKDTLGEVLARAGKKQIRIAETEKYPHVTFFFNGGREAPFEGESRILCPSPKVATYDLQPEMSAYDIRDAILPELAKGEADFVCLNFANPDMVGHTGDLQAAIKACETVDACARDVITAGLENGYTTLVIADHGNCDTMVNPDGSPNTAHTTNPVPLILVDPDRKSIKSGVLGDMAPTILEIIGVAQPELMTQKSLLVS

SEQ ID NO: 21812 - protein, 472 aa, Oryza sativa (japonica cultivar-group)
MGDSLDVVSFHKQALVFRQRVSDYLRRLSLRMLKLETEPIQLGHQQAVDQSSESKVGQYPTSMLQQQTSCDQQSLCIQVDTKLQEMPPNEHLLDQVPPRSQKKLCMDDRLSDLPDTILHHIMSLLSAQEVARTCILSKRWKELSASAPCLDICVDKFGMDRVRFSEFVAHLLLSRAPNSLHTFRLHSFAIDHASSWINRAIELKAQVLEFTEYIRWESFYLDPQLMAFASQYLKCLKLTNVTLDSNAFEPLNHACPALENLQLSQCFLEVPEICSASLKKLDIMECSLLMNLQIQTPRLVSLRFRCLQYKCSSCSRYPVITAAVTLCDLPNAENIDLSCSGRQVTFGREIQKFPMYGKLTSISLGEWCLSDKFSRLFCLLRHSPELKELTLKLEVERQDHNGEDEIRLMVGRSFSAENLKKICISTMQELSRKIARRQSWGMLSRFNKKDTAVSTITMPQEVKPEMHPSTLV

SEQ ID NO: 21813 - protein, 367 aa, Oryza sativa (japonica cultivar-group)
MRAGLALVVVVVAVVVGDVGAALPRFAEAPEYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 21814 - protein, 490 aa, Pseudomonas fluorescens Pf-5
MARFELQKLYIDGGYTDAGSDATFDAINPANGEVLAQVQRATKEDVERAVVSAEKGQKIWAAMTAMERSRILRRAVEILRERNDELAALETLDTGKAFSETKYVDIVTGADVLEYYAGLVPAIEGEQIPLRTTSFVYTRREPLGVVAGIGAWNYPIQIALWKSAPALAAGNAMIFKPSEVTSLTTLKLAEIYTEAGLPDGVFNVLTGSGREVGTWLTEHPRIEKVSFTGGTDTGKKVMASASSSSLKDVTMELGGKSPLIIFDDADLDRAADTAMMANFYSSGQVCTNGTRVFVPSHLKAAFEAKIAERVARIRIGNPEDENTNFGPLVSFPHMESVLGYIAKGKEEGARVLCGGERLTDGEFAKGAFVAPTVFTDCTDDMTIVREEIFGPVMAILTYETEEEVIRRANDTDFGLAAGLVTKDLNRAHRVIHQLEAGICWINAWGESDAKMPVGGYKQSGVGRENGISSLNNFTRIKSVQVELGDYASVF

SEQ ID NO: 21815 - protein, 265 aa, Pisum sativum
MGFDSNLGGSPSSSSPTAKRTRDPEEEVYVDNLRSHKRYLSEIMASSLNGLTVGDSLPDNLLESPARSESAFSLRDDISLQYSPMSEDSDDSRFCETPVHSCLTNLDSRPSSPVSPCRYQRQQNSFSSAPSTSLNTSHGFPVSAVTCSQPRQRSSDSDGRFPSSPSDICHSADLRRAALLRSVQMRTHPPGSASLELPFGSGQEPAPNIDSEDRPCSYMKSLVDERDYQIEECSSIGAPETEFNHDNNKPCRVLNMNPKAADSGG

SEQ ID NO: 21816 - protein, 170 aa, Saccharomyces cerevisiae
  misc_feature (4)..(4): Xaa can be any naturally occurring amino acid
  misc_feature (77)..(77): Xaa can be any naturally occurring amino acid
  misc_feature (120)..(120): Xaa can be any naturally occurring amino acid
  unsure (1)..(170): unsure at all Xaa locations
DSIXKILLIGDSGVGKSCLLVRFVEDKFNPSFITTIGIDFKIKTVDINGKKVKLQIWDTAGQERFRTITTAYYRGAXGIILVYDITDERTFTNIKQWFKTVNEHANDEAQLLLVGNKSDXETRVVTADQGEALAKELGIPFIESSAKNDDNVNEIFFTLAKLIQEKIDSN

SEQ ID NO: 21817 - protein, 608 aa, Polaromonas sp. JS666
MYQYTEFDRQFVKARASQFRDQLTRWQAGQLPEDEFRPLRLQNGWYVQRYAPMLRVAVPYGELSSAQLRVLAKIAREYDQPNAALLEGAQATQDKLGAIPLKNGHSVHSKLTTGYAHFTTRQNVQYNWIPLDKSADVMDLLASVNMHGIQTSGNCIRNITSDERAGIAVDEIADPRPFGEIMRQWSTLHPEFSFLPRKFKIAISGAREDRAAIGWHDVGLQLLRNAEGELGFKVLVGGGMGRTPIIGTVIREFLPWNQIMNYLEAVVRVYNRYGRRDNIYKARIKILVKAEGQRYIDDVEAEYKQIMEHDGGPHTITQAEYDRVAACFVAPTLNCDRKEADAKIAHILRAAAEDDVEFGRWLQQNVAPHQNPDLRAVTLSFKRLGQAPGDATAAQLDVAADLADRFSAGEMRVTHEQNLLLPWVRCDELPELWRAARKAGFAKPNIKLLTDMIACPGGDFCSLANARSIPIAEAITERYQDLDELHDLGEIDLHISGCINSCGHHHSGHIGILGVDKDGKEWYQVSLGGSDGSTLSGPAVPGKAVGPSFSAAEVPEVIEAVLETYRQQREGGETFIATLRRVGAEPFKAAANGARFSAARAETAETAA

SEQ ID NO: 21818 - protein, 781 aa, Kineococcus radiotolerans SRS30216
MPPTVPELSSSAQGIALAVAVTALLSLVAAWVFRRQVLQAGEGTARMQEIAGAVQNGAAAYLRRQFRTLAWFAVAVLLLLLALPADGWDLRIARSAAFVLGAVFSAAIGYLGMSLAVRANVRVAAAAREGAGGRERGMRIAFRTGGVVGMTTVGLGLLGASVAVLAFGADAPTVLEGFGFGAALLAMFMRVGGGIFTKAADVGADLVGKIEQGIPEDDPRNPATIADNVGDNVGDCAGMAADLFESYAVTIVAAVILGSAAVGETGLVLPLLVPAIGAITAALGVVLVRARPGTSGLTSIQNGFYLSAAVALAGTAIACFAYLPATFAEFSGADESVAGLNGDPRVIAFAAVLLGILLAVLILAITGHYTGTEAKPTRDVADASTTGAATVVLSGIGLGLESAVYTTLVIAGAVFLAFLLAGGVLALAMFLVALAGCGLLTTVGVIVAMDTFGPVSDNAQGIAEMSGDVDAEGAAVLTELDAVGNTTKAVTKGIAIATAVLAATALFGSYQEAVVNRINEVAVAIETPSQYLQRTIGDFSVSTPTTLVGVLLGAAAVFLFAGLAINAVGRSAAAVVLEVRRQFADHPGIMDGTEQPDHGRVVDLCTRDALRELATPGLLAAFAPIAVGFGLGVAPLAGFLGGAIAAGVLMAVFLSNSGGAWDNAKKLVEDGLHGGKGSAAHEATVIGDTVGDPFKDTAGPSINPLIKVMNLVALLIAPAVVTLSIGAEANAAARYGIAAAATVVIVVAVVVSKVRRVDMAAPTGPATGVDLRSGDSAERLP

SEQ ID NO: 21819 - protein, 170 aa, Saccharomyces cerevisiae
DSIMKILLIGDSGVGKSCLLVRFVEDKFNPSFITTIGIDFKIKTVDINGKKVKLQIWDTAGQERFRTITTAYYRGAMGIILVYDITDERTFTNIKQWFKTVNEHANDEAQLLLVGNKSDMETRVVTADQGEALAKELGIPFIESSAKNDDNVNEIFFTLAKLIQEKIDSN

SEQ ID NO: 21820 - protein, 393 aa, Prochlorococcus marinus str. MIT 9211
MSKSHLISERTQELQLSLTLEISARAKLLKKEGKDICSLSAGEPDFDTPNYIVNAAIEALRNGITRYGPAAGDPELREAIAQKLTTSNNVPSKAENILITNGGKQAIFNLFQIILNPGDEVLIPSPYWLSYPEIAKLAGAIPVPLHTSPKDGFKLSSEKLEEKITNRTKLLILNSPCNPTGRVIQKEELISIAEVLRRNKQLLVMTDEIYEYLISENESHHSLAAIAPDLRERIFIVNGFAKAWAMTGWRIGYLAGPKEFIKTAIALQSQSTSNVCSFAQRGALAALLGPKESIKTMSRSYNERREILTKGLNSINGISLIPQKGAFYAFPELAPSLPNSLSFCKLALEKVGLAIIPGIAFGEDRCVRLSCAVSEDTIKEGIARLEKLITQLI

SEQ ID NO: 21821 - protein, 465 aa, Oryza sativa
MAASPAAGAAAATVSSFVSPSSFSSVKASKPDRLRPARRAAAVNVRCVSSPPATETSFKTKVPRNANMAKLQAGYLFPEIARRRAAHLLKFPDAKIISLGIGDTTEPIPDVITNAMAKDGAHALSTVDGYSGYGAEQGEKKLRAAIAATYYADLGIEETDIFVSDGAKCDISRLQVLFGSNVKIAVQDPSYPAYVDSSVIMGQTGLYQEDVQKYGNIEYMKCSPENGFFPDLSSVPRTDIIFFCSPNNPTGAAASRDQLTKLVKFAKDNGSIIVYDSAYAMYISDDSPKSIFEIPGAKEVAIETASFSKYAGFTGVRLGWTVVPKELLFSDGHPVAKDFNRIVCTCFNGASNISQAGGLGCLSPEGLKAMSDVVGFYKENTKIIVDTFTSLGFNVYGAKNAPYVWVHFPGRNSWDVFAEILEKAHVVTTPGSGFGPGGEGFVRVSAFGHRENIIEAARRLKQLYK

SEQ ID NO: 21822 - protein, 337 aa, Arabidopsis thaliana
MLSGNNGNTAPPVFMNENQLQYQTNLRSNQLHLLGNMGGGCTVDPVNYFANDNLVPMIRPNKRGREAESISNNIQRQQQKLQMSLNYNYNNTSVREEVPKENLVSTGLRLSYDDDEHNSSVTSASGSILAASPIFQSLDDSLRIDLHRQKDEFDQFIKIQAAQMAKGVRDMKQRHIASFLTTLEKGVSKKLQEKDHEINDMNKKNKELVERIKQVAMEAQNWHYRAKYNESVVNVLKANLQQAMSHNNSVIAAADQGKEGFGDSEIDDAASSYIDPNNNNNMGIHQRMRCKMCNVKEVSVLIVPCRHLSLCKECDVFTKICPVCKSLKSSCVQVFFS

SEQ ID NO: 21823 - protein, 496 aa, Oryza sativa (japonica cultivar-group)
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVRQ

SEQ ID NO: 21824 - protein, 80 aa, Zea mays
MAPGDDSNPAASYIHTVQHLIERCMTFGMSMEECMEALAKRADVLPVVTSTVWKELEKENKEFFDKYQEWISEKRSAGTS

SEQ ID NO: 21825 - protein, 387 aa, Salmonella enterica subsp. enterica serovar Typhi str. CT18
MSVIKMTDLDLAGKRVFIRADLNVPVKEGKVTSDARIRASLPTIELALKQGAKVMVTSHLGRPTEGEYNEEFSLLPVVNYLKDKLSNPVRLVKDYLDGVDVAEGELVVLENVRFNKGEKKDDEALSKKYAALCDVFVMDAFGTAHRAQASTHGIGKFADVACAGPLLAAELDALGKALKEPARPMVAIVGGSKVSTKLTVLDSLSKIADQLIVGGGIANTFVAAQGHSVGKSLYEADLVDEAKRLLTTCDIPVPTDVRVATEFSETAPATLKSVNDVKEDEQILDIGDASAQQLAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 21826 - protein, 348 aa, Salmonella enterica subsp. enterica serovar Typhi str. CT18
MTVRIAINGFGRIGRNVVRALYESGRRAEITVVAINELADAAGMAHLLKYDTSHGRFAWEVRHEREQLFVGDDVIRILHERTLADLPWRELGVDVVLDCTGVYGNREHGEAHIAAGAKKVLFSHPGSNDLDATVVFGVNQNQLRAEHRIVSNASCTTNCIIPVIKLLDDAYGIESGTVTTIHSAMNDQQVIDAYHSDLRRTRAASQSIIPVDTKLAAGITRIFPQFNDRFEAIAVRVPTINVTAIDLSVTVKKPVKASEVNQLLQKAAQGAFHGIVDYTESPLVSIDFNHDPHSAIVDGTQTRVSGAHLIKTLVWCDNEWGFANRMLDTTLAMAAVGFRLDASASTKL

SEQ ID NO: 21827 - protein, 286 aa, Medicago truncatula
MALSRFSSSQFGSTLLKPYFLSSAIRHRSISSSSTETLTVETSIPFTSHNCEPPSTTVQTTASELMSFFNDMVLMRRMEIAADSLYKAKLIRGFCHLYDGQEAVAVGMEAAINRKDCVITAYRDHCTFLCRGGTLVEVFSELMGRKDGCSKGKGGSMHFYRKEGGFYGGHGIVGAQIPLGVGLAFGQKYNKDPNVTFTLYGDGAANQGQLFEALNIAALWDLPAILVCENNHYGMGTAEWRSAKSPAYYKRGDYAPGLKVDGMDVLAVKQACKFAKEHALKNGPLG

SEQ ID NO: 21828 - protein, 386 aa, Arabidopsis thaliana
MALLRPHLHRFHSNTLRHSAYPSADAGGGLVVYPTYGRHRCSAIAIDAPSSLTGVTPIRWGYTSVQGFRDEMEDDIVIRSDAVDSFSYAAVFDGHAGSSSVKFLREELYKECVGALQAGSLLNGGDFAAIKEALIKAFESVDRNLLKWLEANGDEEDESGSTATVMIIRNDVSFIAHIGDSCAVLSRSGQIEELTDYHRPYGSSRAAIQEVKRVKEAGGWIVNGRICGDIAVSRAFGDIRFKTKKNDMLKKGVDEGRWSEKFVSRIEFKGDMVVATPDIFQVPLTSDVEFIILASDGLWDYMKSSDVVSYVRDQLRKHGNLACESLAQVALDRRSQDNISIIIADLGRTEWKNLPAQRQNVVVELVQAATTIGLVTVGIWMSSHLS

SEQ ID NO: 21829 - protein, 122 aa, Brassica napus
MQDQLVCHGCRNTLLYPRGATNVRCALCNTINMVPPHPHPPPPHAHAGMDMAHIVCGGCRTMLMYTRGASSVRCSCCQTVNLVPATPPTNQPAHVNCGNCRTTLMYPYGAPSVRCAVCQFVT

SEQ ID NO: 21830 - protein, 663 aa, Salmonella enterica subsp. enterica serovar Typhi str. CT18
MSSRKELANAIRALSMDAVQKAKSGHPGAPMGMADIAEVLWRDFLNHNPTNPSWADRDRFVLSNGHGSMLIYSLLHLTGYDLPMSELQNFRQLHSKTPGHPEVGYTAGVETTTGPLGQGIANAVGMAIAEKTLAAQFNRPGHDIVDHFTYVFMGDGCMMEGISHEVCSLAGTLKLGKLIAFYDDNGISIDGHVEGWFTDDTAKRFEAYGWHVIRGIDGHDADAIKRATEEARAVTDKPSLLMCKTIIGFGSPNKQGTHDSHGAPLGDAEIALTREQLGWKYAPFEIPSEIYAQWDAKEAGQAKESAWNEKFAAYEKAFPQEAAEFTRRMKGDMPADFNAKANEFIAKLQANPSKIASRKASQNAIEAFGPLLPEFLGGSADLAPSNLTLWSGSKAINEDAAGNYIHYGVREFGMTAIANGIALHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPQIIFIATGSEVELAVAAYEKLTAEGVKARVVSMPSTDAFDKQDAAYRESVLPKAVSARVAIEAGIADYWFKYVGLNGAIVGMTTFGESAPAELLFEEFGFTVDNVIAKAKALL

SEQ ID NO: 21831 - protein, 221 aa, Lactococcus lactis
  misc_feature (8)..(8): Xaa can be any naturally occurring amino acid
  unsure (1)..(221): unsure at all Xaa locations
MFKAVLFXLDGVITDTAEYHFRAWKALAEEIGINGVDRQFNEQLKGVSREDSLQKILDLADKKVSAEEFKELAKRKNDNYVKMIQDVSPADVYPGILQLLKDLRSNKIKIALASASKNGPFLLERMNLTGYFDAIADPAEVAASKPAPDIFIAAAHAVGVAPSESIGLEDSQAGIQAIKDSGALPIGVGRPEDLGDDIVIVPDTSHYTLEFLKEVWLQKQK

SEQ ID NO: 21832 - protein, 699 aa, Ostreococcus tauri
MALNARRPSRDHERTPNKFLPWLSNTPTLDGTLEKRQETEGWWASLFGGGTEQWGLRYFLLYDTHLFWGKGFSTMHGYGTVLSVREVPELGPTSFAVEMMAVPKRNLRRSFNDNVNFLDLISGLCCKPAGFRVMYLRATSPKEMQRWMEGFCRGTSDTPVSTRMPLDFSEEIPPSPRISTDSELSIDTFSGTGTRTRYEEPPPPLSPGGASREFLNTSPETEDVPLFRLDANGESGEFNHSTQQKSPVRTRSVLKSNSMLRNHEQRQSVDGNCSKSVTFDDHVESVVIARSPVKQQGIVPAQETDREFRTRTRLLKAAGSFKISESELQIGAKLGIGSFGVVYRAKWNDTDVAYKVMLQDKMNYETVNAFAEEIRMMRGLRHPNIVLFIGAVIQPNRLGIVSELMKRGNLEFLLHGNSTMGRQLRENGMLRRQMAADCARGMLYLHSLSRPVVHHDLKPANLVVDSNWTLKVSDFGMAQLKSYTYDSVSGAPGGTPEWMSPEALRGDKANERSDVYSFGVILWELMTVSFPWAELSSPVQIVAQVAFLHRRLKVPEWIEKPMADLLHSCWAREPEERPTFEKIVEQLAGEYPQAWSLGQVDKSADEQAANILAMMSTGKGAKNSAFAPRGLKPIRTPTPVTDVPKQTDTLDTEEDSSEDLSKRHGHDYRQRVPPETSPLKTPRAELPSALPTLSNGARD

SEQ ID NO: 21833 - protein, 346 aa, Triticum aestivum
MAAAAAAEVSNNRVILKRHVTGFPTEDDMELVPATARLAVPPGSAAVLVKNLYLSCDPYMRSRMSRHDEPSYVPDFVQGEVLTTLGVSKVVESGHQDYKPGDLVWGMTGCEEYTLITNLQTHFKINHPELPLSYYTGVLGMPGLTAYAGFFDVAKPKKGDYVFVSAASGAVGQLVGQLAKISGCYVVGSAGSDEKVNLLKTKFGFDDAFNYKKEQDLNATLKRCFPEGIDIYFENVGGAMLDAVLLNMRLHGRVSVCGMISQYNLEQLEGVHNLFSIVAKRIRMEGFIVMDHYGSYRKFEEEMAGYLKEGKITYVEDVAEGIESFPSALIGLFYGRNIGKQLVAVA

SEQ ID NO: 21834 - protein, 565 aa, Streptomyces coelicolor A3(2)
MPLPSPDSSRVVLVGVADYDHLPPLPGIRNNLAALAEFFTSPQGWGLPPEHCTVVTNPCQSSEFIDPVQRAAAEATDTLLVYYSGHGHLDDELRYSVSVTGSRQDQPWTCLPYSWLKSVLIQTRAQRRVVILDSCFSGQAHGLMTDAADALRVQVATSGAVVISSARHDLPALAPVGETYTAFTGELLDVLTHGIPGGSPEISVDAAYAHVKAALAARGRPTPDRTGTDTSGALIIARNPGFRPHTPAATLRPVPGTHLRALAERLYPLSADARSSRRHTKPAEAGQRTEPDSAGERYEILSPLGRGGMGTVSVAYDRLLDRRVALKSIEIYGGDEPFARQVFWSEVRIAAALNHPNVAAIYDVVEGKTGRFFVMELVPGTDLSTAIKEGPLSPDQAAEVVHDVLSGLEAAHQRGVVHCDVKPGNIMLTPNGRIKILDFGVSHVIAEGEHGPLHRGDGTMVGTPLYMAPETLLGQLPTVAADIYGTGVVFYQLCTGRPPFPVSHFAEIASLKHAGPPTPPSEIHPAVPATYQTIIMRALERDPKDRYSSAAEMRAAIAAALYGAN

SEQ ID NO: 21835 - protein, 387 aa, Pseudomonas fluorescens Pf-5
MTVLKMTDLDLQGKRVLIREDLNVPVKDGVVTSDARILASLPTIKLALEKGAAVMVCSHLGRPTEGEFSAENSLKPVADYLSRALGREVPLVADYLGGVEVKAGDIVLFENVRFNKGEKKNADELAQQYAALCDVFVMDAFGTAHRAEGSTHGVAKFAKVAAAGPLLAAELDALGKALGNPAKPMAAIVAGSKVSTKLDVLNSLSQICDQLIVGGGIANTFLAAAGHPVGKSLYEPDLLDTARAIAAKVSVPLPVDVVVAKEFAESAAATVKLIADVADDDMILDIGPQTAAQFAELLKSSRTILWNGPVGVFEFDQFGNGTKVLAQAIADSAAFSIAGGGDTLAAIDKYGVAQQISYISTGGGAFLEFVEGKVLPAVEVLEARAKA

SEQ ID NO: 21836 - protein, 352 aa, Thiomicrospira crunogena XCL-2
MKNESLRNFAHIPMQSVGPFKLIGEVETDDLMVPMATYETPLWPSVARGARVTHHAGGIRVTVIDERMTRSVLLEAPNASIALQRFQALKADQAALQAIVSQSSQYAKLLDLNVQIIGNLIYLRLEFSTGDASGHNMVTNAADKLIPWILESYPDLSYVSISGNYCTDKKVSAVNGILGRGKNVVCETTIPRKLCQRFLKTTPEAIVDLHIKKDLIGSIVSGGLRTANAHVANMLLGFYLATGQDAANIIEGSQAINHIEVNADGDLYFSTTLPNLIVGTVGNGKGLDFVLDNLEQLGCVDQTAKPGQNARRLACIAGATALCGELSLLAAQTNPGELMSAHLKLERQNASS

SEQ ID NO: 21837 - protein, 617 aa, Oryza sativa (japonica cultivar-group)
MGGAHSREDLDLTSSDDEDDDEEYDAQTATSAASREDILRTSTPSSLEFLDAKLKALDLKYQAPNAAKLYLHVGGASASARWVPAERRATYAFVDKATAAGDSDCGGPRWVLEVGPGPRVSAPVGPALQLKALPAQRRADFAAGGSVWALRLPTDAAFRRFRQEYDRCLFENTYGVEATDEGRKEVFGADFAAWARPGESDDAVWADAEDSFTPPVATPARDLLEEFEEEAGDGSIQSLALGALDNSFLVGGSGIQVVKNFRHGVHGKGVSVRISDGRGGGNAYMTPQKALLMRGETNMLLMSPGETGTRHSNGVHHVDIETGKVVAQWRFEKDGTDITMRDIANDSKGAQLEPSGSTFLGLDDNRLCRWDMRDSRGRVQTIGSSSESPVLQWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLSPLDSILAGSENKFHGGQFSWVTENGKQEKHLVATVGKFSVIWNFQQVKDSNHECYRDQEGLKSCYCYKVVLKDESIVDSRFMHEKFATTDSPEAPLVVATPMKVSSFSLANRRLH

SEQ ID NO: 21838 - protein, 582 aa, Bacillus subtilis subsp. subtilis str. 168
MGYYLTWLTISRKKEICLNNIKKTKEGHLETTLRGKEVLSIPTLNKGVAFSLEERQELGLEGLLPPTVLSLDQQAQRAYEQFQAQPDRLRQNVYLSDLANRNEVLFYKLLKNHLREMLPVVYTPTVGEAIQEYSHEYRRPQGIYLSIDNIDGIEKAFENLHATAGDIDLIVATDSESILGIGDWGVGGINIAIGKLAVYTAAAGIDPSRVIPVVLDVGTNNEKLLNDPLYIGNKHERVQGERYEAFIDAYVKAALKFFPKALLHWEDLGNKNARNIMKKYNHEILTFNDDIQGTGAITLAGVLAAMKKTGASIKDQRVVIFGAGSAGIGIADQIRDTMVLAGLSEEEANKRFYTLDYRGLLTEDIEGILDFQKPYLRNADEVKDWKRDEKGQIPFDEVVRQAKPTILIGTSGVSGAFTEEIVKEMASHVDRPVIMPMSNPTHLAEAVPEDLFKWTDGKVLIATGSPFDNVEYNGVSYEIGQSNNAFAFPGLGLGSIVAEARIITPAMFAATADAIAEMVDLETPGAGLLPSIDKLQEVSIQVAIAVAEAAIKDGVANRQPEDVKQAVLDAMWTPEYKKVIAK

SEQ ID NO: 21839 - protein, 542 aa, Robiginitalea biformata HTCC2501
MANGFFRVPPAYNEPVKSYAPGSPEREAVLKQYDAYYNSNRDIPLTIGGEKVRTGNTRPIAPPHDHQHQVGQYHLASEKEVRQAIDTALAARASWAALPWEQRASVFLKAAELIAGPYRDRINAATMMAQSKTVHQAEIDSACELIDFLRFNAEFMSQIYQEQPESSEGIWNRVEYRPLEGFVYAVTPFNFTAIAGNLPASAAMMGNVVIWKPSDHQVFSAQVIVDIFEEAGLPAGVINCIYGDPAMITDILLAHPEFSGIHYTGSTEVFKGIWKKIGDNINTYKTYPRIVGETGGKDFIIAHPTANPRQVATAITRGAFELQGQKCSAASRVYLPKSIADDVLEGVKKDLKSINKPGSPADLSNFVTAVIHEGAFDKLAGYIDRAKSDEDAEIIAGGGYDKSVGYFVEPTVILTTDPHYVTMETELFGPVVTVYVYEDADWDTTLELVDQTSEYALTGAVISGDRYAIQQATRVLENCAGNFYINDKPTGAVVGQQPFGGARASGTNDKAGSAQNLMRWVSPRLIKETFVSPEDYRYPFLG

SEQ ID NO: 21840 - protein, 504 aa, Zea mays
  misc_feature (449)..(449): Xaa can be any naturally occurring amino acid
  misc_feature (470)..(470): Xaa can be any naturally occurring amino acid
  unsure (1)..(504): unsure at all Xaa locations
SRSFRLRSLRKSLEGEQVAAGWPPWLSAVAGEAIQGWIPLKADSFEKLEKVGQGTYGSVFRARDLDTGKIVALKKVRFDNFEPESVRFMAREIQILRRLDHPNVMKLEGLITSRLSCSLYLVFEYMEHDLAGLCSSPDIRFTEAQLKCYMNQLLSGLEHCHSRRVVHRDMKGANLLVNNEGVLKIADFGLANFFDPNKNHPLTSRVVTLWYRPPELLLGSTHYDAAVDLWSLGCVFAEMYRGKPILQGRTEVEQLHKIFKLCGSPADDYWKKSKLPHATIFKPHHPYTSTLRDVFKELPENALSLLETLLSVEPYKRGTASGALSSEFFRTKPYACEPSSLPNYAPNKEMDAKLRENALRRKASSRGHGTEASKKSSRLSRAAREPSAVPKQIISRTEESKTNVNATKDGTTQDRAKLNGDARLFVDIQPVSAAQVKESARHVKNESRXEQIPFSGPLSVTSSSGFAWAXISQEDRASARSRTGSSSRRQLPADAALGCTSKCC

SEQ ID NO: 21841 - protein, 202 aa, Triticum aestivum
  misc_feature (21)..(21): Xaa can be any naturally occurring amino acid
  misc_feature (30)..(30): Xaa can be any naturally occurring amino acid
  unsure (1)..(202): unsure at all Xaa locations
RMECSIRAIRTFPKSGIRVMXIPDMLFDSXALRAFSDLFVELFERNDITVVAVVEARGFSCGPPVALATGAKFVPIRTLRKLPGEVISEVYSVEYGADNIDMLVGPVQPNDRVLRVDDVDATGGTLCAAGNLIERVGAKVAECAGVIDLPELTDRDKLGDMAVISVVQADESVGTKLCLLSCSNDVYLVDLYWKQQRYPLQS

SEQ ID NO: 21842 - protein, 464 aa, Salmonella enterica subsp. enterica serovar Typhi str. CT18
MPDNKKQGRSNKAMTFFVCFLAALAGLLFGLDIGVIAGALPFITDEFQITAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKRELDEIRESLQVKQSGWALFKENSNFRRAVFLGILLQVMQQFTGMNVIMYYAPKIFELAGYTNTTEQMWGTVIVGLTNVLATFIAIGLVDRWGRKPTLTLGFLVMAIGMGILGTMMHIGIHSPSAQYFAIAMLLMFIIGFAMSAGPLIWVLCSEIQPLKGRDFGITCSTATNWIANMIVGATFLTMLNNLGNANTFWVYAGLNVLFILLTLWLVPETKHVSLEHIERNLMKGRKLREIGAHD

SEQ ID NO: 21843 - protein, 723 aa, Thermotoga sp. SG1
MWLLFLVPLVALGFAAANFAAVVKKPEGTDRMKEISSYIRSGADSFLAHETRAIFKVAIVIAILLMIFTTWQTGVAFLLGAVMSASAGIVGMKMATRANVRVAEAARTTKKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKIGENLVHQIPKETIQSLITYPIFFALVGLGCSMLGILYVIVKKPSDNPQRELNISLWTSAILTVVLTAFLTYFYLKDAQGLDVVGFRFGPISPWFSAIIGIFAGILVGFWAEYYTSYHYRPTQFLSRSSIEGTGMVISNGLSLGMKSVLPPTLTLVLGILFADYFAGLYGVAISALGMLSFVATSVSVDSYGPIADNAGGISEMCELDPEVRKITDHLDAVGNTTAAIGKGFAIGSAILAALSLFASYMFSQISPSDVGKPPSLILLLNMVDARVIAGALLGAAITYYFSGYLISAVTKAAMKMVDEIRRQAREIPGLLEGKAKPDYNKCIEITSDNALKQMGYPAFIAILTPLVTGFLLGPEFVGGVLIGTVISGAMLAILTANSGGAWDNAKKFLEAGNLEGYGKGSEPHKALVIGDTVGDPLKDTVGPSLDILIKIMSVVSVIAVSIFKHIHLF

SEQ ID NO: 21844 - protein, 367 aa, Robiginitalea biformata HTCC2501
MSENAIRFSRTESPQFFRTLNKRVNAYFKENGLKKTGNWQLYLKTAVMFSLLLAPYFLILTLGLPTWANLLLTMLMGVGMAGVGMNVMHDGNHGTYSSRKWINKLMGGSIYLLAGNVYNWQVQHNVLHHTYTNIHEHDEDLEAGRILRFSKHAKWHRFHRFQHYYSVFLYGLLTFNWAITTDFQQMYRYTKRKLAYGKFPNPVLNWSVLVITKLIYLFIWIALPIIIMDIAWWKVVLGFFIMHYVAGVILSVVFQLAHVVDHADMPLPEKDGTMKNSWAIHQLRTTVNFGTRNRIVNWFTGGLNHQVEHHIFPNISHVHYTKISKIVKQTAREFNLPYNEYKTTRKAIISHFRHLRELGKKPSLQLQ

SEQ ID NO: 21845 - protein, 665 aa, Pseudomonas fluorescens Pf-5
MPSRRERANAIRALSMDAVQKANSGHPGAPMGMADIAEVLWRDYLKHNPSNPSFADRDRFVLSNGHGSMLIYSLLHLTGYDLSIDDLKNFRQLHSRTPGHPEFGYTPGVETTTGPLGQGLANAVGFALAEKVLAAQFNRPGHNIVDHHTYVFLGDGCMMEGISHEVASLAGTLGLGKLIAFYDDNGISIDGEVEGWFTDDTPKRFEAYNWQVIRNVDGHDPEEIKTAIDTARKSPLPTLICCKTTIGFGSPNKQGKEDCHGAPLGDAEIALTRQALNWNYGPFEIPADIYAEWDAKEKGRAAEAEWDQRFAAYSAAFPTEANELVRRLSGDLPADFAEKADAYIAEVAAKGETIASRKASQNTLNAFGPLLPEVLGGSADLAGSNLTLWKGCKGVSAEDASGNYMYYGVREFGMTAIMNGVALHGGLVPYGATFLMFMEYARNAVRMSALMKKRVIHVYTHDSIGLGEDGPTHQPIEQLTSLRTTPNLDTWRPADAVESAVAWKNALERKDGPSALIFSRQNLQHQTRDAGQIADISRGGYVLKDCAGEPELILISTGSEVGLAVQAYDKLTEQGRKVRVVSMPCTSVFDAQDAGYKQSVLPLQVSARIAIEAAHADFWFKYVGLEGRVIGMTTYGESAPASALFEEFGFTLDNILGQAEELLED

SEQ ID NO: 21846 - protein, 434 aa, Saccharomyces cerevisiae
MATLEELDAQTLPGDDELDQEILNLSTQELQTRAKLLDNEIRIFRSELQRLSHENNVMLEKIKDNKEKIKNNRQLPYLVANVVEVMDMNEIEDKENSESTTQGGNVNLDNTAVGKAAVVKTSSRQTVFLPMVGLVDPDKLKPNDLVGVNKDSYLILDTLPSEFDSRVKAMEVDEKPTETYSDVGGLDKQIEELVEAIVLPMKRADKFKDMGIRAPKGALMYGPPGTGKTLLARACAAQTNATFLKLAAPQLVQMYIGEGAKLVRDAFALAKEKAPTIIFIDELDAIGTKRFDSEKSGDREVQRTMLELLNQLDGFSSDDRVKVLAATNRVDVLDPALLRSGRLDRKIEFPLPSEDSRAQILQIHSRKMTTDDDINWQELARSTDEFNGAQLKAVTVEAGMIALRNGQSSVKHEDFVEGISEVQARKSKSVSFYA

SEQ ID NO: 21847 - protein, 104 aa, Brassica napus
MAKRFTTQLFVSRLSGYTTDQSLRQLFSPFGQIKEARLIKDSQTQRPKGFGFVTFESEDDAQKAMKALDGKIVDGRLIFVEAAKDVEAPTTKLDENTHSHYKTS

SEQ ID NO: 21848 - protein, 429 aa, Ostreococcus tauri
  misc_feature (1)..(1): Xaa can be any naturally occurring amino acid
  unsure (1)..(429): unsure at all Xaa locations
XTMDSSPLSLLFTLPCTPMMSPTSTNSVIISNAPGLLHASALVHQRQKRQLPERPLRHHPTAHRLRAPLDLHAVLQPLVFSLKRIAVLRAIEPIIEPPLAQRRQLVQLSHPQRLHLFRRRRHPIPLFFPTNLPTPLRLARVVARRRPRSHRGGEHGLFRRLSSARCVERTISTETSDEPSWLGRVTNTRGAARARGRHRPPRRRDAARARASMALVTLSVYDIKHPGNEGVTSAVASLNALTRDGLRLGGIFHGGVEVYGDEWSFGYIDRGTGVYRCQPKKNPMYAYRESVALGVTSLSPARVSAAVAALKAAWDGPSYDALGRNCNHFCEALCEALGCEGPPKWLNSFANNARGVRDAAVSAREATERAVEGAWAWIASATSQSTSSVSTVRTAGEGAEEGAREREFDSEATSATDDAPHGDAGRETR

SEQ ID NO: 21849 - protein, 233 aa, Sesbania rostrata
MAMAGLYRRLLPCPPAVDFASSQGKQLFLESIQNGTMEGFYRLVSYFQTQSEPAFCGLASLSMVLNALAIDPGRKWKGPWRWFDESMLDCCEPLEKIKVRGISFGKLVCLAHCAGAKVEAFHASHSSIDDFRKYVMKCSTSDDCHVISSYHRGALKQTGTGHFSPIGGYHVGKDMALILDVARFKYPPHWVPLTLLWEGMNYVDESTGQSRGFMLISRPHREPGMLYTLRSGG

SEQ ID NO: 21850 - protein, 184 aa, Borrelia burgdorferi B31
MVVGIILANGFEDIEAIIPIDILRRGNVNIQIISTNDSNVVISSKGVSFLADDIISNCKENCFDLIILPGGMPGATNLFNSKELDLILKDMNSKGKFIAAICASPVVVLAAKGLLGFNKFTCYPGLEKNVLDGEFVDENVVRSNNFITSKGVGTSFEFAFTLLEMVKGKQIMEDVKKATLLCKS

SEQ ID NO: 21851 - protein, 374 aa, Chlorobium tepidum TLS
MEKNEISEERRTQEKEKQHGHRLNIRRLGRKELTELLTRLGEPAYRANQLHRWLYSNQALRFEEMSTLSKQLRQKLASEWIIHPASLVGTERETTDASLVTGNPTAKFLIKLEDNELVESVLIPSEERITACISSQIGCPLRCTFCATGHMGFRRNLTASEITDQVFLLEKEAQKRHWRGLTNIVFMGMGEPLLNLDNVLESIGTLTEKDYQFSISERKITISTVGLPVEMDRIARSGLKTKLAISLHSADQLIRERMMPIAADITLDKLAKAINSYNSVTSQPVTLVYMLLEGINDSPEDARKLVRFAKRVLCKINLIDYNSIVTLKFKPGCSSSKTMFIQQLLDAGLLVTVRKSQGATINAACGQLATRPVR

SEQ ID NO: 21852 - protein, 512 aa, Arabidopsis thaliana
MEISVASVTVSVAVVVVSWWVWRTLQRVWLKPKMLESYLRRQGLAGTPYTPLVGDLKRNFSMLAEARSKPINLTDDITPRIVPYPLQMLKTHGRTFFTWFGPIPTITIMDPEQIKEVFNKVYDFQKAHTFPLGRLIAAGLVSYDGDKWTKHRRIINPAFHLEKIKNMVPAFHQSCSEIVGEWDKLVTDKQSSCEVDIWPWLVSMTADVISRTAFGSSYKEGQRIFELQAELAQLIIQAFRKAIIPGYRYFPTKGNRRMKAAAREIKFILRGIVNKRLRAREAGEAPSDDLLGILLESNLGQTKGNGMSTEELMEECKLFYFAGQETTTVLLVWTMVLLSQHQDWQARAREEVKQVFGDKEPDAEGLNQLKVMTMILYEVLRLYPPVVQLTRAIHKEMQLGDLTLPGGVQISLPILLIQRDRELWGNDAGEFKPDRFKDGLSKATKNQVSFFPFAWGPRICIGQNFALLEAKMAMTLILRKFSFELSPSYVHAPYTVLTTHPQFGAPLILHKL

SEQ ID NO: 21853 - protein, 304 aa, Oryza sativa (indica cultivar-group)
MYPETFGFSAYPQQQQPPPDAASCIYTTALPLIADPPDILGNMAQPSFLSEYDLGGEGDLFKAPEPIIEEPVLSLDPVAAAISMMSGSENVMDETIEVADISDIQNDSLLSEVLYECEKELMEKSAIEETISELLDVKIPMLQVEEFPRETQVQLPAMEKEKPSVPECCSLQKSVSSGCLNSADWINGPARPNFLDFQGLDFETAFGLRRAYSEGDIQNLGASTPRPGNSGNAQLASCERLVTISDLKSEERKQKLSRYRKKKVKRNFGRKIKYACRKALADSQPRVRGRFAKIEEGDLLKPRK

SEQ ID NO: 21854 - protein, 170 aa, Oryza sativa (indica cultivar-group)
MADLSFCSLFISFLQLGSSTLHCTLGVLSSHLLFSQISEILSRFERKGFKLVAIKLVVPSKEFAQKHYHDLKDRPFFNGLCDFLSSGPVLAMVWEGEGVIKYGRKLIGATDPQKSEPGTIRGDLAVVVGRNIIHGSDGPETAKAEIGLWFEPRELVSYTSNEEKWIYGVN

SEQ ID NO: 21855 - protein, 426 aa, Bacteroides thetaiotaomicron VPI-5482
MKIEKIVAREILDSRGNPTVEVDVVLESGIMGRASVPSGASTGEHEALELRDGDKQRYGGKGVQKAVDNVNKIIAPKLIGMSSLNQRGIDYAMLALDGTKTKSNLGANAILGVSLAVAKAAASYLDLPLYRYIGGTNTYVMPVPMMNIINGGSHSDAPIAFQEFMIRPVGAPSFREGLRMGAEVFHALKKVLKDRGLSTAVGDEGGFAPNLEGTEDALNSIIAAIKAAGYEPGKDVMIGMDCASSEFYHDGIYDYTKFEGAKGKKRTAEEQIDYLEELINKFPIDSIEDGMSENDWEGWKKLTERIGDRCQLVGDDLFVTNVDFLAMGIEKGCANSILIKVNQIGSLTETLNAIEMAHRHGYTTVTSHRSGETEDATIADIAVATNSGQIKTGSLSRSDRMAKYNQLLRIEEELGDLAVYGYKRIK

SEQ ID NO: 21856 - protein, 300 aa, Mycobacterium smegmatis str. MC2 155
MSTSGIDVTAQLGTLLTAMVTPFKPDGSLDLDAAAQLAARLVDSGCDGLVLSGTTGESPTTSDDEKIALLRTVVDAVGDRARVIAGAGSYDTAHSVHLAKASAEAGAHGLLVVTPYYSRPAQAGLLAHFTAVADATDLPVVLYDIPPRSVVPIAWDTLRKLAEHPNIVAVKDAKGDLPGGGQIIAETGLAYYSGDDALNLPWLAMGALGFISVWGHLAAGQLRDMLTAFNSGDVATARKINVNLAPLAAAQARLGGVTMSKAGLRLQGFDAGEPRLPQIPATTEEVEALAADMRAATVLR

SEQ ID NO: 21857 - protein, 181 aa, Zea mays
MAGATTPASGALVRLCLPSLLLFLYRCCRCEAVEMERTLAMIKPDGLSGKYTEAIKEVILDSGFHIVKETEVQLDAERASVFYAEHSQRSFFDSLVKYITSGPVLAMVLERPDAVAQWRTLIGPTDAKKAKTSHPNSIRAMCGLDSEKNCVHGSDSPESADREISFFFGEAESVTVEHDEL

SEQ ID NO: 21858 - protein, 310 aa, Brassica napus
MADLIPFYLNIVAFLCTVGAIALAIFHIYRHLLNYTEPTYQRYIVRIIFMVPVYAFMSFLSLVLPTSSIYFDSIREVYEAWVIYNFLSLCLAWVGGPGAVVLSLSGRSLKPSWCLMTCCFPPLTLDGRFIRRCKQGCLQFVILKPILVAVTLVLYAKGKYKDGNFNPDQAYLYLTIIYTISYTVALYALVLFYMACRDLLQPFNPVPKFVIIKSVVFLTYWQGVLVFLAAKSGFIQTAEEAAHFQNFIICVEMLIAAACHFYAFSYKEYAGANVGGAGSFSGSLSHAVKLNDFYHDTVHQFAPTYHDYVL

SEQ ID NO: 21859 - protein, 605 aa, Oryza sativa
  misc_feature (71)..(71): Xaa can be any naturally occurring amino acid
  unsure (1)..(605): unsure at all Xaa locations
MSPNLESHIKSQVPALLLRRFFGGAGRRRVFVQTETGCVLGMDLDRSDNAHTVKRRLQLALNVPTGETSLXFGDRVLENDLSFIRPDSPLLLTRNSINRSCSTPCLCPVSKDFEHKDRSGLVEMLGCSISCARVKRLVDDVVTAIRSGVDPVPIGSGLGGSYYFRNISGDRVAIVKPTDEEPFAPNNPKGFVGRALGQPGLKKSVRVGETGFREVAAYLLDHDNFANVPPTALVKITHSIFHINCPVNGGSPAHDQKQQVSSKIASFQQFIAHDFDASDHGTSSFPVAAVHRIGILDIRIFNTDRHAGNVLVRKLDGGTGRFGCQTELFPIDHGLCLPENLEDPYFEWIHWAQSSIPFSEEELEYIKNLDPMRDVAMLRRELPIIREACLRVLVLCTIFLKEAAASGLCLAEIGEMMTREFRGLEEEPSKLEVVCMEARRKLAEWEPYSPVIEQGEDMDFQFSLDMLGEYNDVIRSPRFNGLGAKGNGFRNPLSKLVESIDEDNDDDDGRSESSKRSSERVHSGGLKFPSADKSSGSNGSVHALNRSADEQLPSSVYFVRLSDMNAEEWNIFLEKFQELLKEALQERAAAAGQRMKQRLGTSCKF

SEQ ID NO: 21860 - protein, 246 aa, Cytophaga hutchinsonii ATCC 33406
MKTYGLIGFRLSHSFSKKYFTEKFLKEGIEDCVYENFQLDTVKEFSALLRTDANLKGFNVTIPYKEEIIPFLNDLDAAAKEIGAVNVIKIQEDGTLIGYNSDYYGFKTSLETFIPKEVSHKALVLGTGGAAKAVVTALNHLGIPYQYVSRNKSAQSLSYEELDQNVMQEYTLVVNTSPLGMYPEVDSFPAIPYEFLDSRHYLYDLVYNPEETLFMKKGIARGAHVMNGLPMLIGQAEKAWEIWNSK

SEQ ID NO: 21861 - protein, 150 aa, Triticum aestivum
  misc_feature (138)..(138): Xaa can be any naturally occurring amino acid
  unsure (1)..(150): unsure at all Xaa locations
MAEQTFIMIKPDGVQRGLIGEVISRFEKKGFYLKGLKLQNVEKSFAEQHYSDLSSKPFFAGVVEYIVSGPVVAMVWEGKSVVATGRKIIGATNPLASEPGTIRGDFAVDIGRNVIHGSDSFESARKEIALWFPEGIAXWRSSQHNWIYEA

SEQ ID NO: 21862 - protein, 622 aa, Pseudomonas fluorescens Pf-5
MSFASLGLSEALVGAIEAAGYTQPTPVQQRAIPAVLQGRDLMVAAQTGTGKTGGFALPILERLFPNGHPDKSQRHGPRQPRVLVLTPTRELAAQVHDSFKLYARDLKFVSACIFGGVGMNPQVQAMARGVDVLVACPGRLLDLAGQGSVDLSHVEILVLDEADRMLDMGFVHDVKKVLARLPAKRQNLLFSATFSKDITDLAGKLLHNPERIEVTPPNTTVERIEQRVFRLPASHKRALLAHLITAGAWEQVLVFTRTKHGANRLAEYLDKHGLSAVAIHGNKSQNARTKALADFKAGEVRILVATDIAARGLDIDQLPHVVNFELPNVDEDYVHRIGRTGRAGRSGEAISLVAPDEEKLLKSIERMTKQKIADGDLMGFDASAVEAEKPEVRERPDVRNPRNPRGPRGDGPNGGGGGGGRKDKGKDKGGKEKPARGERPAREQKPREGTPAREQRQPTPRADRAPDEFLDDDVDNFGNRADYVSPYQNKNNQGRGRRPGAPAQGAGAGNPPRGGAGGGQGRSGNPRNSNGSTTGTAPAKRSGGPRNGAPRDSQGRRDEPRNRRPNRDDQPRQEPAVQNPRGNQPKIMHKESKADRFPTPEQLDQLPSRPRGEKPALLTRNR

SEQ ID NO: 21863 - protein, 180 aa, Hordeum vulgare subsp. vulgare
MFPMVSGFMSYGQQTIRATRYIGQSFITTLSHTNRLPITIHYPYEKSITPERFRGRIHFEFDKCIACEVCVRVCPIDLPVVDWRFEKDIKRKQLLNYSIDFGVCIFCGNCVEYCPTSCLSMTEEYELSTYDRHELNYNQIALSRLPISIMGDYTIQTIRNSSESKINEEKSSNSRTITDY

SEQ ID NO: 21864 - protein, 367 aa, Dehalococcoides sp. BAV1
MAIKTENFILNIGPQHPSTHGVFRLRIVLDGEVITDLEPVFGYLHRGIEKLAEGRTYLQDIPFTDRLDYLGSMTNNHAYVMAVEKLAGITVPERAEYIRVILDELQRIASHLAGLGFFLNDLGALQTPLLYMFREREKIVELFDMCSGQRLNYNYYRFGGFVQDLPEEFLPALKILLDTLPGFIDEYEQLISTNEIVLIRTKGVGVLKRDLAINSSAAGPVLRASGINWDIRRNDPYSIYNRFEFDIPIAKNGDTYDRYMIRILEMRQSVRILRQAVKDLPEGEIMGKAPKLLKPPAGEVYSRIEGPKGELGFYLVSDGTDKPYRWRVRPPCLLNLSALKDMVVGWKVADLMAIFGSIDIVMGEVDR

SEQ ID NO: 21865 - protein, 468 aa, Pseudomonas fluorescens Pf-5
MGLNNQWMQRDLAVLWHPCTQMKDHEQLPLIPIKRGEGVWLEDFEGKRYLDAVSSWWVNVFGHANPRINQRIKDQVDQLEHVILAGFSHQPVIELSERLVKITPEGLTRCFYADNGSSCIEVAMKMSFHYWINRGQPNKKRFVTLSNGYHGETIAAMSVGDVPLFTETYKALLLDTLKVPSPDCYLRPEGMSWEEHSRNMFAAMEQTLAEHHETVAAVIVEPLIQGAGGMRMYHPVYLKLLREACDRYGVHLIHDEIAVGFGRTGTMFACEQAGIRPDFLCLSKALTGGYLPLAACMTTDDVYSAFYDDYPTLRAFLHSHSYTGNPLACAAALATLDIFEQDNVVENNHALARRMASATAHLVDHPHVAEVRQTGMVLAIEMVQDKASKTAYPWQERRGLKVFQHALERGALLRPLGSVVYFLPPYVITPEQIDFLAEVASEGIDIATRDQVSVAVPKDFHPGFRDPG

SEQ ID NO: 21866 - protein, 161 aa, Ostreococcus tauri
MGSITSPKPRADSYDAIIVDSSDPIGPASVLFEEKFFRQIYRVLKPGGVLCSQAECAWLHLDLIVDLAKMCKEIFVNGSVQYGYTSIPTYPSGQIGFMLCCKPDEDGSTVDFTKPKRYPTPVEGSDLKPMRYYNAQVHAAAFVLPEFAREALEPHLVRGKE

SEQ ID NO: 21867 - protein, 1152 aa, Arabidopsis thaliana
MATSSSSCNWVYDVFPSFSGEDVRKTFLSHLQLVLDRKLITSFKDNEIERSQSIAPELVQGIKDSRIAIVIFSKNYASSSWCLNELLEIVSCKEDKGQLVIPVFYALDPTHVRKQTGDFGMAFERTCLNKTEDEKNLWRVALTHVANILGYHSAQCRANPDDYNMKLHLQETFLSTILGKQNIKIDHLGALGERLKHQKVLLFIDDLDQQVVLNALAGQIQWFGSGSRIIVVTNDKHLLISHGIENIYQVCLPSKELALEMLCRYAFRQNTPPDGFKKLAVEVVRHAGILPLGLNVLGSYLRGRNKRYWMDMLPRLRKGLDGKIQKALRVGYDGLDNKKDEAIFRHIACLFNFEKVNDIRLLLADSDLNFNIGLENLVDKSLVNVRSNIVEMHCLLQEMGREIVRAQSNEAGEREFLMDTEDICDVLDDNIGTKKMLGISLDVDEIDHELNVHEKAFQGMRNLRFLNIYTKALMSGQKIRLHLPENFDYLPPKLKLLCWDKYPMRCLPSSFRPENLVKLKMQESELEKLWEGVGSLTCLKDMDLEKSKNLKEIPDLSMATNLKTLNLKYCSSLVKISSSIQNLNKLTKLNMEGCTNLETLPAGINLKSLHRLDLRGCSRLRMFPDISNNISVLFLDKTSIEEFPSNLHLKKLFDLSMQQMNSEKLWEGVQPLTCLMKMLSPPLAKNFNTLYLSDIPSLVELPCGIQNLKKLMELSIRRCKNLESLPTGANFKYLDYLDLSGCSKLRSFPDISSTISCLCLNRTGIEEVPSWIENFVRLTYLTMLECNKLKYVSLNIFKLKHLDKADFSDCGTLTEVSWCNKTISVAAATADNIQPKLLVSEASSSLCVQKSVVRFINCFKLDQEALLQQEPVFKSLILGGEEVPAYFNHRATGNSLVIPLVPTSISLDFLGFRACALVDVKAMSMPGRVDIQVSCRFRGSLKNHFDSADHSHSLVAFHKASHLLIFDCRFALNNDSNPLNYAHMDITFHLTTDSVSKINACGIRFSEGVSPQKHLNGPSSIVHVCEADESKLDNDRRHAHETEHGEECGDSNVETVVSRKRIKNKKKKKKNKGLKNPNKKRKTSLKKNKGLKNPKRKTSLNNVLKYPLADHYSPDQISQLIQSLEPHVSKVRERFVLLSRRNRSRQNRIIRV

SEQ ID NO: 21868 - protein, 277 aa, Oryza sativa (indica cultivar-group)
MGAVSMSTTTRLPLVAALLSAAACVAAAQPATAEAAPETPGVGIKVSFRPSVAIVVGIFTMIFSLTFLLLMYAKFCHPSSPVAAPAPTVVPAAAADDGVAKPVIESLPFFRFAALRGARQGLECAVCLARFDDADLLRLLPRCRHAFHLDCVDRWLESKASCPLCRARVDAEDAALGLKYASSARFVPAGGASESERFDGDQDLLGIFVERVPSSRMEPAAAAHCPDLDRYKHRIVVSDAAGDDQVKLNFWDGRHIFHDEYPPFSATTTTYGIHNGK

SEQ ID NO: 21869 - protein, 320 aa, Oryza sativa (japonica cultivar-group)
MSKDTSSKRSLGDIILEKIREKDAEISTEGRTPVKLDSSIIELYKGVGEFLSRYTSGKIPKGFKRIPSLECWPDVLQLTEPENWSPNAVYQATRLFSSNMNAKNAVRFYEAILLPRVRNDIRKNKRLHFALYQSLKKCLYKPAAFFKGILLPLCQERNCTLREAVIIGSIISKVSIPPLHASAALMKLAEMEYCGTTSYFIKLFLDKKYALPYRVVDAVFAHFMRFIDEERVMPVIWHQSLLAFVERYKNELEKKDKEKLARLLDHQKHYLVTPEIRRELRMSCNRGEKDTIMSICSPVSVITKPIEEDRWNVPEVPMEE

SEQ ID NO: 21870 - protein, 252 aa, Kandelia candel
MPIRQIAVGHPHEATRPDVLKAALAEFISTLIFVFAGEGSGMAFNKLTDNGSTTPAGLIAASIAHAFGLFVGVSVSANISGGHVNPAVTFGAFIGGNITLLRGILYWIGQLLGSTVACLLLKFSTGGLTTSAFSLSSGVSVWNAFVFEIVMTFGLVYTVYATAIDPKKGNLGTIAPSPSVSLWVPSVWTGGAFDGASMNPAVSFGPALVSWTWENHWVYWAGPLIGSAIAALIYDSFFIGYGTHEQLPTADY

SEQ ID NO: 21871 - protein, 104 aa, Oryza sativa (indica cultivar-group)
MEFWGLEVKPGQTVKCEPEDERFLHLSQAALGESKKGSDNAVMYVKTDDQKLVIGTLSADKFPQIQFDLVFDKEFELSHTSKTASVFFSGYKVSQPAEEDEYPL

SEQ ID NO: 21872 - protein, 210 aa, Magnetospirillum magnetotacticum MS-1
MSPIRAVLFDLDGVLVDAREWHWEALNQALRLFGYEIGREEHLTTFDGLPTRKKLAYLHEHRGFPKGLAGVINELKQVYTKQLIATHCFPVFHIEYAVSRLKTENYKLAVCTNSIRETCDMMLGQSGLLDYFDTTLSNQDCARPKPDPDIYVTAMSRLGVAPAETVIVEDNDYGVQAATASGAHVLRVADPSEVTYWNIRSRIRQVEAAS

SEQ ID NO: 21873 - protein, 433 aa, Pneumocystis carinii f. sp. ratti
MGIFKIHARSFYDSRGNPTVEVEVTTETGVHRANVPSGASTGIHEALELRDNGSSWSGKGVTLAVSNVNDIIAPSLLSAGIDIKDQRSIDKFLIDLDGTSNKSRLGANAILGVSIAICKAAAAEKGVPLYRHFADIADIKEPFILPLPCFNVLNGGSHAGGRLAFQEFMILPTSAVTFHEAMQQGSEVYSALKKLSRKRYGHSAGNAGDEGGVAPDIQTADEALDLIVTAIEEAGYTGKIKIALDVAASEFYKNGKYDLDFKNPESDSSQHKTSKELADIYLDLSKKYPIVSIENPVDRDDWDAWIYVSRRATFQMVGDDLTVTNVSRINEAADKKACNCLLLKINQIGTISESIDAFKTAFDAGWGVMVSHRSGETEDTVIADLVVGLGTGQIKTGAPCRSERVAKYNQLLRIEEELNHSVYASMNYIKNIK

SEQ ID NO: 21874 - protein, 408 aa, Arabidopsis thaliana
MGSLRRSTSNRSRKKGTAVKMNRMPSSLLPPTPPCSAIVGGTGKSKKRRGGVCLWTRFDRTGFMEVAGCDKSTIIERSSVSAKDLRTAFSHSSKILAREKAIVLNLEVIKAVITSEQVMLLDSLRPEVLTLTDRLKHHFPRKDGPENILQASSHGHQEGGEEGLKSKLPFEFRVLEIAFEVFCSFVDSNVVDLETQAWSILDELTKKVSNENLKDLRSLKTSLTHLLARVQKVRDEIEHFLDDKEDMEDLYLTRKWIQNQQTEAASNSIVSQPNLQRHTSNRISTSMVTEEDDIDDMEMLLEAYFMQLEGMRNKILLMKEHIDSTEAYVKILQNSRRNGLIHLMMLVNIGNYAITAGTVVVNLFGMNIPIGLYSTPDIFGYVVWAVVALCIVLFIVTVGYAKWKKLLD

SEQ ID NO: 21875 - protein, 482 aa, Solanum tuberosum
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSSHLGRPKGVTPKYSLAPLVPRLSELLGIQVVKADDCIGPEVEKLVDSLPEGGVLLLENVRFYKEEEKNEPEFAKKLASLADLFVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFATGTEAIAKKLADLSGKGVTTIIGGGDSVAAVEKVGVASVMSHISTGGGASLELLEGKVLPGVIALDEADAPVAV

SEQ ID NO: 21876 - protein, 345 aa, Oryza sativa (japonica cultivar-group)
MVVTIDLREVTIDLREEDEAAAAAAMKAIAGRSDEEVLAAVLARKGGPVPFLQAAIDAAAAAATKAIAGRSDEEVLAAVLARKGGPVPFLQAAIDVAQRRSDLFLDPSAPGVVAEMAVEAQAKAEAEERRKRAKGEPRKAEEMLKEEEPMKAEEMLKEEEPMKAEEMLKEEPRTPMREAGRDKVERAAVVERVRDPKPNAGNGLDLEKYSWTQERPEVTITIPVPQGTKSSLVTYEIMKNHLKVGLKGCSFIIDGELFEPVKVNDCLWTIEDGNTLSILLTKENQKEWWTSVIKGDPELDPRDMKVPELRDCDVEAKETIVRILSHGLPKAMNFCPFMHNRFSYH

SEQ ID NO: 21877 - protein, 657 aa, Staphylococcus aureus subsp. aureus Mu50
MAKETFYITTPIYYPSGNLHIGHAYSTVAGDVIARYKRMQGYDVRYLTGTDEHGQKIQEKAQKAGKTEIEYLDEMIAGIKQLWAKLEISNDDFIRTTEERHKHVVEQVFERLLKQGDIYLGEYEGWYSVPDETYYTESQLVDPQYENGKIIGGKSPDSGHEVELVKEESYFFNISKYTDRLLEFYDQNPDFIQPPSRKNEMINNFIKPGLADLAVSRTSFNWGVHVPSNPKHVVYVWIDALVNYISALGYLSDDESLFNKYWPADIHLMAKEIVRFHSIIWPILLMALDLPLPKKVFAHGWILMKDGKMSKSKGNVVDPNILIDRYGLDATRYYLMRELPFGSDGVFTPEAFVERTNFDLANDLGNLVNRTISMVNKYFDGELPAYQGPLHELDEEMEAMALETVKSYTESMESLQFSVALSTVWKFISRTNKYIDETTPWVLAKDDSQKDMLGNVMAHLVENIRYAAVLLRPFLTHAPKEIFEQLNINNPQFMEFSSLEQYGVLTESIMVTGQPKPIFPRLDSEAEIAYIKESMQPPATEEEKEEIPSKPQIDIKDFDKVEIKAATIIDAEHVKKSDKLLKIQVDLDSEQRQIVSGIAKFYTPDDIIGKKVAVVTNLKPAKLMGQKSEGMILSAEKDGVLTLVSLPSAIPNGAVIK

SEQ ID NO: 21878 - protein, 665 aa, Streptococcus pyogenes serotype M6
MKKPFYITTPIYYPSGKLHIGSAYTTIACDVLARYKRLMGHEVFYLTGLDEHGQKIQTKAKEAGITPQTYVDNMAKDVKALWQLLDISYDTFIRTTDDYHEEVVAAVFEKLLAQDDIYLGEYSGWYSVSDEEFFTESQLKEVFRDEDGQVIGGIAPSGHEVEWVSEESYFLRLSKYADRLVAFFKERPDFIQPDGRMNEMVKNFIEPGLEDLAVSRTTFTWGVPVPSDPKHVVYVWIDALLNYATALGYGQANHANFDKFWNGTVFHMVGKDILRFHSIYWPILLMMLDLPMPDRLIAHGWFVMKDGKMSKSKGNVVYPEMLVERFGLDPLRYYLMRSLPVGSDGTFTPEDYVGRINYELANDLGNLLNRTVAMINKYFDGTVPAYVDNGTAFDADLSQLIDAQLADYHKHMEAVDYPRALEAVWTIIARTNKYIDETAPWVLAKEDGDKAQLASVMAHLAASLRVVAHVIQPFMMETSAAIMAQLGLAPVSDLSTLALADFPANTKVVAKGTPIFPRLDMEAEIDYIKAQMGDSSAISQEKEWVPEEVALKSEKDVITFETFDAVEIRVAEVKEVSKVEGSEKLLRFRVDAGDGQDRQILSGIAKCYPNEQELVGKKLQIVANLKPRKMMKQYISQGMILSAEHGDQLTVLTVDPSVPNGSIIG

SEQ ID NO: 21879 - protein, 395 aa, Oryza sativa (japonica cultivar-group)
MRHKQKTPPCTVHTILASPMAPTSSVHREGGSAAMDMAELIPTLPLETGSPPFPLRQYGGYWLPEWVLPGLEAVHTRFEPRPSDVFLASFPKSGTTWLKALAFATINRTTYPPSGDAHPLRHRGPHDCVKFFESTFAISGEGGGGDVDVFAALPSPRAVARPGTCSPPSRRRARLLATHIPYSLLPERITSAAADDGDSGCRIVYVCRDPKDAFVSMWLFTMSNMVKGVTTTTDEHHPAAAAAAPSIEQVFDLFCDGRSIAGPQWHHVREYWEESRRRPEKVLFLRYEEMLREPARNVERLAEFLRCPFTAGEVAAGVVDAIVDLCSIDRLRNVQANKTGVTDLAVKKESFFRRGVAGDWSNHMSPEMASRLDRVVEDALRGSGFTFAAAAGDSE

SEQ ID NO: 21880 - protein, 434 aa, Oryza sativa (japonica cultivar-group)
MARGAAGGEVGRSMPAVHDAHDDSENFLELLNSRTLAPELFAEPPACDYLKKMEYGGGGGGGGGGWPEHQFTAAAALEKHLSSAAAAGYGGALAHHHHAAGAPERLTANLSDLVSNWSIAPPNHGHHVGGAAACDNPAVAAAMAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKVPKVKLGDKITALQQIVSPFGKTDTASVLYEAINYIKWLHEQVQLLSDPYMKSSSSKDYNAWGGLDRKEKADAEVDLRSRGLCLVPVSCTPQVYRDNNGPDYWTPPYRSCLYR

SEQ ID NO: 21881 - protein, 126 aa, Staphylococcus aureus subsp. aureus Mu50
MKIINTTRLPEALGPYSHATVVNGMVYTSGQIPLNVDGKIVSADVQAQTKQVLENLKVVLEEAGSDLNSVAKATIFIKDMNDFQKINEVYGQYFNEHKPARSCVEVARLPKDVKVEIELVSKIKEL

SEQ ID NO: 21882 - protein, 167 aa, Eucalyptus globulus subsp. globulus
MFPMVTGFMNYGQQTVRAARYIGQGFMITLSHANRLPVTIQYPYEKLITSERFRGRIHFEFDKCIACEVCVRVCPIDLPVVDWKLETGIRKKRLLNYSIDFGICIFCGNCVEYCPTNCLSMTEEYELSTYDRHELNYNQIALGRLPMSVINDYTIRTISNSPQIIIK

SEQ ID NO: 21883 - protein, 668 aa, Prochlorococcus marinus str. MIT 9515
MVAASVSLESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCEIVDHYTYVIMGDGCNQEGIASEACSLAGHLKLGKLIALYDDNQITIDGRTDVSFTEDVLKRYEAYGWHVQHVEDGNHDVQGITKAIESAKSVKDKPSLIKISTTIGYGSPNKSDTAGIHGAAVGEEEASLTREFLNWEYPPFEIPDEVYTQFRQAITKGEESEKEWNLKFKGYQNSYPSEGNELKRMIQGDLPENWDSDLPSYTPDDKGLATRKHSQICLGALGPNLPELIGGSADLTHSNYTDIKGETGSFQAHSPEKRYLHFGVREHAMAAILNGIAYHDSGLIPYGGTFLVFADYMRGSMRLSALSELGVIYVLTHDSIGVGEDGPTHQPVETIPSLRAMPNMLVFRPGDGNETSGAYKIAIKNRKRPSALCLSRQAMPNQENTSIEKVALGGYIVSDCEGTPEVIFIGTGSELNLCIEASKEISKSGTKTRVISMPCVELFEEQDPSYKESILPSSVKKRVVVEAAHSFGWHKYTGLDGICITMDRFGASAPGGKCMTSFGFTVENVINKTREIL

SEQ ID NO: 21884 - protein, 393 aa, Eucalyptus globulus subsp. globulus
MNVTTTRKDLMIVNMGPHHPSMHGVLRLILTLDGEDVIDCEPILGYLHRGMEKIAENRTVIQYLPYVTRWDYLATMFTEAITVNGPEQLGNIQVPKRASYIRVIMLELSRIASHLLWLGPFMADIGAQTPFFYIFRERELVYDLFEAATGMRMMHNYFRIGGVAADLPYGWIDKCLDFCDYFLTAVSEYQKLITRNPIFLERVEGVGIIGPEEAINWGLSGPMLRASGIQWDLRKVDHYECYDELDWEIFWQKEGDSLARYLVRIGEMRESIKIIQQALEGIPGGPYENLETRCFARERDPEWNDFEYRFISKKPSPTFELPKQELYVRVEAPKGELGIFLIGDQSGFPWRWKIRPPGFINLQILPQLVKRMKLADIMTILGSIDIIMGEVDR

SEQ ID NO: 21885 - protein, 456 aa, Prochlorococcus marinus str. MIT 9515
MRNSWIKPRLGQKNITQMNFAKNGIITEEMNYVAQKENLPSSLIMEEVARGRLIIPANINHVNLEPMAIGIASKCKVNANIGASPNASDINEEVEKLRLAVKYGADTVMDLSTGGVNLDEVRQAIIKESSVPIGTVPVYQALESVHGSIDRLTEDDFLHIIEKHCQQGVDYQTIHAGLLIEHLPKVKGRITGIVSRGGGILAQWMLHHFKQNPLYTRFDDICEIFKKYDCTFSLGDSLRPGCLHDASDDAQLAELKTLGELTRRAWAHNVQVMVEGPGHVPMDQIEFNVRKQMEECSEAPFYVLGPLVTDISPGYDHISSAIGAAMAGWYGTAMLCYVTPKEHLGLPNAEDVREGLIAYKIAAHAADIARHRAGARDRDDELSHARYTFDWNKQFELSLDPERAKQYHDETLPEEIFKKAEFCSMCGPKHCPMNSKISDETLDQLNNKLAKCDIKV

SEQ ID NO: 21886 - protein, 445 aa, Treponema primitia
  misc_feature (38)..(38): Xaa can be any naturally occurring amino acid
  misc_feature (160)..(160): Xaa can be any naturally occurring amino acid
  unsure (1)..(445): unsure at all Xaa locations
FTGDFHAIGAANNLLAAMIDNHIYQGNKCNIDPRKIIXHRCVDMNDRQLRFIVDGLGGKANGASREDWFDITVASEVMAILCLSKDIDDLKARLGRIIVGYTYGKQSDNTEKPVTAGQINAQGAMAALLKDALKPNLVQTLEGTPAFIHGGPFANIAHGXNSIMATRLALKMGDYVVTEGGFGADLGAEKFLDIKCRFAGLKPSAVVIVATVRALKSHGGVAKADLEKENLDALEKGLPNLLQHVENITKVYNLPAVVAINAFPKDTKAELDLVEKKCKELGVNVALSEVWAKGGEGGQKLAEEVVKLCELPNKFTFSYDEKSSIKDKIEAIAKKIYHADGINILPVAQKQIAQLEKLGMDKVPICMAKTQYSFSDNPDLKGAPKGWTLTVRNIKISAGAGFIVALTGDIMTMPGLPPVPSAEKSTWTTPGKFPACSDSVTLKNG

SEQ ID NO: 21887 - protein, 723 aa, Thermotoga sp. KOL6
MWLLFLVPLIALGFAAANFSAVVKKPEGTDRMKEISSYIRSGADSFLAHETKAIFKVAIVIAILLMIFTTWQTGVAFLIGAVMSASAGIVGMKMATRANVRVAEAARTTKKIGPALKVAYQGGSVMGLSVGGFALLGLVLVYLIFGKWMGQLDNLNIYTNWLGINFVPFAMTVSGYALGCSIIAMFDRVGGGVYTKAADMAADLVGKTELNLPEDDPRNPATIADNVGDNVGDVAGLGADLLESFVGAIVSSIILASYMFPIYVQKLGERFVHQIPKETIQSLISYPIYFALVGLGCSMLGILYVIVKKPSDNPQRELNISLWTSAILTVVLTAFLTYFYLKDAQGLEVVGFRYGPISPWFSAIIGIFAGILVGFWAEYYTSYHYKPTQFLSRSSIEGTGMVISNGLSLGMKSVLPPTLTLVLGILFADYFAGLYGVAISALGMLSFVATSVSVDSYGPIADNAGGISEMCELEPEVRKITDHLDAVGNTTAAIGKGFAIGSAILAALSLFASYMFSQISPSDIGKPPSIVLLLNMVDARVIAGALLGAAITYYFSGYLISAVTKAAMKMVDEIRRQAREIPGLLEGKAKPDYNKCIEITSDNALKQMGYPAFIAILTPLITGFLLGPEFVGGVLIGTVISGAMLAILTANSGGAWDNAKKFLEAGHLEGYGKGSDPHKALVIGDTVGDPLKDTVGPSLDILIKIMSVVSVIAVSIFKHIHLF

SEQ ID NO: 21888 - protein, 180 aa, Zea mays
MASLLGRFCRKLVVPGSAHGSRMVSTTACDSEAVKSLNLYSAINQALHIALETDPRSYVFGEDVGFGGVFRCTTGLAERFGKNRVFNTPLCEQGIVGFGIGLAAMGNRAVVEIQFADYIYPAFDQIVNEAAKFRYRSGNQFNCGGLTIRAPYGAVGHGGHYHSQSPEAFSFLPLVPWGYL

SEQ ID NO: 21889 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 21890 - protein, 324 aa, Chlorobium tepidum TLS
MDINVVTFSVTEELKQFQERYKTVLHSSNSLVDKVTRYVLRQQGKQIRPTLVILAAKVCGGVHDVTYRGAIMVELLHSATLIHDDVVDGAEMRRGIPSINALWKNKISVLIGDYLLSKGLLYSLENKDYRSLHLVSEAVRRMSEGEILQIQKTRSLDITEEDYLSVIADKTGSLIATSCAIGAASSTDSEDEIASLKSYGEFLGLAFQIRDDLLDYTGDSKKTGKQLGIDIKDRKITLPLIYALRQSDKSEQNKIKSILKSSRKRSVRSGEVIDFVTRKGGLDYAAEVAEGFADKALESIAHFPESDAKRSLQLLVDFVMKRQH

SEQ ID NO: 21891 - protein, 108 aa, Glycine max
  misc_feature (85)..(85): Xaa can be any naturally occurring amino acid
  unsure (1)..(108): unsure at all Xaa locations
AASMISSPAVTTVNRAGAGMVAPFAGLKSMGGFPTIKTNSDVAFIASYGGRVQFKLVWPPVGNKMFYTLFFLPYLYDAQLAKEVXFLHRKGWITWLEFEWEHGFLCRE

SEQ ID NO: 21892 - protein, 159 aa, Polaromonas sp. JS666
MNTEFDILNASILVVDDQAANVQLLEQLLSNTGYTRVRSTMNPLEVAGLHAEHRYDLILLDLKMPGMDGFQVMQELKKNTSDDYLPVIVLTAEPGHKLRALEAGAKDFISKPFDLVEVKTRIHNMLEVRLLYKKLDNYSKLLEHAVHQGTVEIDEARRQ

SEQ ID NO: 21893 - protein, 555 aa, Glycine max
MEGIISGVWNVLLQYFRSYKVAKTAVLNYITPFTDKFDLVDILLVWTVIVVIGTVIYRNVNYARKHGFRKTVTAWFFRRLKRISFITNKIDGEISKLASSLEADIQKHRDASKTTHIPTTGLSEEALVKKLAQWQKIDHKIYGEKKITGCIYYNEGEKLQTIVKDVAKEYFYINPLHFDLFPTANQMEGEVIYMVKNLYNGDDKSCGILSSGGTESIMIAMLAYREQGRINGIFEPEIVAPITAHVAFENAAFYYGMRMKWVPVDIKTGVVSPHDIKKAISKDTVCVIGSYPNYPYGTCDPIEQLAAIAKKKKVGFHTDCCLGGFVAPFAEKFGAMSEVFDFRVPGVTSISVDPHKYGLAPKGVSVVLFRDRKLRGGSFFSCTTWPGGIYSTPTHAGSRGHAPVAGAWVALQYTGYNGYMDKAGKIIEATRRVAKKISEIPELQVVGNPQLGSVAFVTKTNKLSIYDLVDKIGQRGWKLAALQLPPAVHLSITNYNIGQIEDFIASVKWGVTELLKAGPPKVQGELAQIYGSNAKLPESIMQDGAKVILEGLLKP

SEQ ID NO: 21894 - protein, 412 aa, Oryza sativa (indica cultivar-group)
MNPTESKKRRSKSNQAAGEPTALDPDAASVVGADGAPDATAVACGALRASAPGAGFPTAGAHAASPWWQESSPDSSEWMYPPGGFLNYLQNNKISPFSQTHPFVNYHNASKLPENFHFVGAPISYSTMSHTIPCSKAIPSPTGRSEKRLNWSNEEDIRLASAWLHNSIDSIDGNDKKSNQYWLDVTATYNNTTKSNCMRNCNQLKQRWERIKKPVSEFNGFYARITKIHQSGMSEDQKMDQAFQLYASEHNDKRFTMVHVGRILRHEKKWSTYLKKIKKEKDKSVTPNPTHVVNVKDAPKQRPIGHKKAKDDCSGKRLTSDAISVIDQKLDKFIEASSNAEKMGEVQQSLANKKLEVANLNHKAAQEQTMGKMIDLYKDLLLAPTSDLSEEALAERSKALECMRLALFAKDN

SEQ ID NO: 21895 - protein, 537 aa, Zea mays
AEAEEGTVEQNTPPWMATKKVTALAAICLVALPILMVTTVSRRDVPRTPASFWPLATLARQEKLVGGLLVPGFDERSCLTRYQSAFYRKNLARSPSAHLIRRLRQHEALQRRCGPGTEAYRAAAARLRSSSHRSGSNDDNDTRGACRYLVLVPYRGLGNRILAVASAFLYAVLADRVLLLGGETSLGDVFCEPFPGTSWLLPPRFPIGDLQNLTGDVRESYGNLVQQSDSAAAAAASGLRYVFVDLDHSCTYHDKLFFCDDGERQFLRRAAWLVMRTDGYFVPALFLNPAYQDELDGMFPRKDSVFHLLAHYLFHPTNEVWGLVTRFHRSYLRGSDERLGIQVRVFDGDAPFQHILDQILACTSQEHLLPDVAVTQEPSAGRGARSKAVLMTGLSSWYYEKIRWKYWQSATATGEVVSVYQPSHEEHQLSGYTTHDMKAVAEMYLLGMTDKIVTSGWSTFGYVGHGLGGLTPWIMFRPENHTTPYPPCRRAKSMEPCMHGPPFYDCRAKHGADTGKLVPHVQHCEDMSWGLKLVHPE

SEQ ID NO: 21896 - protein, 588 aa, Arabidopsis thaliana
MVARTPQKQRKVAMVVPPLNSDLLKETINKVDKCMERLQELQYTIAGGTKVVSGVNLSPRSTRIYLKTSLRCKQETLRIKNATNKKSPVGKFPASSPGDWRKMSLPAMLLGETVNEILQASQVTRDIVDAIAPKKSRKSRRLTMSQEDDGPKTPETQQKSREQNPETVSSNIKARRKKEKQNRRSESDSPPSLQRARSRIAFRTISPQVKGNNGENSFRHLANRVSPKHKPWVKKAVLFPNPLFISGTATQQAKFSRTMSPVIARNEISSIKNNKETPYKFLIKSPPTSASKFQVKIRSPPKVLVSPTRNGSNSVRKSPRGSRSPTRTVNLGKKSASISPIRNTGKRSPKLSTAAKLRRSFTPTRNGSNLARKSSISPKRVTLQAFLSPTRNGNFCKKSPKASISPTRVCNKSQKLSTAAKFRRSFSPSRLAMRADEITMFHGSKAPSLSIYRYTERIHRYAQCSPVCFVAAFAYILRYLQRPEATSTARRLTSLNVHRLLITSLLVAAKFLERQCYNNAYYAKIGGVSTEEMNRLERTFLVDVDFRLYITTETFEKHCLMLQKETVPCDSRKLRTVLGEIACSCQAI

SEQ ID NO: 21897 - protein, 90 aa, Zea mays
LGKIVGLVISTNEAPSSLGSIIDAPSSLHISRRLEEASKTTDIASVVLVRKSLAWITGIILLVSTLIGVCLLMNMPLTRDTLLYSNVKID

SEQ ID NO: 21898 - protein, 394 aa, Thiomicrospira crunogena XCL-2
MSRLSNRVNRVKPSLTLVISAKAAELKRAGKDIISLGAGEPDFDTPDHIKAAGISAIQNGQTRYTAVDGTPELKSAIIEKFKRDNNLTYEMDQILVSSGGKQSFYNLCQGLLNDGDEVVIPAPYWVSYPDMALLAGGKPIIIEADIEQGFKITPEQLKAAITPKTKMVVINSPSNPTGAVYTASELKALGEVLQQHPDIVIASDDMYEHILLDDTPFTNILEVCPELTDRTVVMNGVSKAYSMTGWRIGYAGGPKDLIAAMRKVQSQSTSNPCSISQAASTEALNGPQDCIDTMLTEFKKRHEFVVERINEIPGFKCIPAAGAFYAFMDVKAAMKQKGYQTDTDFATAILEEVEVAAVPGSGFGAEGHLRISFATSMVNLINALDRIDSFMKDA

SEQ ID NO: 21899 - protein, 415 aa, Zea mays
RSSTEEGRPEMVPCAQQPQLPTAPPFHTFRQAGRRVIPLPRLHRRSRRTIATMASASGTPNPVVLGCGGISVDYLATVASFPNPDDKIRSLALKVQGGGNTGNALTAAARLGLRPRIISKVANDAQGRSILSELQTDGVDTSYILVAENGNSPFTYIIVDEQTKTRTCIHTPGSPPMVPEELTKANLSSALDGVDIVYFDVRLHDIALLVAEEASQRKIPILIDAERKREGLDELLNFASYVVCSAKFPQAWTGASSIPVALVSMLSRLPNIKFVIVTLGEKGCLMLERSSTDASEAGEIDAEALFESLEKSIDQSSTIPKCVASKSNLRISADGVGSISGRLLLGTAEVIPPGELIDTTGAGDAFIGAVLYGLCTSMPPERMLPFAARVAGCGCRGLGARTSLPHRADPRLAGY

SEQ ID NO: 21900 - protein, 528 aa, Cryphonectria parasitica
MMHDQASNGGDQAAPIKTQETPVPMSSSNSVPIMNAPAPLLRPAIPGSRGGARTPRLGLAIPPSPNVKPVTNPAGGAPQPQKASRPAPPTLSIATPMGSIGPPQEQQPGRSVAQPGHSASSGSEISAAHSRTDSFGGRGSNPTSAGSQYSNLSFVSQYGLGGKPHGTPDPQSAAGSMYSNASEGGLDMSRQDSMHGLERAMDEVTLERVRNLDVEDLDDEGWRIASQENRIVELGGLGEGAGGAVTRCQLKGGKTIFALKVITTNPDPDVKKQILREINFNKGCASDHICRYYGGFLEPSTATISIAMEFCEGGSLDSIYKEVKRLGGRTGEKVLGKIAEGVLQGLTYLEAKRILHRDIKPSNILLCRNGEVKLCDFGVSGDFGTKGEANTFIGTSYYMAPERITGQTYTITSDVWSTGVTLLEVAQHRFPFPADGTEMQPRAGLIDLLTYIVQQPIPKLKDEPEAGIFWSDNFKHFIESCLEKNPKRRGMPWKMLEHPWMIELKTKRVNMGKYLSQVWGWDDPKHSK

SEQ ID NO: 21901 - protein, 371 aa, Malus x domestica
MGKGGMSDGDHADRCYGEAINGDVQQENMAAWLLGVKNLKIQPYKLPNLGPHDVRVRLKAVGICGSDVHHFKNMRCVDFIVKEPMVIGHECAGIIEEVGSEVEDLVPGDRVALEPGISCKRCNLCKQGRYNLCRKMKFFGSPPNNGCLANQVVHPGDLCFKLPDNVSLEEGAMCEPLSVGIHACRRANVCQETNALVVGAGPIGLVTLLAARAFGAPRIVIADVNDERLLIAKSLGADEVVKVSTNIEDVAEEVAKIQKVLENGVDVTFDCAGFNKTITTALSATRPGGKVCLVGMGQREMTLPLATREIDVIGIFRYQNTWPLCLEFLRSGKIDVKPLITHRFGFSQKEVEEAFETSARGGNAIKVMFNL

SEQ ID NO: 21902 - protein, 332 aa, Prochlorococcus marinus str. MIT 9515
MKKTKVVCIGEALIDRIKNNSNQEFTDFLGGAPANVVCALRKLQINSAFIGRIGNDEFGKKFIEKFKELEVNTNFLQLDNNLPTRIVKVNRDSNGDRYFSGFDTSLNTVFADEALAINEIKKDVESLEKLFLETKYIVCGTIILSSLISTESIQFLLNLANKFHVKIVIDLNWREVFWDFASDSSETSKKERVYLIRNFLNHAHILKLAKEEAILFFKTDNPLEISKTMLNHPDVIITDGANPIKWFINSMQGNTKVINSSKIIDTTGAGDAFLAGLISQLLSFDYPSNESEIQNCVRFAGVCGLITCLGEGAIEQQPDYSKVNEFLGSQIL

SEQ ID NO: 21903 - protein, 377 aa, Zea mays
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLAYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 21904 - protein, 277 aa, Oryza sativa (japonica cultivar-group)
MLNESMGEGDAAYAKRVLLTAAGDDVSRGIASTLATHGCRLVLVGDEGALAGTAEEARRGGGGGDAVAVVGLDLHGCDEAAVDAAVGTAWRCFDGLDAMVNCYSYEGEVQDCLNISEDEFKKTMKANVMTPWFLVKAIAKRLRDSESSCGGSVVFLTQIIGAERGLYPGAAAYGTSLGAIHQLVRLSAMELGKHKMRVNAVCRGLHLGDRFPVWVGKEKAEKATGEVMPLRRWLDPEKDVASTVLYLVGDESRYMTGSTIFVDGAQSIVRPRMRSFM

SEQ ID NO: 21905 - protein, 302 aa, Psychrobacter arcticus 273-4
MKDWLLVISSQRGCAIDRANANFLLLYLNFKYLNFNRNESFMSTPFNDVAAQHADFNTKARQRIQQTEFMMSAPTFRLCPADIGLEVAFAGRSNAGKSSAINALTNQRQLARSSKTPGRTQMINFFNVGDADRRLVDLPGYGYAAVPLEMKKEWQVELEEYLVSRSSLAGLVLMTDIRHPLKFFDEQMLRWAKDGELPVHILLTKADKLKYGASKNALLNTRKRLKQLGLNCSIQLFSALRKEGLDELAGVMGNWYEYQLEANKIIESSFALLEGSELEDAIEKDAVQKDKNLKDSAQKESK

SEQ ID NO: 21906 - protein, 527 aa, Oryza sativa (japonica cultivar-group)
MATLLSKLLALPQQWQLLLLLLLLPIASLLLVIGRNTGGRRRRRHLRLPPGPARLPVLGNLLQLGALPHRSLRDLARRHGPVMMLRLGAVPAVVVSSPEAAQEVLRTHDADCCSRPSSPGPMRLSYGYKDVAFAPYDAYGRAARRLFVAELFSAPRVQAAWRARQDQVEKLIGKLTRPEPEPVELNDHIFALTDGIIGAVAFGSIYGTERFAGGGRKRFHHLLDDVMDMLASFSAEDFFPNAAAARLFDHLTGLVAHRERVFQQLDAFFEMVIEQHLDSDSSNAGGGGGNLVGALIGLWKQGKQYGDRRFTRENVKAIIFDAFIGGIGTSSVTILWAMAELMRSPRVMRKVQAEIRATVGDRDGGGMVQPDDLPRLAYLKMVVKETLRLHPPATLLMPRETMRDVRIGGYEVAARTRVMVNAWAIGRDAARWEEAEVFDPDRFEAKRVEFNGGHFELLPFGSGRRICPGIAMGAANVEFTLANLLHCFDWALPVGMAPEELSMEESGGLVLHRKAPLVLVPTRYIQL

SEQ ID NO: 21907 - protein, 324 aa, Geobacillus stearothermophilus
AQMTMVQAITDALRIELKNDPNVLIFGEDVGVNGGVFRATEGLQAEFGEDRVFDTPLAESGIGGLAIGLALQGFRPVPEIQFFGFVYEVMDSICGQMARIRYRTGGRYHMPITIRSPFGGGVHTPELHSDSLEGLVAQQPGLKVVIPSTPYDAKGLLISAIRDNDPVIFLEHLKLYRSFRQEVPEGEYTIPIGKADIKREGKDITIIAYGAMVHESLKAAAELEKEGISAEVVDLRTVQPLDIETIIGSVEKTGRAIVVQEAQRQAGIAANVVAEINERAILSLEAPVLRVAAPDTVYPFAQAESVWLPNFKDVIETAKKVMNF

SEQ ID NO: 21908 - protein, 377 aa, Streptococcus thermophilus LMG 18311
MNNTEYYDRLGLSKDASQDEIKRAYRKLSKKYHPDINKEPGAEEKYKEILEAYETLSDAQKRAAYDQYGPDGANGFGGQGSFGGFDGGAGFGGFEDIFSSFFGGGATRNPNAPRQGDDLQYRVNLSFEEAVFGAEKEIHYNREVTCKTCSGSGAKPGTSPVTCGRCHGHGVINVDTQTPLGMMRRQVTCDVCHGTGQEIKDPCQTCHGTGREKQSHTVSVKIPAGVETGQQIRLAGQGEAGFNGGPYGDLFVVINVNPSDKFTRDGSTIYYTLNISFVQAALGDTVEVPTVHGNVEMVIPAGTQTGKTFRLKGKGAPRLRGGSQGDQLVTVKIVTPTKLNDAQKEALLAFAKASGDEKVAPQKKGFFNKVKDVLEDL

SEQ ID NO: 21909 - protein, 641 aa, Oryza sativa (indica cultivar-group)
MDLKRRDEGAEESFVKPLQLKVKDYPLLGVHVSECQIYDLENRMICYQVSNLFSFYGALWICLVVFIPFNIFPTAIPQTRRDFTMISSQHKRRPCENKYCREYLVNICNQSAEGVAQKVWNFSKCRGMCSYRLYRKKNWEMLAEILDHAVNTLGYTSVHKLLNKGSYVVAVAEMLTSTPLEIWDLRFAQALSSMEIVMAGKACHQCRQMKRNFAVACTQVKKKGVCPIKYCHRCLLKRYDENDEEVGQMEAWICPKCRGICNCSCCRRKKGQQPTGRLVHTAKKGEQGAADEESTGRSLRIENSVEELLVEGDQIKLKGNIVVNKNFDGESSLAKDKNGSILGYNSAVSSPNKKVLPRGSLVTNILGADLEVKDVGPAIQLYEFCNSFGEIFQIRKGQPEQILQDIERDQEVEIVPELIADFHKNLLSVIKEDRGEKNSIYITNGDAWLNDLGAYINELAFMSKELHLEFVNKGTLGYNKLSPCKLHVLNLLCDEALSTVKLRKLIEEQNGRAAERRNDAKAKLRAAKAKEKELREGLKNDMKEGATPIEGNRNQLISDIKKAKEVKLTAIKEKKLGTVLRSKPLMLEDREAYWKLDGYSNNKMLLLQEFDNENFTGNDIWFEFTEDEEKTIENHAAIRDP

SEQ ID NO: 21910 - protein, 792 aa, Acinetobacter sp. ADP1
MEARVIGLEKLGKHDVELVGGKNSSLGEMISHLSNAGVSVPGGFATTAAAYREFLDQSGLNAKIQAELAKLNVEDVNALAESGAKIRQWIIETPLTPEFEKEVREAFNALSNGNPEIAVAVRSSATAEDLPDASFAGQQETFLNIRGIDNVLIAIKEVFASLYNDRAIAYRVHQGFAHDVVALSAGVQRMVRSETGAAGVMFTLDTESGFRDVVFITASYGLGEMVVQGAVNPDEFYLSKPLLKNGKHSVLRRNLGSKHQKMIYGEEGSAGKSVVVVDVEKQDRQQFALNDHELQELAKQAMIIEDHYGAPMDIEWAKDGDDGQIYIVQARPETVKSRQNVGTMERYLLKQRGTVVCEGRSIGQRIGSGKVRIVSSIKEMDKVQDGDVLVSDMTDPDWEPVMKRAAAIVTNRGGRTCHAAIIARELGVPAIVGCGNATEVLTDGQEVTVSCAEGDTGFIYEGSLDFEVQRNSIESMPKLPFKIMMNVGNPDRAFDFAQIPNEGIGLARLEFIINRMIGVHPKALLNIDSLPRETRAAVLARTAGYTSPIDFYVEKLVEGISTLAAAFAEKPVIVRMSDFKSNEYANLIGGKLYEPEEENPMLGFRGASRYVSDNFRDCFELECRALKKARDEMGLTNIQIMIPFVRTVAEAKRVIELLALNGLKRGENGLKVIMMCELPTNALLAEQFLEHFDGFSIGSNDLTQLTLGLDRDSGIVSHLFDERDPAVKALLSMAIHACRKAGKYVGICGQGPSDHPDLAKWLMEQGIESVSLNPDSVLDTWFFLAEEKTKQA

SEQ ID NO: 21911 - protein, 631 aa, Oryza sativa
  misc_feature (11)..(11): Xaa can be any naturally occurring amino acid
  unsure (1)..(631): unsure at all Xaa locations
MDGGGGGDPGXQEFGTRVGEAKADATRAANKRRAPSPAGGGGVEAKRRRKDAMGSSVSGSRSGGGGGRRLRHGRGRRARAFRRKLEEENKNSNNRPRASNVVIAYTPNLIRRYGTLLRNISFLLPYDGQGKAYACPSDKINVFLKWSRCNFCLFFEWAEGDQMMICHMFNTLKEIHISFLINPAFLDESMEVKVTNPLLSFSSNFVEDETWALVKEMLMMMFSPVQEDERAASDLYVFTKSRDSVYFRIFKITSIPAGESENSLVLDEVGLNFCLKLLDVHGAFVGSDCDQALDGLQSQTRNELKLSPDIYYCVPNDKLGCCTLHSVALNNQNYLFFLENGLDLSHFEGFCLTLEEFLERNSFLKIKHIVGSRNDEECNFVRNIAKAIIRSMLSHLVNLFSLGKCLRMGTDLLRRRKILLKGSDVKFFQLEVIAYEEDEAINNVLQVVELVKSCFVGEMIPADLQGDLHDLKENPLKRLESVIDSSSLMSAKEKKGLLVNLHTEYKTNISPAISEDDRDSLFKHIPYLDCWMNRTEDNEYLKLVANLDSKKVALKVNKVGTDKRKPSKNGILQFDFMRNSDVHIPEKALKDGITPFRLSWTDYILTSRYPTYLRAIQKSLEPYMKSRKKLK

SEQ ID NO: 21912 - protein, 391 aa, Polaromonas sp. JS666
MTTILERTPKLETKLPAVGTTIFTVMSTLAAEKGAVNLGQGFPDFECDPQLVNAVTDAMTKGLNQYPPMTGVPVLREAISAKVAKLYGHRYNANTEITITAGATQAIITVILAVVHPGDEVIVLEPCYDSYVPNIELAGGKVVRVPLTPGTFRPDFDKIAAAITPQTRAIIINSPHNPSATVWTQADMLKLQDILAPTDVLLISDEVYEHMVFDAAKGCMHQSASLFPGLAARAFIVSSFGKTYHVTGWKVGYVAAPAALTAEFRKVHQFNVFTVNTPVQYGLAAYMADPKPYLDLPAFYERKRDLFRAGLAKTRFKLLPSEGTYFQCVDISEVSDLNEADFCQWLTTEIGVAAIPLSAFYGNGFDQRVVRFCFAKKDETLHSALGRLAKL

SEQ ID NO: 21913 - protein, 386 aa, Oryza sativa (japonica cultivar-group)
METRPPRAAAPAPARVSRFRRLLVRVSAEPERAGGGGGGEVREKEEKAAEMEVGSVGLDRMVLSFMEDSAAAAVERPPRGRCGSCFNGGGDGSDDEEFDFLPSDSSATAAASAAAAAGDALDALKGLVQSASMAERNLLADASRIAERCRKGGKKKADVRCAVADGLAALGYDAAVCKSRWDKTPSYPAGEHEYIDAVVAAETRLVVEVDFRSEFEVARSTKAYRAALQALPPLFVGTPDRLGQIVAVVAEAARQSLRKKGLHVPPWRKPEYMRAKWLSPQVLRCSDKPPPPPPSPPPTPVSLSSFSGEFELRFDAKTPPNLSATAAGDDNDNDNDDEVEAKKITMVVSPSPWRPVEPEAASKKRSPPPPPRRPEGKVVTGLAAVL

SEQ ID NO: 21914 - protein, 497 aa, Mycobacterium smegmatis str. MC2 155
MTAMTQTAPAATAATTNWDKLFIGGQWVEPSSSEIIEVFSPATGEKVGQAPLATKADVDAACAAARKAFDEGPWPRMTPQEREAVLAKATALIEESADEFKTLLKLETGQPQTIVDMMQYGAAMSTLQFYASAADKFAWKDIRDGIYGQTLVLKEPVGVVGAVVAWNVPFFLAANKLGPALLAGCTIVLKPAAETPLTTNLMAQKFLEAGLPEGVLSVVPGGPETGRALTDNPALDKFTFTGSSAVGKEIGKIAAEKLKPCTLELGGKSAAIILEDADLDSTLPMLLFSGLMNSGQACVGQTRILAPRSRYDEVVEKVAAGVAAMQVGVPDDPAAMVGPLISEKQRERVEGYIKKGIEEGARLVTGGGRPEGLDSGWFVQPTVFADVDNSMTIAQEEIFGPVLVVIPFEDEDDAVRIANDSVYGLAGSVYTTDHAKGVEIASKVRTGTYGINMYAFDPGAPFGGYKNSGIGRECGPEGIAGYCESKSVLLPFGYTPE

SEQ ID NO: 21915 - protein, 391 aa, Solibacter usitatus Ellin6076
MSYLSIRDLDLKGKRVFIRVDFNVPLQKNDQGAMEITSDKRIKASLPTIQYALEHGAAVILASHLGRPKGKPNTEMSLKPVAARLEQVLKVPVKMAPDCVGPEVQAMLPAPGEVLLLENLRFHAEEEKNDPAFAAQLAALCEIYVNDAFGSAHRAHASTEGMVKLVKQAAAGLLMEKELKYLGMATTNPPRPCVAILGGAKVSDKIEVIQNLGKVVDRLLIGGAMAYTFLKAQGLPTGKSLVEDDKVELAKSLLAELGERLMLPVDHVVVSEIAAGAPFEVVDTIPEGKIAVDIGPKTVEAFSKVVAGAKTVIWNGPMGIFEKPPFDQGTVAVAKAVAGSGATSIVGGGDSEKAIKAAGVSDKISHVSTGGGASLEFLAGDTLPGVAALDR

SEQ ID NO: 21916 - protein, 359 aa, Solibacter usitatus Ellin6076
MRLPRRELPFALLLSALAILAYLLLWPVPIDPIVWRPATVPPISDRYAPNDRLSGIRSLPEAGPGPESVAIDRDGRLYTGLQDGRVMRMLPDGSGRETFVQTGGRPLGMKFDTAGNLVVGDAFRGLLSISPERKISVLADSVNGERMLFTNDLAIAADGSVWFSDASRRFDQHHWTLDFLEGRATGRLLHYEPRTGQVTVVLDRLMFANGVALGPGDQYVLVNETLAARITRYWLAGAKAGQSDVFAGALPGYPDNLTYNDRGVFWVALPSARNSALEALSGLPWLRKVVQRLPARWREQRLERMAWVLGFNTEGQVVHSLQDSRGRYGPVTSVTERSGRLYFGSIDTAAIGWAPAPRN

SEQ ID NO: 21917 - protein, 556 aa, Magnetococcus sp. MC-1
MGKTFDSNRLKELTGHANPLEILNDPYMNKGVAFTEEERDLFHLRGLLPPRVQTMEAQLGRALDNFRCKPNDLEKYIFLTGLQERNETLFYRLVMTNIEEMLPIIYTPTVGKACQTYGHIFRRPQGMFISINDKGRIAELLGNWVHKDVRVIVVTDGSRILGLGDLGAHGMGIPVGKLALYTALAGIPPIHCLPVTLDMGTNNEALRNDPLYVGLPQPRVTGEIYDEMIEEFVLAVQEQFPRAMIQFEDFSNDNAFRLLEKYQDRICTFNDDIQGTAAVALAGILGALRITEADLCTQRYLFMGAGSAGFGIADLILRAMEQKGIPREQGLKQFRFMDSRGLVTRSRTDLRGRKSEFVCDDPPLTDLQQVVERFMPTVLIGVSGQPGVFHQGVVEAMARINPRPIIFALSNPTSKAECSAQQCYQWSDGRAIFASGSPFEPVTIAGQTFVSGQGNNAYCFPGIGLGVIMCEASRVTEEMFLVAAQTLAQMTAQSDLDQGRVYPSMQDIRAISLNIALAVVDLASKRGLAQRDLGEHAKERISAWMCNANYRNYANR

SEQ ID NO: 21918 - protein, 170 aa, Glycine max
  misc_feature (3)..(4): Xaa can be any naturally occurring amino acid
  misc_feature (16)..(17): Xaa can be any naturally occurring amino acid
  misc_feature (27)..(27): Xaa can be any naturally occurring amino acid
  misc_feature (36)..(37): Xaa can be any naturally occurring amino acid
  misc_feature (41)..(42): Xaa can be any naturally occurring amino acid
  misc_feature (48)..(49): Xaa can be any naturally occurring amino acid
  misc_feature (77)..(77): Xaa can be any naturally occurring amino acid
  unsure (1)..(170): unsure at all Xaa locations
RSXXVFHYGSISLIVXXCRSAHLKAMXVAKESGCLXXYDPXXRLPLWXXAEEARKQILSIWEKADLIKVSDAELEFXLGEHGSRYYTKSFKGSVDAFHVNTVDTTGAGDSFVGALLAKIVDDQSILEDDPRLREVLKFANACGAITTTQKVAIPALPKEEVALNLIKGGS

SEQ ID NO: 21919 - protein, 265 aa, Zymomonas mobilis
MIPRPDHGEKSYRGSGKLQGRKALITGGDSGIGRATAIAYAREGADIVINYLPQEEPDAREVVALLQGEGHKVFALPGDLRNENFCVQLVQEASKRLGGLDILANIAGHQHYNESILTLSTADFDDTLKTNDYAMFWLCKEALKIMPAGSAIVNTSSKQGYSTPAILLDYATSKAAIANFTRALAIQLAPRGIRVNAVAPGPFWTPLQVSGGQPASAYSQFGANTPVKRPGQPVEIAPVYVFLACAENSYVTGEVYGETGCAQIF

SEQ ID NO: 21920 - protein, 110 aa, Porphyra yezoensis
MKKKLSVLFTVFSFFVIGFAQIAFAADLDNGEKVFSANCAACHAGGNNAIMPDKTLKKDVLEANSMNTIDAITYQVQNGKNAMPAFGGRLVDEDIEDAANYVLSQSEKGW

SEQ ID NO: 21921 - protein, 402 aa, Debaryomyces hansenii CBS767
MSYYNRNSSSSSSVLPSSRKTHSEKHKQILKQLLKEHANKTCVDCKTATHPRWASWSLGCFMCIRCSGIHRSMGTHISKVKSVDLDAWTDEQVELMIKWGNEKCNIYWESKLPDGYVPDQLKIDNFIRTKYDLKKWVSSTTIPNPLSIKASGSQNAGLTTAQHTSESHKSKNSDLGSADLLSGHSSKIEPHGSLLDDDFGSFTSSPSPKASTPVTSTRNTTALKSNQQRSNSTTQQKLPTENTSDGAGIQSAQSTGGSFSNTRPDLKKSILSLYSSPKSSSSSFIQPQHNSQAQPNMQASVNSLSNSLSGLDFNNSNTSTNFNVSSIPSRTSLASQSASQQPHARPEAQTTNWNNEWTDANESTASLNNQWPNSGSSGTHGAKTTSLNSTNLDDDLFKNVWS

SEQ ID NO: 21922 - protein, 524 aa, Oryza sativa (japonica cultivar-group)
MAEVKPEEISYPPMEQLQGFEYCIDSNPPWGEAIILGFQHYILALGTAVMIPAVLVPMMGGSDGDRVRVVQTLLFVTGINTLLQSLFGTRLPTVIGGSYAFVVPIMAIIQDSSLAAIPDDHERFLQTMRAIQGALIVSSSIQIILGYSQLWGIFSRFFSPLGMAPVVALLGFGLFERGFPVVGRCVEVGLPMLILFVVLSQYLKNVQIRDIPILERFSLFICIALVWAYAQILTAGGAYKHSPEVTQINCRTDRANLISSAPWIKIPFPLQWGAPTFSAGQSFGMVSAVLVSLVESTASYKAAARLASATPPPAHILSRGIGWQGIGILLDGLFGTGTGSTVSVENVGLLGSTRIGSRRVIQISAGFMIFFSMLGKFGALFASIPFTIFAAVYCVLFGLVAAVGLSFLQFTNMNSMRNLFIVGVSIFLGLSVPEYFFRYSMAAQRGPAHTKAGWFNDYINTIFSSPPTVGLIVAVFLDNTLEVKNAAKDRGMPWWVPFRSFKGDARSEEFYSLPFNLNRFFPPS

SEQ ID NO: 21923 - protein, 327 aa, Photobacterium sp. SKA34
MADITLIEAVNLALHYEMQHDPNVVILGEDIAENGGVFRATLGLKQAFGCKRVIDTPLAESLIAGVTVGMASQGLRPIAEFQFQGFIFPAMEHLVCHAARLRNRTRGRLTCPAVFRAPFGGGIHAPEHHSESIEAMFAHIPGLKVVIPSSPQRAYGLLLAAIRSNDPILFFEPKRIYRTVKSHVENNGLALPLDQCFTLRKGTDITLVTWGACVVESLQAAETLSQHGIELDVIDLASIKPIDMATISASLEKTGRLLVVHEAAKTCGVGAEIITRVAESAMFLLKAPPKRLTGFDTIMPYYRNEDYFMIQHDDIVNAARELMEGWQ

SEQ ID NO: 21924 - protein, 328 aa, Deinococcus radiodurans R1
MTQRPDNTTPDNANPKRQRVPGVRPSGPGLTTNRALLLGGLALAAVLLFQSVRVVPAGFVGVGFNKLSGQLSTLQEGVHFVVPGIQQLNLYDARLQEVTLSNTARDGDEGAINARSKEGLGITAEVTVQYRIDRNQAAALHKQLGHDYQRTVIRPQVRSKVRDAIGQFGAAELISTERKQVEESVTKALREEFSRNNLMLDSVLLRELKIPDSVAKAIEEKQTAEQQVAVQKNRLQQAQISAQQAVVDAEGKAKAAVATARGEAEALSLRGKALRENPQLIQLTVAEKLSPGIQTVMLPADGNFLLNLQDLGRAANANGQNGNGAGQP

SEQ ID NO: 21925 - protein, 1193 aa, Cryptococcus neoformans var. neoformans JEC21
MSSPTSTSPKSSFVFSPTSFPHAAIASNNVRPRTNLPPPPPPDRIPPPKGRSHQQKFKILRKEKDKDRRQPIDLEDDWTIEDVTVNGDGVEQESQYLDDLQPEENELKPGPRFLEMANREEKKEKTSKSRGLVKKTSRLFGRDKDKDRGKPEEPAVTGSSSSTLAAMRQSSSTSTDSTTSRSITSAFTRQNSIQSRRSPRTSFGQAHSRRASQDSQMSWPAPRSIRSSTTSHDPSSDPQNSASSTGVPIPQRQGASMSSLSRYSLPHPNGGTSRSPDTFPNKMSTWFSHLLPVSSGSPPSSSYETSSSIRKQSSVAASLFNAARQKAVDGVRHLLDSEAQPDKCMDTIWVRGVAHPGWRPITPENSTSNLPALEPGGSGGGVEDRRASLSMNGPSPNSLRPSSWKRNTSLPPTGQPQSPAHVHTQASNQTTSPSKGFTGIWNPSTLSLGMPIGGSPNKEKENGSGAESPSKKKSKEIVKWPEQFYDDFKSTVWFTYRNQYAPISSLSPNLLIPSPEAYYASFGPPLDATSPSSLRVTTPTAAAQQSASGSGGWGWSKEERGLTSDAGWGCMLRTGQSLLVNALIHIHLGRDWRVPSTPASFSEATTTQEIAALKDYAKYAQMLSWFLDDPSPLCPFSVHRMALIGKELGKEVGEWFGPSTAAGALKTLANSFAPCGVAVATATDSIIYKSDVYTASNLPSDDWNSISPTFNSSKKKRRGDNEAKEEKWGKRAVLILVGVRLGLDGVNPIYYDSIKALFTFPQSVGIAGGRPSSSYYFVGSQANHLFYLDPHLTRPAIPLQIPPLPVHSAKEKGSTESSSIMSTAEEESEEGVMIRTPETPRSTTPSMFSAPEHVEDEDQEEWGQGSKYKLDVVDADGVEVEGIDDDKGRNEGKMIREEVPKSSFESNGAAQEQPKKQKGFTSTASIDSQVDSQVDPHMLWYTTAYPDPLLRTYHCEKIKKMPLSGLDPSMLLGFVCKDEDDFEDFVERVAQLPKKIFTVQDEMPSWEEDDDAGLESVSEPDFEGDEFEEPGTAKPRFDSSSPVNEDSLKGPRVVSASTTATPLAAKEEDHLDVEEANSTDDDNESIGTTTAAGPMDIARHLNRVDLSSKREQEGDDDDGEWVGGTPSSQGVLVEPPSLKGTPSKSRSSAFEPRYEQNGETEQERPVFPARNRMESWVEPVCEGKEAPNGDNLL

SEQ ID NO: 21926 - protein, 502 aa, Arabidopsis thaliana
MAMASLYRRSLPSPPAIDFSSAEGKVRTDQLIFNEALQKGTMEGFFRLISYFQTQSEPAYCGLASLSVVLNALSIDPGRKWKVVFYKKFSSLPIGPWRWFDESMLDCCEPLEVVKEKGISFGKVVCLAHCSGAKVEAFRTSQSTIDDFRKFVVKCTSSENCHMISTYHRGVFKQTGTGHFSPIGGYNAERDMALILDVARFKYPPHWVPLKLLWEAMDSIDQSTGKRRGFMLISRPHREPGLLYTLSCKDESWIEIAKYLKEDVPRLVSSQHVDSVEKIISVVFKSLPSNFNQFIRWVAEIRITEDSNQNLSAEEKSRLKLKQLVLKEVHETELFKHINKFLSTVGYEDSLTYAAAKACCQGAEILSGSPSKEFCCRETCVKCIKGPDDSEGTVVTGVVVRDGNEQKVDLLVPSTQTECECGPEATYPAGNDVFTALLLALPPQTWSGIKDQALMHEMKQLISMASLPTLLQEEVLHLRRQLQLLKRCQENKEEDDLAAPAY

SEQ ID NO: 21927 - protein, 67 aa, Triticum aestivum
  misc_feature (51)..(51): Xaa can be any naturally occurring amino acid
  unsure (1)..(67): unsure at all Xaa locations
HTWSSNRWDQIHAPSSETHVFMRCDVNFNKSAHGQNLDTMIHRPAHIEFLXTDICAELILWYVPELF

SEQ ID NO: 21928 - protein, 349 aa, Zea mays
MPSPLGGRIQFGPGKAGMPSASLARRLLSTISSPAISSRSTSSSNSNSCGFSTRARKKRSCVSWMVSAATPADMATNRCTTEARVLSCSPPETRDTAHLLRSCLLNSESGSALAKLAPLEAILFDIDGTLCDSDPIHFCAFRELLQQAGFNGGVPITEEFYSANISGGHNDDLARSLFPGMDHQKAMRFMDDKEAMFRKLAPGQLKPVDGLQELCGWMEGRDMKRAAVTNAPRANAELMLSLLGLTDFFPVLVIGSECDRAKPFPDPYLKALQLIDASPQHTFIFEDSASGVRAGVAAGVPVVGLTTRNPGKVLKDAGASLLVKDFQDPELLSVLQQVEVEPAAENAQG

SEQ ID NO: 21929 - protein, 711 aa, Zea mays
RLEEDGTVRVWNLETKKCVAVLKEHFSAVTSLALSDDGQTLLSAGRDKIVTAWDIRKYSSKKTIPTYEMIEAVSFIGSGSELLACLGIELANIKEKSAGYFLTVGERGVVRVWCLESCVCVFEQQTSDVTVNSENEETRRGFTSAVMLPNDQGLLCVTADQQFLFYCPKRTDDGDFELSLYRRLIGYNDEILDLKFIGEEEQYLAVATNLEQVRVYDVASMSCSYVLAGHTEIVVCIDTCVSASGKTLVVTGSKDHTVRLWDAERKGCIGIGKGHLGAVGSVAFSKKTNNFFVSGSSDRTIKVWTWDDALGDAEDEVPLKAKAVVAAHDKDINSLAISPNDGLVCSGSEDRTACIWKLPNLVLSVVLKGHKRGIWSVEFSSVEQCVMTSSGDRTIKIWSVADGSCLKTFEGHTSSVLRASFLSRGTQVISCGSDGLVKLWTIKTNECIATYDKHDGKVWALAVGMKTEMVATGGTDAVLNLWHDSTMEDKQEDFRKKEEEVLRGQELENAVSDSDYAKAIQLAFELRRPHRLLDLFSKLARRADAEDPIEKALLGLPTDGLRVLLEYVREWNTKPKFCHVAQFVLFRLLRSFSPTDILEIKGISELLEGLIPYSQRHFSRVDRLVRSTFLLDYTLMRMSVVDPDVDAGTIKDEMNGSSVENGELAEPRPASPVPQKSSKKRKSGKSGKKGKEKKVKVASSGLLSKDVSVEP

SEQ ID NO: 21930 - protein, 328 aa, Burkholderia sp. 383
MLHVAADHARGAPHTKEETQMETIAVIGSNMVDLVTYVARMPARGETLEAPNFELGCGGKGANQAVAAARLGARVVMVTKVGDDVFADNTIRNFEREGIDTTHVRKVAGVPSGVAPIFVEPDSSNSILIVKGANRHLTPADIDAAAPQLAECALIVLQLEIELDTVYHAIAFGARHGIPVLLNPAPAVADLDFERIRTVEFFVPNETELAIVSGMPVDSRDSAARAAEALVARGLKHVLVTLGSNGSLLVSRDGVRHVPGVPVDARDTTGAGDAYIGCFARCYAASRDALDAMRYASAYAAHSVTGLGTQKSYADTATFERFLRDAGV

SEQ ID NO: 21931 - protein, 568 aa, Oryza sativa
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLQWSGLSLLLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 21932 - protein, 513 aa, Cytophaga hutchinsonii ATCC 33406
MTQLPVKEIFDAFNIQKQNASAMSAGQTWHSNETFLKSSPINGELLATVEYASKETYNALIEKAQEAFPVWSALPAPKRGEIIRQIGDAFREKKQELGALITIETGKLLQEGLGEVQEIIDVCDFAVGLSRQLYGLTMHSERPDHRMYEQYHPLGIVGIISAFNFPAAVWSWNAIIGAVCGNVCIWKPSEKAPLSAIACQSVVSEVIKKNGLPEGIFTIYQGAAAQGSWMADDERVALVSATGSVAMGKKVNQAVAGRLGKVLLELGGNNAIIVTEKANLDMATRAIVFGAVGTAGQRCTTTRRLIVHESIYKKLVDDLTRIYAQLSIGSPLDADTLVGPLIDETAVELYEKRIATAQKEGAVLVTGGKRMQPKGFEKGTYVLPAILEADGAIPSIQEETFAPILYISKYTGHVENAIKMNNGVRQGLSSAIFTGDLQQMERFLSNKGSDCGIANVNIGTSGAEIGGAFGGEKETGGGRESGSDSWKAYMRRQTNTINYGNTLPLAQGIKFDL

SEQ ID NO: 21933 - protein, 512 aa, Streptomyces clavuligerus
MVTAAISGTDEIRARAEQALTRCGVDLTAVKGDALTARTPLTGADLFGLRAQTPEDVDRAVEAAHTAFLTWRTTPAPVRGALVKRFGELLTEHKQDLADLVTIEAGKIRSEALGEVQEMIDICDFAVGLSRQLYGRTMPSERPGHRLMETWHPLGVVGVISAFNFPVAVWAWNAAVALVCGDTVVWKPSELTPLTALACAALLDLAIADAGAPKGLNQVVVGAADVGERLVDSPRVPLVSATGSTRMGRAVGPRVAARFGRTILELGGNNAAVVTPSADLDLTVNAAVFAAAGTAGQRCTTLRRLIVHEDIADTVVERLTAAFERLPIGDPFQDTTLVGPLVNEAAFGRMREAVERATAEGGTLCAGGERQFPDAAPGAYYVRPALVRMPAQTAVVREETFAPILYVLTYRDLDEAIRLNNEVPQGLSAGIFTADQSEAERFLAPDGADCGIANVNIGTSGAEIGGAFGGEKETGGGRESGSDAWRAYMRRATNTVNYSGRVALAQGVDFSQ

SEQ ID NO: 21934 - protein, 181 aa, Antirrhinum majus
MAAKVSSDPLVIGRVIGDVVDHFTSTVKMSVIYNSNNSIKHVYNGHELFPSAVTSTPRVEVHGGDMRSFFTLIMTDPDVPGPSDPYLREHLHWIVTDIPGTTDSSFGKEVVSYEMPRPNIGIHRFVFLLFKQKKRGQAMLSPPVVCRDGFNTRKFTQENELGLPVAAVFFNCQRETAARRR

SEQ ID NO: 21935 - protein, 534 aa, Arabidopsis thaliana
METPTMKPDTVLILDYGSQYTHLITRRIRSLNVFSLVISGTSSLKSITSYNPRVVILSGGPHSVHALDAPSFPEGFIEWAESNGVPVLGICYGLQLIVQKLGGVVVEGESKEYGKMEIEVKGKSEIFGSESGGEKQMVWMSHGDEAVKLPEGFEVVAQSAQGAVAALENRKKKIYGLQYHPEVTHSPKGMETLRHFLFDVCGVSADWKMEDLMEEEIKVINKTVASDEHVICALSGGVDSTVAATLVHKAIGDRLHCIFVDNGLLRYKEQERVMDTFERDLHLPVTCVDASVRFLSELKGVVDPETKRKIIGKEFINIFDQFAQELEKKYGKKPAFLVQGTLYPDVIESCPPPGTDRTHSHTIKSHHNVGGLPKDMKLKLIEPLKLLFKDEVRELGRILNVPVGFLKRHPFPGPGLAVRVLGDVTQGNALEVLRQVDEIFIQSIRDAGLYDSIWQAFAVFLPVRSVGVQGDKRTHSHVVALRAVTSQDGMTADWFNFEHKFLDDVSRKICNSVQGVNRVVLDITSKPPSTIEWE

SEQ ID NO: 21936 - protein, 629 aa, Cytophaga hutchinsonii ATCC 33406
MCGITGIFAFNQIGAFYMINLGKSIELLAHRGPDGRGTFVEELIALGHRRLSVIDTINGRQPMHDSTDRYVLTFNGEIFNYKILREQLIQEAGYTFTTDSDTEVLLNAYIHWGEACLLKLNGFFAFAIYDKQKHEIFVARDRMGVKPLLYYKDEDKFIFASEMKAVLAYNVPKEIDWVSVQQYFTLGYIPEPDSIFKDVKKLEAGSYLLINKAGVISKKYYEIPSSTQTKHQHSFEQAAAHVKELVDASVKDRLVADVPVGAFLSGGLDSSIVVASASKHVENLHTFSVGFKGADFYDETKSAELVAKTFNTSHTTFSLSQTELADNILPCLESMSEPFGDTSSLPLFVLSKKVAPSMKVILSGDGADELFGGYNKHRAEWLIKNPNWQIRFAQLIQPVVKILPGNRNTPMGDKIRQAQKLIEGLTLTDAERYYRWCSVFSEEAHKEMFQENIADNEEYKIRKGGILHAFKKNPYDLNRILYTDLNLVLGSDMLHKVDSMSMANGLEVREPMIDYRLVEYVSTLPSSYKINKNGGKQVLKHAYKDELPAEILSKAKHGFDVPLTKIFSKELKAWILDELLSQKFIEQQHVFKWSYIKNIRNAIDKNSNLDESKIWPLITFQFWWKKFMN

SEQ ID NO: 21937 - protein, 149 aa, Alkaliphilus metalliredigenes QYMF
MGFFHGIGNNKILGTALLAWFIAQTIKVIHTFIVDKRFNLSRFVGSGGMPSSHSSFVMGLTTAIGLDKGFDSAIFAVSLAFSLVIMYDAAGVRRAVGKQAIILNRMIEDIHHKRKLKLTEQRLKELIGHTPIEVLAGAILGIVVAKLMI

SEQ ID NO: 21938 - protein, 830 aa, Vibrio sp. Ex25
MPSRLLYPKLREKEVSWQSVTDLIAQEIHQAKAEFGPDSVAMYVSGQLLTEDYYVANKLMKGYVGSANIDTNSRLCMSSAVAAHVRAFGEDVVPVNYDDIDNTELLVICGANTAWTHPVLFRRIQQARENNPNLKLVVIDPRETVTAQQADLHLPIKNDGDVSLFNGLIKFLIEQQCIDSEYINSYTESFSALAEEVSDLRYDVTNLTSSIGISEEKLTTFFQWFAQSPTVITLFCQGVNQAENGVDKGNAIINAHLASGKIAKSGCGPFSITGQPNAMGGREVGGLANQLAVHRAFDSESIKQVQAFWDSPEIATKPGLKAVELFEAVERGEIKVLWIMATNPVVSLPDNQMVKRALEACPVVIVSDITAESDVAKYADVLLPAVGWGEKQGMVTNSERRMSRQRQFQVPPGEAKPDWWAISQVGQALCELEKAQNGFAFTSEHAVFREYAAMTGMNADSPLKLDLSQHANLTEQEYEEWVPTQWGGGRPFADGIYSHPDGKARFVVTSELPQRLERAKGWWLNTGRQRDQWHTMTRTGHIAHLAASELEPTVYMNTLSATQNRLKAGQLIKLFQPTSNTGIYAKVAIDEGLGFQELFMSMHWAGRYGGESSVNAIVNSVKDPISGQPAFKSSYVEVQDAAVKTYGMFIGTQFDSGKFLYSAFQAESNLGIWRFAHDKRPKKQSFCRTEKSRRITIDIALGWLAVDYDLVGDVRIIRSVLVVSSEPIQTDYTNFTGLIGKPMELSQLLTITQSQSSAKLVCSCFRVTDKQIHDAMEKQDCTSLTQLQNKLKCGTNCGSCVSQIKQMLDSHLHQKGKLQANQQSLAIQIK

SEQ ID NO: 21939 - protein, 527 aa, Chlorobium tepidum TLS
MNPVLTAREMSLADRAAIEELRTGETRLMELAGRETVRMIAERFESGRSLDGLSAFVVCGKGNNGGDGFVVARHLLNKGARVDVLLVWPEDDLAGVNLEGLHILKAYRRYNEGLRIFAGIDEARTAVGATEYQVVVDAIFGTGIRIDPDNPQLPEPAKSAIELINFVNTHSKAVTVAVDIPSGLDATNGRCANPCVKADMTVTMAFLKTGFFQNSGPSLCGEIQTAEISIPEFLVEPTSCLLVDETFAAESYLLRDPSSAKHLNGKVLLVTGSADGGGSMLGAALLASRAAVKTGAGYVCCSLPDGQASVMHSFAPEVVVIGRDMISIIEKAKWADAIVIGCGLGRSEEAQELVETLLCTPEIASKKLVLDADALYAIAERNLFNRVTALEDAVLTPHAGECSRLSGLSVEDIMLSPIDTARMLAEEWNANLLLKGTPTFVAAPSGMVLISNSGTEALASAGTGDVLSGMIGALAAKGLDTHEAAAAAAWLHGRAGDLASNVSSLVSSVDVLQAIPQAVLELFESEE

SEQ ID NO: 21940 - protein, 404 aa, Chlorobium tepidum TLS
MFDEIEFDRIKRLPKYVFAAVNELKMAERRAGRDVIDFSMGNPDGPTPQHIVDKLVESVSKPKTHGYSVSKGIYKLRGAIGGWYRDKYNVDLDLDREVVVTMGSKEGYVHLVQAITNPGDLAIVPDPCYPIHSQAFILAGGNVHRMKLEMNEDYTLDEEAFFHNVETALRESSPKPKYLVVNFPNNPTTATVELPFYERLVELARRERFYIISDIAYAEITFDGYVTPSILQVSGAKDVAVESYTLSKTYNMAGWRMGFMVGNAKLVGALEKIKSWLDYGTFTPIQVAATIALTGDQSCVREIREVYRKRRDVLISSFANAGWDIVSPKASMFVWARIPEQMRAMGSLEFSKKLLIEGKVAVSPGIGFGTYGDEYVRVAMIENEERIRQAARNIKRFLKNNAGS

SEQ ID NO: 21941 - protein, 3132 aa, Magnetococcus sp. MC-1
MNKSQAKAACVSAPLASIPAKKLSFLWRGVPVCLIMLSFPGQALAGPSGEQVIAGQVTIDRNLNDTIINQATDKAIINWKNFDINPNELVKFIQPDVGSIALNRVESNLPTNILGQLQANGRLFILNANGVIFGRSAQVDVAGLLATTLSIKDNNFLSGKYAFEKVPGLKDAAVENKGEIHIGEGGFAFLVAPGVRNEGLIIAKLGSVALASGDKMTIDFHGDGLVSYEVTGAVAEKVLGADGQPLEALVSNTGTIQADGGNVVMQGHSAGDVFSSVVNNEGIIQAQSLQKKNGKIYLGGDDEGGIVSNSGILDVSAAEPNSAGGEVVMTGHFVGNEGVIEAKGSGSGDGGQVTLISAQHTLTTVNSVIDVSGGADSGSGGVVQIRSANRATFDGVVKADAGQNGGDGGLVDVSSEGEVQLIGKVVGLAPRGRNAKLVIDPKHIEINDAGGGAYNSTTVQFDDSQSGTTVITAASINAQVADVVLQANTDITVTTAINIANAGTGLTLQAGRSILINADLTTNNGVVTLTANDHTALSADRDAGVASIAMASGTTINAGSAAVNMTIDASGHGLMGDITAYNVTSSGAVALDSAGSIIVNGPNFASGSTSIGLTADNDVTVGSALTTGSLTIAAGRSVALNSNVTTTSTVNIKANDSTQTLANRGSGDGAISMAAGTTLNGGSAAITLTVDSTNASTAGGITIDLVTTDGNLTVSSHDAITEIDADSEVDLRGDILSLTTTDTNGAYIGAPGTSTTDYLEVHAKTRVDVTTNNGSVALASPGYLSGTVDWFGAAPTDDIGTTDIDESKIVNLNLGTVNVGTATFMLVVTDGGILDGLAGTGTNITAGSANLTTNGGESVVAGAIVLGNDGTRGGSIGDATHALKTELGILTASSSNGSVYIDEASGILINSINANQKGVTAKVNSSYAVVVTTLDGQTETGTNNVTVTAAGDIIIGTASATSTVTLTSTAGNIYDNNDATNNILAKNVVLNAGLNMGLSGDVLELTTESATLTATNGGVYFAMGVPSTVASVTAGGGHDVVINASDGVLSLGMVSAVGGSVTIDGGTGSILDNNGATANIIANSASIKSDKGAGTASDALETTVDTLAVEITGSGKSFYIDESDALTSINAKVNNGSTNLNFTGGSFAFNATTGAFSSTGVGSVTFENTGGGVAIGTVTATGGSATITASTAITDATSAITADTVVLTAGTSIGASGSTIKSTATTLTYLASAGSIYAQESDGATVNAKAVGTGKNIEFATTTGNLTIGTISAKGSVTLTATAGSVLSGGTSSSATGATVVLSAGTAIGASGASVNTVAANLSATASAGGVYLSNAGDVTLTTAVATGAGFQLSNTGALVLNGVTAAGQAVSLTASGAITDGNGATNNISAESLTLVGLSIGSTATNGAVDTQVNSVTATTTSGGIYLNELGSGGLTITAATAVGSDANVSITGAGDIALGVITAKGDDVTLVSAGKITDNNGAANNVTADILNVTGPNGVEGLETSITQLSSTGSTDIVNAGAMAITKASLEGGSSSFIAESLTILDMAGDTATIANNTSLTLQTTTGNIVFLDTNDTIVAQGSGTVTINAGTTDKSGAVAIIGNITTANQNISITADSHITIGLLNAGIGDVSVSSDYGVVLDGNSTAVNVIARNFSLSGTTPTVRQAELHTTNSIANAHAHDSEVAAKLTLLEANTAAMDIMSTAESTANYSLTLASSAYDTAQAEVDRLAPIENGLKITTYVLDGVSIALSTAASAIEVAAGAAQAIPFSGDAGSEAAAAVTGLAANVAGIAAYAIGIAHSEIAGQLDDAEDLAFNKDAEMYAAKSTLTDAIANHQAYKEATSISQAAYDAAVIERNHNWQVARQAVLAEDASSTAGTLALPFGIQISGQLDVNAVNSDVVLAITGPAVLNSMSATKTAGTGIMSITATDNISVVGALVADDYIRLETTGQIINGNAGHSLTASKFVGVAGTGIGASGGLNTSVTTMAASTTTGDVTVTNNKALTLGTVDGVSGITTAGNIVIAATSPLTVSNNVTTSGGTVALTAGNSANSGDDFTLSANTTISAASTVTLTAGDNVAVESGAQITGTTVTITANNTGDGEADGVNGGATIAGNINASSLVLSGGGVNHSGTITSAGSVNISATSTAASSVNGITLGSVTAGGQIDVVSSNKLVMNQNVTTTSGAVVLTAGDSSASGDDLTLAAGKTISSGDNTITLTSGDNMSIGAAAQITGTTLVLAANHEGAGVADGVSGSMVLAGNLSGQTVTISGAGLTHTGSITSNSTVSVNVNSAATSAISGISLAAVTAGGQIDVTSSHALTLTQNVQSTGGPITITAGLQTTSVDNLTVDAGVTVQSSAGVAFSAGDSMTFGLGSQVTGTGITLIADKAGDGDGDGVSGSINLYGNVNGSSVDVSAAGFRQTGTITSSGDVDIAVVSTLSSPYNGIALGTISAAGHSVKISATGTATAGIADNNGAATNVTAADLAMVANGGVGASADALETQVSNLAATGGSGGVTISNSGDLSLTTVEGVTSFSAADGALSLVTTGNLLISDGFVQGAGLTVTLQATGGNINETNSGAAADVVGNIITLTTTGLGNGVGDVANRLELNAQVLNVTTDKGDVYLHDTAGGVAVGLITTGTTEGTRVDMMVSNGGVTEDPGHGHAPKIIADELYLNVTGHGFGIGHVDNDLNVDLTTFVNVTTEGGSIYMADADYGFYVDLVSTNSASTNIAMGTELRLVSLEGSIEESPTRSDAAVDLKAERVVLLAQGENDNIGTVEDAIEIKAANLFSETESGARSSLVAPDGDSPIVEAPGQSANALLIDGDFVGGDDSNLFQEIQSTGNRVGGDIGGGAGGGFGGAGGAGGGFGGAGGDFGGAGGGLVSDAGGFGGEGAPGGDAGGFGGEGAPGGDAGGFGGEGAPGGDAGGFGGEGAPGGDAGGFGGEGAPGGDAGGFGGEGAPGGDAGGFGGEGAPGGDAGGFGGEGAPGGDAGGFGDEGAPGGDAGGFGGEGAPGGDAGGFGGEGAPGGDAGGFGGEGAPGGDAGGFGGEGAPGGDAGGFGGEGAPGGDAGGFGGEGAPGGGPGGDAGGIGGTDGAGGDRGGPGGTDGAGGDTGSPGSGDGDVNKQGEGG

SEQ ID NO: 21942 - protein, 339 aa, Oryza sativa (indica cultivar-group)
MALVQSARRAAGPAASRLFSTASVAAAGRSPVAGLPKALPQPAISSLWMVGAAAPPRRFAGTAAVGGVDVTAPTATPPPAKKEESEKEAASYWGVAPTRLVKEDGTVWKWSCFRPWDTYEADVAIDLTKHHNPATLGDKVARWTVKSLRWPVDLFFQRRYGCRAMMLETVAAVPGMVAGAVLHLRSLRRFEHSGGWIRALLEEAENERMHLMTFMEVSQPRWYERALVVAVQGAFFNAYLASYLLSPRFAHRIVGYLEEEAVHSYTEFLRDLDAGKIDDVPAPAIAIDYWRLPADATLRDVVMVVRADEAHHRDVNHYASDIHYQGHALREVAAPLGYH

SEQ ID NO: 21943 - protein, 297 aa, Dehalococcoides sp. BAV1
MKELGRLITAMVTPFKKDGTVDYAQAQKLALGLLDSGSDGLVVVGTTGESPTVTWEEEHALFAAVKSAVGNRGKVIAGTGANSTQEALENTLKAEKIGVDACLLVVPYYNKPTQEGLYLHFKTIAEATKLPCILYNVPSRTITHMNPETVIRLSQIPNIVGIKEASGKLDDIAQIINNVRPDFTVWSGNDSDTLPMLAMGSYGVISVASHLVGNQIKDMITSFVSGNTEHAAAIHRHLTPLIRSLFVVSNPIPIKYALNYLGVEVGGLRLPMTEADEKTAALIRESLKGYTIDLPIK

SEQ ID NO: 21944 - protein, 211 aa, Neisseria gonorrhoeae
MPMNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKELIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 21945 - protein, 222 aa, Oryza sativa
MDTDGRLRRALAAFGGGADVWDLVDAALASAARDRPAELRARRDGIVERLYATAAGGRCGNCDAPRSAEPEAAAAAAASPASPDEDADVDGLDDDEGGGMESKILAIRDFLEDPDQSEDELVSLLQSLADMDITYKALQETDIGRHVNGLRKHPSGEVRQLVKLLVRKWKEIVDDWVRLHNSGGDGGSSVLTDGDSPDKISTALCFVSEFSRFVFVLDDNFD

SEQ ID NO: 21946 - protein, 387 aa, Bacillus sp. NS-129
MSTHFDVIVVGAGSMGMAAGYYLAKQGVKTLLVDSFDPPHTNGSHHGDTRIIRHAYGEGREYVPFALRAQELWYELEKETHHKIFTQTGVLVYGPKGGSAFVSETMEAANIHSLEHELFEGKQLTDRWAGVEVPDNYEAIFEPNSGVLFSENCIQAYRELAEAHGATVLTYTPVEDFEVTEDLVTIKTAKGSYTANKLVVSMGAWNSKLLSKLDVEIPLQPYRQVVGFFECDEAKYSNNAHYPAFMVEVENGIYYGFPSFGGSGLKIGYHSYGQQIDPDTINREFGAYPEDEANLRKFLEQYMPGANGELKKGAVCMYTKTPDEHFVIDLHPKYSNVAIAAGFSGHGFKFSSVVGETLAQLATTGKTEHDISIFSLNRDALKKEAVK

SEQ ID NO: 21947 - protein, 448 aa, Brassica napus
MATHSALAVSRIPVKPRLQSKSAIHSFPAQCSSKRLEVAAFSGLRVSSNGGEASFFDAIAAQITPKAVGTSSPVRGETVAKLKVAINGFGRIGRNFLRCWHGRKDSPLEVVVLNDSGGVKNASHLLKYDSMLGTFKADVKIVDNETISVDGKFIKVVSNRDPLKLPWAELGIDIVIEGTGVFVDGPGAGKHIQAGASKVIITAPAKGADIPTYVVGVNEQDYSHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAAAGPLKGVLEVCDTPLVSCDFRCSDVSTTIDSSLTMVMGDDMVKVVAWYDNEWGYSQRVVDLAHLVAAKWPGEVAAGSGDPLEDFCKTNPADEECKVYEA

SEQ ID NO: 21948 - protein, 302 aa, Prochlorococcus marinus str. MIT 9515
MIPNNTQFSNPIFGRILTAMVTPFKENGGVDYELAIKLANHLCENGSDGIVLCGTTGESPTLSWDEQHNLFVAVKSSLNSRSKVIVGTGSNCTSEAIEATKKAYEFGADGALVVVPYYNKPPQEGLYNHFSSIATAASDLPLMLYNIPGRTGCNLLPTTVNKLMNFPNILSIKAASGRIEEVTELRAACGPKLFIYSGDDSLLLPMLSVGAVGVVSVASHIVGLQLKMMIESFQKGEFSIALDIHEKLQPLFKALFETTNPIPIKAALELTGWQVGSPRNPLTPLIKEKKDNLFQIIQNLSL

SEQ ID NO: 21949 - protein, 600 aa, Arabidopsis thaliana
MSFSQSLVLFFAILLQEVEEEVSRWEGYADWRNRAAVKGRHGGMLAASFVLVVEILENLAYLANASNLVLYLREYMHMSPSKSANDVTNFMGTAFLLALLGGFLSDAFFSTFQIFLISASIEFLGLIILTIQARTPSLMPPSCDSPTCEEVSGSKAAMLFVGLYLVALGVGGIKGSLASHGAEQFDESTPKGRKQRSTFFNYFVFCLACGALVAVTFVVWLEDNKGWEWGFGVSTIAIFVSILIFLSGSRFYRNKIPCGSPLTTILKVLLAASVKCCSSGSSSNAVASMSVSPSNHCVSKGKKEVESQGELEKPRQEEALPPRAQLTNSLKVLNGAADEKPVHRLLECTVQQVEDVKIVLKMLPIFACTIMLNCCLAQLSTFSVQQAASMNTKIGSLKIPPASLPIFPVVFIMILAPIYDHLIIPFARKATKTETGVTHLQRIGVGLVLSILAMAVAALVEIKRKGVAKDSGLLDSKETLPVTFLWIALQYLFLGSADLFTLAGLLEYFFTEAPSSMRSLATSLSWASLAMGYYLSSVIVSIVNSITGSSGNTPWLRGKSINRYKLDYFYWLMCVLSAANFLHYLFWAMRYKYRSTGSRS

SEQ ID NO: 21950 - protein, 654 aa, Cryptococcus neoformans var. neoformans
MEDVKMSGPVGVGVPMGVVDPREKELPREPGSAAMGGRSRSGTGRSSKDKKSMFGFVSDLLGKDKPPVISKPYDPVHVTHVGFDFQTGKYTGMPPKWQQVLDDNGITQDEQERNPNGVMAVVQYLKHQDEGEDEEEEVWAKMKNAQPPAFPPPSAAPSQPTTPGGGVGSREMSREPSNEALGAAGTQVVDFTCPRMAPAPPTKPSLNRMLSERHAPASHRPAELTTPAPLAAAPRVTQAYSSALSHSPHLPPPHPTSSAPPTAPAPHLDRSYSQRAPVSGTKTKVLDRANTTRSPGSSAGIAQGAGTGVGLTKSQSQSGHKSRDPSREPKDSASSSGGLSRNQTTTRQQQGATPRRREKEKKENEDVIRQLRMICTPGDPNLVYKNFRKIGQGASAGVYTAIDRQTLPVAIKQMSLEKQPKQDLIINEILVMRESAHPNIVNFKDSYLWQGDLWVVMEYMEGGSLTDVVTAHCMSEAQIASVSREVCEGLRHLHSKGVIHRDIKSDNILLSLNGDVKLTDFGFCARIADPTTTKRTTMVGTPYWMAPEVVLRKEYGPNVDIWSLGILAIEMLEGEPPYLTENPVRALYLIATNGTPKIKDWDKLSTVFRDYFKVTLQVDPAKRPTAAAILKHEFFKHTAPLISLAPMIRSSRKS

SEQ ID NO: 21951 - protein, 599 aa, Candida albicans SC5314
MTTKEKDEFNIGSLQNSPESSTNMSPDVITTPISKWQAFKDSFKPPEQKPLASSSSSTSSLSASSPHHNDVANDYDIEKSLRPDQQGELKRELKNRHVQMIALGGSVGTGLLIGSGGALHQGGPAALLIAWGITGTMVFCIIHSLGELCVAFPVNGAFSTYANMFVDSSWAFAVGWNYAIMWLIVLPLELVAAAMCITYWNDEINPASWVAIFYVLIVVINIFGVKYYGDAEMYLTIFKIIAIVGFIILGVVLVCGGGPTHEFIGNKYWKQDGAFANGFKGVATTFVTASYSMAGSEMVGLASAEVANPQKSLPKAIRQVFWRIFLFYFLSLTFIGLLVPSNSPQLLGASGTSASPFVIAIKNGGIYALPSIFNACILLSVLSVGNSAVYGCSRTIQSLGAQGLGPKIFAYVDRKGRPLGGLVMSAIFGLLCFLSAYHDEATIFNWLLSVAGLATIFSWFNIGLCHVRFRLALRKQGRSLQELTFTALTGVWGSVYSMIFLCVVLVIQFWTALFPLGSKGKANAENFFQNYLGAVVILIFYVGHKLYTRNWKLCVKLEDIDLDSGRRSFDLDLIRAEIEEEKAANKAKPLYKRLWNYWC

SEQ ID NO: 21952 - protein, 130 aa, Ustilago maydis 521
MVRISVLNDALNSIVNAERKGKRQVLVRPSSKVVIKFLSVMQKHGYIGEFEEVDDHRSGKVVIQLNGRINKCGVISPRFNVQLGQIENWVQQLLPARSFGYVVLTTSAGIMDHEEARRKHVAGKILGFFY

SEQ ID NO: 21953 - protein, 379 aa, Cytophaga hutchinsonii ATCC 33406
MAKRDYYEVLEITKSASADEIKKAYRKLAIKFHPDKNPDNPEAEEKFKEAAEAYEVLSTPEKRQRYDQYGHQAAGGGGYGGGMNMDDIFSQFGDVFGSGGSPFESFFGGGGGGRGRGVRKGSNLRIKLKLNLEEIANGCEKKIKVKRQVACDECSGTGAKNGAVQKCGTCNGTGQVKRVVNTMLGQMMSATTCPTCNGEGTTIKDKCTSCHGQGTVEKEETITIKIPAGVVDGMQLSMSGKGNMPPRGGVAGDLLILIEEIEDEQLKRDGLNIIYELYVTFFDAVFGTSVEVPTVDGKVKIKIEPGTQSGKILRLRSKGLKDVNSYQKGDQLIYVNVWTPQTLSKEEKELLATIKESENFKPNPGKNDKSFFERMKEFF

SEQ ID NO: 21954 - protein, 65 aa, Zea mays
MTSRICSCMRDLMLLECYGMECAYDDGYLKRLAGFSCLTWEPDGVAGMCTDCSLVCDDGHEIVEL

SEQ ID NO: 21955 - protein, 283 aa, Arabidopsis thaliana
MELSSASAILSHSSSAAQLLRPKLGFIDLLPRRAMIVSSPSSSLPRFLRMESQSQLRQSISCSASSSSSMALGRIGEVKRVTKETNVSVKINLDGTGVADSSSGIPFLDHMLDQLASHGLFDVHVRATGDVHIDDHHTNEDIALAIGTALLKALGERKGINRFGDFTAPLDEALIHVSLTFLLLIVNKNLLQDLSGRPYLGYNLEIPTQRVGTYDTQLVEHFFQSLVNTSGMTLHIRQLAGENSHHIIEATFKAFARALRQATETDPRRGGTIPSSKGVLSRS

SEQ ID NO: 21956 - protein, 110 aa, Arabidopsis thaliana
MASKALILLGLFSVLLVVSEVSAARQSGMVKPESEETVQPEGYGGGHGGHGGHGGGGGHGHGGHNGGGGHGLDGYGGHYGGGGGGYGGGGGHHGGGGHGLNEPVQTKPGV

SEQ ID NO: 21957 - protein, 336 aa, Solibacter usitatus Ellin6076
MTDSNIVSREIRLASRPTGMPTAANFTMVRTELPRLEDQQVLVRNLYLSVDPYMRGRMNPGKSYVPPFEVGKALDGAAVGEVLESRAEDFKAGDAVTSFFGWRDCFVSSPKYLHPIDREVQSLSVYLGVLGMTGMTAWIGLNLVDVKAGDVIFVSGAAGAVGSVAGQLAKLRGCRVIGAAGCDEKVKLLRERFGFDSAFNYKAGPVRAQLEREAPEGIDVYFDNVGGEMLEAALWSLRTHSRIIACGSISGYNDESPRPGPSNLHNIVTKRLTIKGFIVSDWMQQRAQFEHEVAPLFVAGKLKHEETVVHGLEHAVDAFIGLFRGENSGKMVVALG

SEQ ID NO: 21958 - protein, 1022 aa, Cryptococcus neoformans var. neoformans JEC21
MPSSANAHDGAARQATVTRKRTNGSSTRDEKQYIGQWRIGRTIGKGSSGRVKIAKHAVTGKYAAIKIVPKGLILNSRMSMSEAGAKADKVLLGIEREIVIMKLIDHPNVLNLYDVWETSSELYLIMEYVPGGELFDYLVKRGRLPVSEALHYFQQIIYAVDYCHRFNICHRDLKPENLLLDKDKNIKVADFGMAAWEAGERMLETSCGSPHYASPEIVAGKAYHGSSSDIWSCGIILFALLTGRLPFDDDNIRSLLQKVKIGIFEMPDEIKDPARDLLRRMLERDPERRITMPEILSHPFFISRPPRPIPGRSLVSPPSLDEVERPVNSVDEIDPDIMGNLKTLWSGVSDEEIIKALMCKDKTWEKTIYHLLIKYRNKHLENYNMEEEEYAEARERRQARKQLQSSSSPARRKGVPAQDQSARLAPLGENETVANTPVKRPQAPTPNKASRKAPPECPTPTKQVSQARSPAGPRPANSRGNSGASNSSQAPAIVLQGATPTKELPPPHTTSSHPRPEMITTPTSPAPLSVPRVEDANLQTFLNQIADQMNRFSVRSSVASQSSTSSSAVLGSDYQACLAFAAGVTPSANPSSSVTESVIEEQGQFEDAADDQTDTEVASIHSGFTASIAPQSPLAGLGLGAPSAAVRPGLHPVAGPNQQRWSYASSAGSSYQGSSVGSYAPVESPQYIHSPLEVQAPVLQAERSAPRPPPRATRPAPPPISRPLPFSPAQQTYSEPTESLLPRDTSYVIIDNSELPSDASLSSWGSKSSGFKAHRGLDGFGMLKKKKLNVEPVPYSYGNLGSSATSPLNSPKRSWFNNLFNFKPATCTLLSRDNVANTRERVRKILLSIGVRTAVTEIDGHKALKCRLDEVRDNGNVTTKGVRFRVEFTRASTSQTYSTLVTLTQEKGAESSFRACFAELKHFMDSQPSAPTTLSLNRPSVEQSRSVNSSNLLPAHSYQQQRYSSTSADTPAGAPTSPLLSAPPIRYTASAPTTPVIESSPRFTSPYLQLPVSPQSLQMPSY

SEQ ID NO: 21959 - protein, 249 aa, Pseudomonas aeruginosa UCBPP-PA14
METRRLFDQGSAAYASARPRYPDALYRHLAGLCGQRRRAWDCATGTGQAALGLAQHFGEVLASDTSAQQIEHAVIHPGIRYSVQDAEATDYPDAAFDLVCVAQAWHWFDHSRFNRELLRVLRPGGVFAAWGYGWFSIDAQIDAAIDEEYLRPIGPYWAQQNRLLWNAYRDVELPLGELPAPAFVIEQQWSLARLFDYMATWSASRLCREAQGNAFVRQALQRVAALWGEPTSTRRVRMPLALRIARKDA

SEQ ID NO: 21960 - protein, 471 aa, Acinetobacter sp. ADP1
MSMANKVLKLIQESGAKWVDFRFTDTKGKEQHVTYPADSIDEDTFEDGKMFDGSSIAGWKGIEASDMILRPDAETGFIDPFFAEPTVVVTCDVIEPSTGQGYERDPRSIARRAEEYLKSTGIGDTAFFGPEPEFFVFDEVKWEIDMSGARHTLIAEEAAWSTGKDYESGNSGHRPRVKGGYFPVPPVDSSHDMRAEMCNKIEEIMGPGRVEVHHHEVASCQLEIGVSFNTMVRKADEVQQFKYAVHNVAHQYAKTATFMPKPMVGDNGSGMHVHMSISKDGKNLFAGDEYAGLSEMALYFIGGVIKHARALNAITNPSTNSYKRLVPHFEAPIMLAYSARNRSASIRIPYVSSPKGKRIEARFPDPMMNPYLGFAALLMAGIDGIQNKIHPGEAADKNLYDLPPEEEAKIPTVAHSLDMALEALQADHEFLLKGGVFTKEMLDAYIELKTEEVRRLNTTTHPVEFDMYYSL

SEQ ID NO: 21961 - protein, 421 aa, Glycine max
MGFLVPLFFHIVAFICTIAAIALAVLHIYRHLLNYTEPTYQRYIVRIIFMVPVYALMSFLSLVIPDSSIYFNSIREVYEAWVIYNFLSLCLAWVGGPGAVVISLSGRVLKPSWFLMTCCLPPLALDGRFIRKCKQGCLQFVILKPILVVVTLILYAKGKYKDGNFSPKQSYLYLTIIYTFSYTMALYALALFYVACKDLLQPFNPVPKFIIIKSVVFLTYWQGVLVFLAAKSGFIEDADEAALLQNFFICVEMLVAAVGHFYAFPYKEYAGANIGGSRGLTASLAHALKLNDFYHDTVHQFAPTYHDYVLYNHGGEGEEGTRKYRSRTFVPIGPEMDTVRRNKHLFGSKADDVQISSFSSNSSSPSNSGPISDVPHSGAMKSSLLVDVSNSLSVPYDMTLIDLDASSYPEKVPAADKAGGR

SEQ ID NO: 21962 - protein, 161 aa, Antirrhinum majus
LKTKKITLRSSDGEVFEVEESLALESQTIKHMIEDDCADNVIPLPNVTGKILSKVIEYCKRHVDAAAAKADDKLASTGTSDDELKAFDADFVKVDQATLFDLILAANYLNIKTLLDLTCQTVADMIKGKTPEEIRKTFNIKNDFTPEEEEEVRRENQWAFE

SEQ ID NO: 21963 - protein, 308 aa, Arabidopsis thaliana
MISDSIPKELILEIMLRLPAKSIARFHCVSKQWASMLSRPYFTELFLTSSSTQPRLLFAIKRNGLWCFFSLPKHQSPYDNSSSSLVVAADFHMKFLPNKIQMYSSSENRKLSCCYASGLTYFYDMYSEVRVICNPITGRYASLPYLKRYRKELSFFGFDPIDKQFKEWLKYAYSLRDDKFFTHDVFVVRVTATEMNTIQRVEIQGFGECQHEYDYYRSRVVYVFADHVEDLDVNDPKLLESKSEEEEEEEEEEEEEEEEEEEEEEEEEEEEESKEREKEKKIETVIGGWIKQYWACFLRKSWELNPHR

SEQ ID NO: 21964 - protein, 303 aa, Mycobacterium smegmatis str. MC2 155
METAAQNGSSNQTGTARVKRGMAEMLKGGVIMDVVTPEQARIAEAAGAVAVMALERVPADIRAQGGVSRMSDPDMIEGIIDAVTIPVMAKARIGHFVEAQILQSLGVDYVDESEVLTPADYTNHIDKWKFTVPFVCGATNLGEALRRITEGAAMIRSKGEAGTGDVSNATTHMRKIGGEIRRLTSMSEDELYVAAKELQAPYELVVEVARAGKLPVTLFTAGGIATPADAAMMMQLGAEGVFVGSGIFKSGNPEQRAAAIVKATTFYDDPDVLAKVSRGLGEAMVGINVEEIAQPHRLAERGW

SEQ ID NO: 21965 - protein, 451 aa, Mycobacterium sp. MCS
MSATYAVVGGGISGLVAAYRLRVTAGPDATITLFDPADRLGGVLRTERVGGQLLDVGAEAFVARRPEVPALLAELGLADRQIGTTGARPLIYSQGRLHPMPQGTLQGIPSGAATLAGLVDDATIARIADEPTRPLRWRPGADPTVADLVVDRFGEQVVSRSVDPLLGGVYAGSAATIGLRAAAPTLAAALDRGARNLTDAVREALPPPAPGSVFGAVDGGYAVLLDALRHRARIHWAQVGVERVDLVGRGVEIVDDEGNRWPADAVVLAVPAPRLPRLVDHIAPRTAAAARRIPVASAAVVALALPGGTPLPQQSGVLVATGERLRTKAITLSSRKWGRRGNVELLRLSYGRFGDDLARSTGDEDLLAWAAADLGTVFGIDTEPVDALVQRWIDAMPQYGPGHADLVAELRAGLPRGVAVAGGYLDGIGVPACVASASRAVASLATSGVAR

SEQ ID NO: 21966 - protein, 536 aa, Desulfitobacterium hafniense Y51
MAGLATSFGSGAMTNSINEIPNAEVMFVIGSNTTEAHPIIGTKMKQALARGAKLIVADPREIELARDAHIWMRLKPGTDIALINGIMNIIVENGWEDRAFIEERTEGYQELRENLKKFPPEEVSKITGVPVELMAEAARLYTSVERAQIFYTLGITEHVCGTDNVMSLANLAMLTGNIGKESSGVNPLRGQNNVQGACDMGALPNVYPGYQSVTNPEARAKFEEAWGVSLNPNQGFMIPDMFDSAVKKELRAMYIMGEDPVLTDADANHVRKGLKALDFLVVQNIFMSETAELADVILPGASFAEKDGTFTNTERRVQRVNRAIKPIANTKADWEIICELANRMGYPMAYPSPAEIMLEVASLAPQFAGVTYERLGKKGLQWPVPHAEHPGTKFLHQGKFTRGKGVFTVIEHQLPDELPDEEYPFLLTTGRKLQHYNISTRFSAALDEHAPEELAELNPKDARRLGIQDGEKIKVVSRRGEVVTKVWVTKRVPPGVLFMTLHYRESPTNVLTNGAYDKVTKTYEYKVCGVRVEALK

SEQ ID NO: 21967 - protein, 398 aa, Brucella suis 1330
MTTENARKFRPATELVHAGSLRSGFAEMSEALFLTQGFLYPTAEAAEARFKGEDPGFIYSRYANPTTDMFEKRMCALEGAEDARATASGMAAVAAAILCQVQAGDHVISARAVFGSCRYIVETVLPRYGVEVSIIDGSDVANWKAAVRPNTKVMFLESPSNPTLEIIDIAAVAQIANEAGAKLIVDNVFATPLFQKPLELGAHIVVYSATKHIDGQGRCLGGVVLSDREWIETTLQDYFRHTGPGLSPFNAWIMLKGLETLSVRVRQQTQSAAAIADFLAGKPGVKRVIYPGRADHPQADIIAKQMTGGSTLIALELEGGKEAAFKFENALQIFSITNNLGDTKSLITHPATTTHKNLSNEAKAELGISDGLLRVSVGLEDTDDLLEDVEVALKVARG

SEQ ID NO: 21968 - protein, 328 aa, Prochlorococcus marinus str. MIT 9515
MIILHIGLFENSSSNIMKSVIFQETAKLKRPVPAEKVLELHYKFLAPSSHSKNYPPRLHKTWGTIFFMIAIHVLSFVALQPQFWSLPAVTALFFFYWLTACLGVTLGYHRLLSHRSFVVPKWLERFFATCGAISCQHGPIDWVGLHRHHHSFSDTEVDHHNSKRGFWWSHMGWMFKDVEALKAVPKLSADLIKDPYYRFLNKYFLFLQIPIGLCLFAIGQKLEVGGWAMVLWGIPLRLVVVYHITWLVNSATHCWGKAPFESGDESKNNAWVAALTFGEGWHNNHHAFPNSARQGLFKGQIDLTWEHIKLLAKLGYAKKVKLPSRTYY

SEQ ID NO: 21969 - protein, 321 aa, Legionella pneumophila str. Lens
MDLSKRIEPKTWSFVEKIQNAGGKPIYDIPVAEGRAIFDQIQALPNEKPDVDVEDKTLPVGPGGKVDIRIVRPKGAKEALPVIMFFHGAGWVFGDYQTHGRLVREIAVGTHAAVVFVKYTLAPEAQYPTQIEESYAAMKYIAEHGKQFNLDTSRFVAAGDSVGGNMTSVMTLLAKERGGPQIDYQVLIYPVTDANFDNASYKEFAEGPWLTKKAMEWFWDKYLPNKEKRKEITASPLQASLEQLKGLPPALVITGECDVLRDEGEAYAHKLNAAGVTVTAVRHLGTIHDFLMLNDLSETPACRNAVETIIGHLTQIFGKKK

SEQ ID NO: 21970 - protein, 621 aa, Citrus unshiu
MKTKVWALCLILVVHSSWLASANMEGDALHSLRSNLIDPNNVLHSWDPYPCQSLHMVSCYMQMNNSVILVDLENAALSGQLVSQLGLLKNLQYLELYSNNITGPIPSDLGNLTSLVSLDLYLNSFTGPIPDTLGKLSKLRFLRLNNNSLSGPIPMSLTNISSLQVLDLSNNRLSGVVPDNGSFSLFTPISFANNLDLCGPVTGRPCPGSPPFSPPPPFIPPPPISSPGGNSATGAIAGGVAAGAALLFAAPAIAFAWWRRRKPQEFFFDVPAEEDPEVHLGQLKRFSLRELQVATDSFSNKNILGRGGFGKVYKGRLADGSLVAVKRLKEERTPGGELQFQTEVEMISMAVHRNLLRLRGFCMTPTERLLVYPYMANGSVASCLRERPPSQLPLDWPTRKRIALGSARGLSYLHDHCDPKIIHRDVKAANILLDEEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLQNNYVEAEVEQLIQVALLCTQGSPMDRPKMSEVVRMLEGDGLAERWDEWQKVEVLRQEVELAPHPNSDWIVDSTENLHAVELSGPR

SEQ ID NO: 21971 - protein, 165 aa, Antirrhinum majus
SSSDNASKKITLRSSDGEVFEVDEAIALLSQTIKHMIEDDCADNVIPLPNVTGKILSKVIEYCKRHVDADAAKSEEKVAAAAAGDDDLKAFDADFVKVDQATLFDLILAANYLNIKTLLDLTCQTVADMIKGKTPEEIRKTFNIKNDFTPEEEEEVRRENQWAFE

SEQ ID NO: 21972 - protein, 119 aa, Antirrhinum majus
TIIPVPNVTSKILAKVIEYCKRHVEAAAKTDADDGQGDRDALKVFDAEFVKVDQGTLFDLILAANYLNIKSLLDLTCQTVADMIKGKTPEEIRKTFNIKNDFTPDEEEEVRRENAWAFE

SEQ ID NO: 21973 - protein, 324 aa, Neisseria gonorrhoeae FA 1090
MLENLPYFQRHLPEDLAKVNEVINRAVQSDVALISQIGTYIISAGGKRLRPIMTILAGKAVGYDDEKLYSLAAMVEFIHTSTLLHDDVVDESDLRRGRATANNLFGNAAAVLVGDFLYTRAFQLMVASGSMRVLEVMADATNIIAEGEVMQLMNIGNTDITEEQYIRVIQYKTAKLFEAAAQVGAILGKASPGHEQALKDYGMYVGTAFQIIDDVLDYSGETEETGKNVGDDLAEGKPTLPLIYLMRQGSEQVANDVRTALENADRGYFEKIRDYVVRSDALAYSIGEARKAVDCAVAALDALSDSEVKDAMIQLAKESLVRVS

SEQ ID NO: 21974 - protein, 1043 aa, Vibrio vulnificus CMCP6
MFTATDVLKPEFVAQPLDKLWALISPLYMVDESQWLEQLLPLATPSAEEKQAIASRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRVASREGLGVFVCISPWNFPLAIFLGQVTAALVAGNTVVAKPAEQTSLIAVRAVELMLQAGFPAGVVQLIPGRGADIGSALTSHPAIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPHRHKTDVGPVIDARAKEKLLLHIEQMNQTQRPIAQLTLADDCQHGDFVAPTAFEISGIDVLKEEQFGPILHIVRFKASELTRVVEQINQTGFGLTMGIHSRNETTYRWIEKHARVGNCYINRDQVGAVVGVQPFGGQGLSGTGPKAGGPHYLYRFTQVQFNQTENA

SEQ ID NO: 21975 - protein, 1102 aa, Prochlorococcus marinus str. NATL1A
MPRRKDIRRILILGSGPIVIGQACEFDYSGTQACKALRGEGFEVILVNSNPASIMTDPETANRTYVEPLTASVVEQIIKIERPDALLPTMGGQTALNISVELAESGILEKYNIELIGADLNAIKKAEDRNLFKIAMKNIGVDVCPSGIASNLQEAVIVGNEISSFPKIIRPAFTLGGSGGGIAYNQDEFLELCKTGLDASPVSQILIEKSLLGWKEFELEVMRDLSDNVVIICSIENVDPMGVHTGDSITVAPAQTLTDREYQRLRDYSISIIREIGVATGGSNIQFAINPNNGEIIVIEMNPRVSRSSALASKATGFPIAKIAALLAVGYRLDEIINDITGKTPACFEPSIDYVVTKIPRFAFEKFSGSSSILTTSMKSVGEAMAIGRCFEESFQKAIRSLETGLSGWGCDRVDQNVSSIELERLLRTPSPERIMHVRLAMKNGRSDNEIFSFSKIDPWFLSKLRNIVEAEDQLLNYENITQLEPNFLFKLKQLGFSDRQIAFALNTDELTIRARRTHLKILPVYKTVDTCASEFSSNTPYHYSTYERPAYNIDNDGNIIKNINLNELKNDNKNKILILGGGPNRIGQGIEFDYCCCHASYQAQEEDYTTIMLNSNPETVSTDYDTSDILYFEPLTLEDVLNVIEFEEPYGIVVQFGGQTPLKLSLPIVNWLEKLENSKLRTKVLGTSPISIDLAEDREQFDKVLRRLDIRQPKNGLARTFEESLSVANKVGYPLVVRPSYVLGGRAMEIVYEQDELERYIKEAVNVEPDHPILIDQYLENAIEVDVDALCDVSKNVVIGGLMEHIEPAGIHSGDSACCLPSITLSVESIKTIKHWTKSLAIELDVVGLINLQFAVKRDDEGNEIVYIIEANPRASRTVPFVSKATGVPLAKIATQLLLGKTLKDIGLNQEPIPPLQTIKEAVMPFKRFPGSDSLLGPEMRSTGEVMGSAKTFGMAYAKSELAAGEGLPTSGFVFLSTHDRDKPALIPVAKKLIELGFSVLATSGTSKYLEKFDLNVERVLKVHEGRPNIEDMIRSGKVQLVINTPIGRQAIYDDKYLRKAALDYSVPTLTTLKGASAAVKGIEALQNQILSVSALQDIHS

SEQ ID NO: 21976 - protein, 535 aa, Yarrowia lipolytica CLIB122
MSYKTRKEVLPRSEIEALIADGHHIVIYNGKVLKLDNWLDRHPGGDMAIFHVVGRDATDEINAYHSDEALATMGAYQIGITGEKIWENFLPPIQGGVFRKRGSIAADEGISLSSSASSSSQEAVTQKPAPIFTNEQILKAERLKLIEEDENRQLQHDLEIFPSLDYNTQTEIGTKYKALYKRVEDAGLFEPNYRGYFSDFLRISTMFSLSWYLFDKSMFLSAICLGMGWHQLVFIAHDAGHIGITHGYQMDNWIGMTIAAWIGGLSLGWWKRNHNVHHIITNDPVHDPDIQHLPVFAVSNRFFSSVKSTYYNCVLKYDIFARYLIPLQHMTYYPILCLGRFNLYALSWGHVLLGRGPRHGKAAWFRWYELMGLSFFAYWFFYLIVYKSIPTAGQRWMYVIVSHVATMPVHVQITLSHFAMSTQDLGLSESFAQRQLRTTMDVDCPAWLDFLHGGLQFQAIHHLFPRMPRHNLRRAQRYVLEYCKDIGVEYHIYGFVHGNQHVIGKLGEIAKQAEIFRDCERHLREEHVAEMTEAK

SEQ ID NO: 21977 - protein, 349 aa, Bradyrhizobium japonicum USDA 110
MTSTALAATLFGPEDLRMIEHPLDKLASGMVRIRFGAGGICGSDMHYFRHARTGDFVVKSPLVLGHEISGEVVEISGSAANLKVGDRVAVNPSRWCGHCVACREGRPNLCENIYFMGSASKTPHMQGGFANYFDAIPAQCVKIPDHVSYQAAALAEPLAVCLHAVARAGNIEGKRGIIFGAGPIGLLTMLAAHRAGMADITVADIAPAPLAFASRLGASHVENVSGGEEGLKAQAAARPYDVAFEVSGTAAGLASAIGIVRRGGVVVQIGNLPGGQIPTPSNAVMAKEIDLRGSFRFGFEFMTAVELISAGSVDVLSLVTAERPLSTAPDALRLALDRSQSVKVVLTAN

SEQ ID NO: 21978 - protein, 613 aa, Oryza sativa (japonica cultivar-group)
MRRGLARHPEVRELVEVVMDLGRRPLARFPSGDWVISEQAVTADDLHQAVSKVGDFSEDNRSGINHSLHRISAIRNRKAHIIGLTCRVGRAISGSAEMIRDLVVGGGSILVIGPPGVGKTTLISLRCFQQYREIARILADEGKKRVIIVDTSNEIGGDGDVPHSGIGRSRRMQVPKVSMQHNVMIEAVENHMPEVIVIDEIGTELEAMAASTIAQRGVQLVGTAHGVTIESIIKNPCLQVLVGGIESVTLGDEEAKKRKVQKTILERKGPPTFSCAVEMISKTECRVHHKLEATVDAILAGKPPKFEARKMDYKATESGRSLVIPEREYETEPLPSYQEHHFAKAMPSEDNFDDDFSTRRTESKSVPSNDNFNDDFGSTRKTKGKTSVPGKSPVHVYTYQISEADILQVATVMGFDDELDVTDDIGAANVILASSSEMKQNHWIRNVAKYHKLPIFVVKTNTMAQIVKAVRMIVGRDKLNAPTRKQPKVVVGEIEIEDDAPKRKPSLEEIDALEEARLAIEYIVIPGGEPVELLPRCSEIVARQLELVESYQLLAETFGTDSNSRLQILPVKITKKSSSKGSAGSMPKQGSSDLIVSDNGGGSSFSRLPFLPK

SEQ ID NO: 21979 - protein, 180 aa, Triticum aestivum
MTLQLQRSAVVSGKEPEPEPEMGQGQEVVAHVYDVACSGPDGAGGGGATVLQINRIFKDGIGLGGIFHTAIQVYGNEEWSFGYCENGSGVFSCPPAKNPMYTFRESFVLGKTSCSPRTVNQIARELSREWPGASYELLSRNCNHFCNEFCDKLGVPKLPGWVNRFANAGDAALEAAETTA

SEQ ID NO: 21980 - protein, 393 aa, Ashbya gossypii ATCC 10895
MGVLPTDKFATKAIHAGAHTDLHGSVIEPISLSTTFKQSSPGNPVGAYEYSRGQNPNRQNLEEAIAALESAKYGLAFSSGSATTAVIVQSLPQGSHAISIGDVYGGTHRYFTKVANAHGVETSFTNSLLEDLPKLVRDNTRLVWIESPTNPTLQVTDIQQVADTVKALNEDIILVVDNTFLSPYLSNPLNFGADIVIHSATKYINGHSDVVLGALATNSTSLYERLAFLQNAIGAIPSPFDAWLTHRGLKTLHLRVRQAAQSAQKIAEYLEQSEHVVSVNYPGLPSHRGYQIAQKQHRDGLGGGMISFRVKGGAQGAALLSQSTRLFTLAESLGGIESLLEVPAVMTHAGIPKEAREASGVYDDLVRVSVGIEDTDDLLEDIKQALSVVAESI

SEQ ID NO: 21981 - protein, 341 aa, Desulfitobacterium hafniense Y51
MPVNNKDINILGIETSCDETSAAVLRNGCELLSHIISSQIKTHQKYGGVVPEVASREHILHLQSVVEQALQEAKMGFGDLAGIAVTYGPGLVGSLLVGVAGAKAMAYGAGIPLLGVNHLEGHIYANFLHNPGLKFPLLALLVSGGHSHLVYFEGHGKYQVLGQTRDDAAGEALDKVARTLGLGYPGGPYIQKAALEGNPHAYEFPRAMLEPGSLDFSFSGVKSAVLNTLNSARMKGETVNVADVAASFQEAIVDVLVRKTLLALARTKAPTLVLAGGVAANTLLRERLTEATQKRGIAFSYPPPILCTDNGAMIATAGYYRYLDKDYAPWNLNAIPGLNLA

SEQ ID NO: 21982 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEDSGKA

SEQ ID NO: 21983 - protein, 157 aa, Hyacinthus orientalis
NSCRHQWAVRVAHYLPWLTYWWNTQKWFPCSSVITGRPEIFSAGDMKVLHKFLARGHYMDQILQQGEHNSLHHDMTVGFGNWEFDPMDLGDPFPDAEGSVHLWHGAEDRIVPVIMSRYISRRLPWIHYHELPDAGHMFPLADGMGDAIVTALLVGDD

SEQ ID NO: 21984 - protein, 641 aa, Oryza sativa (japonica cultivar-group)
MSAAVGGAEFHGFRGGGGGAAQLQRSRMLGRPLRVATPHAAAPAGGGGSSSASIRAVSAPLKKDASEVKRSKVEIIKEKSNFLRYPLNEELVSEAPNINDSAVQLIKFHGSYQQTDRDVRGQKNYSFMLRTKNPCGKVPNQLYLAMDTLADEFGIGTLRLTTRQTFQLHGVLKKNLKTVISTVIKNMGSSLGACGDLNRNVLAPAAPYVRKDILFAQETAENIAALLTPQSGAYYDLWVDGEKIMSAEEPPEVTKARNDNTYGTNFPDSPEPIYGTQYLPRKFKIAVTVAGDNSVDILTNDIGVVVVSDSAGEPVGFNIYVGGGMGRTHRVETTFPRLADPLGYVPKEDILYAIKAIVVTQRENGRRDDRRYSRMKYLIDNWGIEKFRAEVEKYYGKKFEDSRPLPEWQFNSYLGWQEQGDGKLFYGVHVDNGRVAGQAKKTLREIIEKYNLEVSITPNQNLILCGIDQAWKDPITAALAQSGLLEPKDVDPLNITSMACPALPLCPLAQTEAERGILPILKRIRAVFDKVGIKDHESVVVRITGCPNGCARPYMAEVGFVGDGPNSYQIWLGGTPNQSTLAETFMNKVKLQDIEKVLEPLFSYWNSTRQEGESFGSFTRRTGFDKLKEVVNKWAESASAA

SEQ ID NO: 21985 - protein, 191 aa, Triticum aestivum
  misc_feature (3)..(3): Xaa can be any naturally occurring amino acid
  misc_feature (155)..(155): Xaa can be any naturally occurring amino acid
  unsure (1)..(191): unsure at all Xaa locations
LPXDVRRVIYLDSDVIVADDIRTLFSVDLAGHVVGAPEYCHANFTNYFTDTFWMDRALSGTFHGRRPCYFNTGVMVMDVDQWRTGGYTRRVEGWMAVQKQKRIYHLGSLPPFLLVLAGDIQAVDHRWNQHGLGGDNVKGRCRGLHPGPISLLHWXGKGKPWHRLDARRPCTVDYLWAPYDLYRPSSPVLEE

SEQ ID NO: 21986 - protein, 288 aa, Candida albicans SC5314
MSLKLVPQQRGIVHTYGFNLTAFEFTTDPSNISPNIILFVGGLGNGLLNIPYLPELADSASNEFQSTDGGSWSLVQVLLSSAYQGWGTSSLDRDTSELQSAIEYFRSERGGNRQKIVIMGHSTGCQDVIHYLTKTLYKENIPETSQVQGGILQAPVSDSEALSSGRDPTKHEALVQRVYDEYISKGKESEILPQEYRKLTWGVPTSAYRFYSLASKRGDDDYFSSYLTQEDYTKSFGKVNKPLLVLYGSIDEFVPEYVDKENLVSTWKQSTSSQYWSEHSQIIKGATP

SEQ ID NO: 21987 - protein, 456 aa, Haemophilus influenzae Rd KW20
MTKHYDYIAIGGGSGGIASLNRAASYGKKCAIIEAKHLGGTCVNVGCVPKKVMFYGAHIAEAINNYAPDYGFDVEVKKFDFSKLIESRQAYISRIHTSYNNVLAKNNIDVINGFGKFVDAHTIEVTLADGTKEQVTADHILIATGGRPYRPNIKGQEYGIDSDGFFALTELPKRAAVIGAGYIAVELSGVLNSLGVETHLLVRRHAPMRNQDPLIVETLVEVLAQDGIQLHTNSTPSEIVKNADGSLTVRCDGQSDVTVDCVIWAAGRVPTTDKIGLENAGVETNEHGYVKVDKYQNTNVKGIYAVGDIIENGIELTPVAVAAGRRLSERLFNNKPTEYLDYSLVPTVVFSHPPIGTVGLTEPQAIEQYGAENVKVYKSSFTAMYTAVTQHRQPCKMKLVCVGKDEKVVGLHGIGFGVDEMIQGFAVAIKMGATKADFDNTVAIHPTGSEEFVTMR

SEQ ID NO: 21988 - protein, 700 aa, Mycobacterium bovis AF2122/97
MTTLEEISALTRPRHPDDWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 21989 - protein, 127 aa, Emiliania huxleyi
MSVLEKIVKESDFFYKKENLPKFRVGDTVKVTLYLELPKADEAKKGKERIQVYQGVIISTHNNENPTNATITVRKMFQGGGIEKVFLLNSPWLKTVEVLTSAKVRRGKLYYLRDRVGKSARLKRLFT

SEQ ID NO: 21990 - protein, 242 aa, Brassica napus
MQSIVSSHHLCLAPPPPPPVLCQRLLCHRVPSIRLPSRRSTTSLRLFPCAAVSRESEMAAKEDGQDPRIPKIASSIRVIPDFPKPGIMFQDITTLLLDTEAFKDTIDIFVERYKCKGISVVAGVEARGFIFGPPIALAIGAKFVPMRKPKKLPGKVISEEYSLEYGTDKIEMHVGAVEPGERAIIIDDLIATGGTLAAAIRLLERVGVKIVECACVIELPELKGREKLGEAPLFILVTSDAA

SEQ ID NO: 21991 - protein, 376 aa, Andropogon ternarius
ALSIAGAVQSQKLAVRAISRLQALPGGDVKLLCDTVVEHVRVLTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVLAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDNLADAGYLGAAALGDAVCGMAVAYITPSDYLFWFRSHTAKEIKWGGAKHHPEDKDDGQRMHPRSSFKAFLEVAKSRSLPW

SEQ ID NO: 21992 - protein, 376 aa, Apluda mutica
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCLGDSTGLSTDSLADAGYLGAAALGDAVCGMAVAYITPSDYLFWFRSHTAKEIKWGGAKHHPEDKDDGQRMHPRSSFQAFFEVVKSRSLPW

SEQ ID NO: 21993 - protein, 376 aa, Bothriochloa odorata
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCRATPVRVIQDPGLSQPLCLVGSTLRAPHGCHAQYMANMGSIASLVMAVIISSGGDHEQTGRGGISSAMKLWGLVVCHHTSPRCIPFPLRYACEFLMQAFGLQLNMELQLAHQLSEKHILRTQTLLCDMLPRDSPTGIVTQSPSIMDLVKCDGAALYYHGRYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 21994 - protein, 559 aa, Yarrowia lipolytica CLIB122
MRNNLAEKNDLLEVHPNGNGTTNGPGNEFSASSRTSSIQSFLGNYEMPQVEPHKAAGNKSTDHYKSRMSPWRYRMRSAMLPLIRWETPYLAQIQKSSRNIWLDVYFAMTANLGTHTFYVIMLPVLFWFGQADMARGLVFVLAYGVYVSGVIKDLLCLPRPLSPPLHRITMSGSAALEYGFPSTHTTNAVSVTLLFLQKLYECKDNLSSFSFESLRALCVLYGASIICGRIYCGMHGFLDVISGFLLGALLWWIRFAFGDLMDATTTAEAPYALLAIPLALLLVRVHPEPVDSCPCFDDGVAFMGVIMGQDVGIWLFGKTQYATSVPLRGAIAYNFQDIGIIKSFLRVVVGIMLVLVWRAVAKPMMHTYLPPFFRIIERVGLSMPRRFFLSASEYKDVPGQIPDSTLIEPHEIPSLIHKLGHARKDSVGPQSTADVIESIAYAEYQRQRQDKKLGVDDDAPYPDAEGVSYRGDKTSKMDEKCGHSHGHDQDAEDELFASIQPPRVRYDVEVVTKLIVYSGIGCLVMFCGVVFQVVGLGVTAEHLTHTAAKVVGEATEKIL

SEQ ID NO: 21995 - protein, 144 aa, Triticum aestivum
MHPTRWELSHMVDLQAAALVISVVAAEVFLRQAAMEPASASLVSLRVSTATSRSCFSCRQRATPRTRMLPAMASKSGAKLVASGCKTCRGKGAVECEGCKGTGRNKKNGNIFERWKCFDCQGFGMRKCPTCGKGGLTPEQRGER

SEQ ID NO: 21996 - protein, 535 aa, Spinacia oleracea
MADERNTYGGPAPSMETTDRGMFDFMKKNNKGEDHKPSEADVIASGGIGKLPVSEPAHYDHDDKEHVGLLEKKHIGLVEQFHRSDHASDERHHDEEQNKGGVFGKIKEKLPGQHDSDTTTHTQQLYPASDHNYNTHHVHQDDEKKDNILDKIKDKLPGKHEDKKQDYHQHQEEEKKGGALDKIKDKLPGQGNAGHTQQLYPAPDHNYNTHHVHQDEENKDSVLDKIKDKLPGQHEDKKNDYHHHQEEEKKDSVLDKIKDKMSGQHEDKKNDYHHHQEEEKKGGVLDKIKDKLPGQHDADTARHTQQLYPAADHNYNTHHVHQDEENKDSVLDKIKDKLPGQHDDKAAYSQHDHHKHHQEEENKGGVLDKIKDKLPGVYMVVKHDGDIVEHTQQLYPAPDHNYNTHYVHEDEKKKDSVLDKIKDKLPGQHEEKAAAYSEPSYDSHPTPAKHHDYFPQEEEKKGGVMDKIKDKLSGQHKDKADEHELVAPLVTVEPHSEGDKEKKGFLEKIKDKIPGLHSKNDAEEKKTHEEKKEGY

SEQ ID NO: 21997 - protein, 294 aa, Aeropyrum pernix
  misc_feature (1)..(1): Xaa can be any naturally occurring amino acid
  misc_feature (21)..(21): Xaa can be any naturally occurring amino acid
  misc_feature (43)..(43): Xaa can be any naturally occurring amino acid
  misc_feature (95)..(95): Xaa can be any naturally occurring amino acid
  misc_feature (131)..(131): Xaa can be any naturally occurring amino acid
  misc_feature (291)..(291): Xaa can be any naturally occurring amino acid
  unsure (1)..(294): unsure at all Xaa locations
XARGREAVTLLLVGWGYAPGXQTLEALDAVRRADVVYVESYTXPGSSWLYKSVVEAAGEARVVEASRRDLEERSREIVSRALDAVVAVVTAGDPXVATTHSSLAAEALEAGVAVRYIPGVSGVQAARGATXLSFYRFGGTVTLPGPWRGVTPISVARRIYLNLCAGLHTTALLDVDERGVQLSPGQGVSLLLEADREYAREAGAPALLARLPSVLVEAGAGGGHRVLYWSSLERLSTADVEGGVYSIVIPARLSGVEEWLLAAASGQRRPLEYDRSVYETVEENCKKGVYXEPV

SEQ ID NO: 21998 - protein, 644 aa, Ashbya gossypii ATCC 10895
MWGGCSAAGRARASGLLTGPAQLIKKTTGSSSSTQKKKDKETGKKPGSANGAAGAVGGSGGRATVDKKEQKGSGAKQPKAKDAGKSGAGAAPKVKVAAKKEERSYPTMIAAAVSPGSTSGPPSPKEAEAASPNGIDIPRSSHSFERLPTPTKLNPDTDLELIKTPQRHSSSRFEPSRYTQISKLPGFDDVPPEEQISLFIAKVDQCNIMFDFSDPSFDIHGKEIKRITLQELIEFIVTNRFTYTEEMYGHVVNMFKVNLFRPIPPPVNPIGDVYDPDEDEPVNELAWPHMQCVYEFFLRFVESPDFNHQIAKQFIDQEFILKLLELFDSEDIRERDCLKTTLHRIYGKFLSLRSFIRRSINNIFLQFVYETERFNGIAELLEILGSIINGFALPLKEEHKVFLVRILIPLHKVRCLSLYHPQLAYCIVQFLEKEPMLTEEVIMGLLRYWPKVNSTKEIMFLNEIEDIFEVIEPLEFIKVEVPLFVQLAKCISSPHFQVAEKVLSYWNNEYFLNLCIENAEVILPIIFPALYELTSQLDLDSQTDEEGNPNQDPYMLVEQAINSGSWNRAIHAMAFKALKIFLETNPVLYENCNSLYLSSLKESQKRREKREENWNKLQEYVRNLHISSVDNPVAVDRIGTGDLH

SEQ ID NO: 21999 - protein, 131 aa, Pyrobaculum aerophilum str. IM2
MEARPLATPEEAWRIASSLRYRHIEGTVVAVVQDVETKEVLMVGHMDPIAVVLTLTTGLAHYYSTTRKRIWLKGETSGHYQIVKEFRSDCDGDAVVIKVVQIGAACHTGSRSCFESKYSLIKALKLSLRHG

SEQ ID NO: 22000 - protein, 167 aa, Glycine max
MIASSFCNADSMFSREEGIDVRKMMEHKRRPCSVDQSSYTSIASKRQKADLSISTKERKEKIGERIVALQQLVSPYGKTDTSSVLKEAMEYIGFLHKQVKLLSAPYLESSPAAKMQGVEPCSLRSRGLCLVPVSVTIGVAESNGADIWAPIKTTTSPKFEKDVSQFH

SEQ ID NO: 22001 - protein, 207 aa, Arabidopsis thaliana
  misc_feature (177)..(177): Xaa can be any naturally occurring amino acid
  unsure (1)..(207): unsure at all Xaa locations
MQGVIRSFVSGGNVVKGSVLQHLRVINPAIQPSVFCSRYESTQPARMEESGFESTTISDVMKSKGKSADGSWLWCTTDDTVYDAVKSMTQHNVGALVVVKPGEQQALAGIITERDYLRKIIVQGRSSKSTKVGDIMTEENKLITVTPETKVLRAMQLMTDNRIRHIPVIKDKGMIGXMVSMGDVVRAVVHEHREELQRLNAYIQGGY

SEQ ID NO: 22002 - protein, 342 aa, Silicibacter pomeroyi
MKALEKSKPEEGLWMVQAPVPEIGPDDVLIKIKKTGICGTDIHIWNWDEWAAHTVPVPMITGHEFAGEIVELGRDVTGLSIGQRVSGEGHLIGTESRQSRAGKFHLDPGTRGIGVNVQGAFAQYLRLPAFNVVPLPEDIPDEIGAILDPLGNAVHTALSFDLLGEDVLITGAGPIGIMAAAVAKHAGARHVVITDINADRLKLAQHVVPRARTVDVTREDLGDVVHELGLKQGFDVGLEMSGSQAALDQMVEALVMGGKIALLGIPPGKSPVDWSRIVFKAITIKGVYGREMFETWYKMIAMLQNGLDVSRVITHRFGVDEFREGFAAMKSGLSGKVVLDWT

SEQ ID NO: 22003 - protein, 376 aa, Chionachne koenigii
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVVQDPGLSQPLCLVGSTLRSPHGCHAHYMANMGSIASLVMAVIISSGGDDEHTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAATLGDAVCGMAVAYITPSDYLFWFRSHTAKEIKWGGAKHHPEDKDDVQRMHPRSSFKAFLEVVKSRSLPW

SEQ ID NO: 22004 - protein, 127 aa, Triticum aestivum
MVLASGPAATFSARPAAPGAGRPCSCAAAATGGARFRGADGKWWAPLLGWSGQPDYIDAQPAPAPATEEERAAAGAAGARRFGVLTEEKARQLRLRMMETESFHDAMYHSAIASRLASAARDSDAKP

SEQ ID NO: 22005 - protein, 376 aa, Chrysopogon fulvus
ALSMAGAVQSQKLAVRAISRLQALPGGDVKLLCDTVVEHVRELTGYDRVMVYRFHEDEHGEVVAESRRDNLEPYLGLHYPSTDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22006 - protein, 564 aa, Bacillus licheniformis ATCC 14580
MRRTKEGHLETSLRGKDVLSIPTLNKGVAFSLEERKNLGLEGLLPPTVLSLDQQAERAYEQFSRQPDRLRQNVYLNDLQNRNEVLFYKLLQNHLREMLPVVYTPTVGEAIQEYSHEYRRPHGVYLSIDDMDGIETAFKNLQASADDIDLIVATDSESILGIGDWGVGGINIAIGKLAVYTAAAGIDPSRVIPVVLDVGTNNEKLLNDPLYIGNRHPRVEGERYEQFIDAYVETALKLFPNALLHWEDFGNKNARNIMSKYNHKIATFNDDIQGTGAITLAAILAAVKKTGTSLKDHRVVIFGPGSAGIGIADQIRDTMVLEGLSEEEANRAFWTVDYRGLLTTGMDQIMDFQEPYLRDTEEVKDWKRNEKGEISFEEVIRQVKPTILIGTSGVAGAFSEEIIKEMAAHTERPVILPMSNPTHLAEAVPEDLFKWTDGKALVATGSPFEAVEYNGVKHEIGQSNNAFVFPGLGLGTIVAKAKVITNGMFAASANAVANMVDHEKPGAGLLPKIDDLQDVSVQVAIDVVKAAIKDGVAQVQPEDVEKAVREAMWRPEYKTIVAKQD

SEQ ID NO: 22007 - protein, 376 aa, Chrysopogon gryllus
  misc_feature (240)..(240): Xaa can be any naturally occurring amino acid
  unsure (1)..(376): unsure at all Xaa locations
ALSIAGAVQSQKLAVRSISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVVISSGGDDEQTGRGGISSAMKLWGLVVCHHTSPRCIPFPLRYACEFLTQAFGLHLNMELQLAHQLSEKHILRTQTLVCDMLLRDSPSGXVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22008 - protein, 558 aa, Emiliania huxleyi
MLLADNLNQLLDILPEFISKPLRTTEMRTQLIEIVLDIGRRPEARFATGTKYLSYKTIVWQDLEYVLKRLGKFSGDNRAGIEKTLHRVSALRNRNGGVIGLTCRIGRAIFGTVNIICDLLEKRKSILLLGRPGVGKTTAIREIARVLSDDMNKRVIIIDTSNEIAGDGDLPHPSIGKARRMQVRNPQNQHQVMIEAVENHMPEIIIIDEIGTELEATAARTIAERGVQLVGTAHGSALDNLIKNPTLTDLIGGIQYVTLGDEEARRRGSSKSILERKAPPTFEIAVEIHNVKTWVIHDNIERSVDLLLQGQNLALQKRELSPFDRGIVKCSLTHSNKEDESLYGIENSSNFTNPGYKKSKTNPSQLGRDEYVKSKKSNKNNSLVKKELGERFIFLYVYGINSQDLCSLIKTLDLPIIVTREVQYADNVLALGNLIKNNKKLRQISSSRNINISTIPNNSLLQIAKALKQIVIRNSSGSEFKNDDRIKRASGQLFSPLEETQFLIDEIIQSKKRAINLLPRSREVRKLQHQLISHYQLKSISVGVEPHRYVRLFPSGIR

SEQ ID NO: 22009 - protein, 376 aa, Cleistachne sorghoides
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISGGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22010 - protein, 250 aa, Yarrowia lipolytica CLIB122
MTYVTFSPGAFLGGNTTCDRKQHGLVLLNQPITNMELFKQAWTFCERRICADGGANRLFDALKTDEERLRFLPDVIVGDFDSLRDNVRQWYEDHGVLVKHDTSQDTTDFMKAVTLGNELYQVHGLLVLGALGGRLDHTFHSIFHLFLSLKHHQTVYLLNDACVSFLLHPNVPNIVKTPQNLLGKAVGIIPVAGPTRITTKGLQWDVEDWETSFYTQISTSNYLVADQVTIESPDPVLFTIEFKFNELHGG

SEQ ID NO: 22011 - protein, 376 aa, Coelorachis selloana
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSSMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22012 - protein, 336 aa, Prochlorococcus marinus str. NATL1A
MKDKDINNDFNHIFPEDIRDDFLFSLDSYRLFLEGLSINPSLFYQKWSDVNVQSIVNKYWKPTQKSDWKWSLAFPIFSLLENYINTFNKPIIIGFSGLPGSGKSTLGFWIDSVARELSLDIKVISLDDFYLPGQEMDVAMSDNPWNVPRGFPGSHSLDLLNQSLDVFLKTGVLNSPTFDKSLRDGKGDRSGWCDSEPRVLILEGWFVGCEPVSDLSKIDYMAPDEFNLSLSQSEKDYRILIQESLIEYSQIWNKFDKIWHLKSSQFNNTILWKSQQEGEMIKLKGSGLKGNNLSNFIRMIQTSIPQQSLSFINSDTTVGINQDRRINLLKTSKYYF

SEQ ID NO: 22013 - protein, 391 aa, Arabidopsis thaliana
MSSMYHDYDHLTASGKGLWSKFYGLVDAAVLLYDEIQRRGKIVSEEESQKRIFCLFPRRKRSSLVKRQQKLNGGFISFTSSSLIDLNQLPTDSEIEDPQTSDSQMKTLQNSSSEPCTSLVLFDYKTAESEKMEAKTLQNPSSELCSSLVLSDYKMAESEKMETKDPPNPLSLCLTGNTSRKRRAVEERKRTGGFKKAKVAPFPGTARDTPKWLVKVMRDMKEAKDAKLIFEKTLFVTDINPTQNRLSMPFNNLLQNDFLTSVESRIIKEDINNNKKIGVGAILVDQRSVKWGVMLKRWELKKESGKGSWNYNLICGWNDVVEANGLKEGDNISVWSFRCRGVLCFAMEQSSSSLALCLCTQLSLYKVGIIRKHCLSVCCNEQVTISQNKSY

SEQ ID NO: 22014 - protein, 509 aa, Mycoplasma mobile 163K
MKKFYISTPIFYPNGDLHLGHLYSMSIAWAIRNYKKLKGYQTLLLTGSDEHGQKIMQSAEKNNLSPKNFVDQQAEKFKSFWKKFDIEYDVFVRTTDKKHNSVIEKILTKLNENNFIYKSFYEGLYSISDEEFLTKTQAKEVNGKFFHPVSNHELKIVKEESYFLKISQFQNWLKKYLEDYPNFISSQKVINELKSTFLNEKLEDLSISRNSFDWGIKFSFDNKHIAYVWVDALFSYLSPLELFLNQEKFNSSWNDDVEKIHVVGKEITRFHGIYWPIMLKMLNLPLPNKILSHGWLITSTGKMSKSKGNIVNPLDLLEEFDSETIKLYLLSAFSINRDGVFDKENIKFFYNSFLANNYGNLISRVSSLFSQNFSSKISWDQNSLDKIDYSILDKIEKSKEDFMSNFDNFEIDKAVEILIKLGNELNGYVDLTKAWLLKDDKKRLATILLILINGIYAMSAYLKIFMPLKIEKIERDFFQQNASLENIENWKKFDDIFIKKIESIFNRIK

SEQ ID NO: 22015 - protein, 325 aa, Mycoplasma mobile 163K
MAKKIAILTSGGDSPGMNNAIRTIVKTSKIHGIEVFLVYNGYKGLVEKTIKNANEINVDQYIGSGGTFIGSARYLEFKKLEVRQKAVQNLKEMGIDSLVVIGGDGSYAGAQLLHELGVKTIGLPGTIDNDIASTEYTIGLDTALNTIVENVDRLRDTMNSMNMVALVEVMGHGAGDLAMLSGLATGAEIIVTNAHRKSIDEMIEIVKDQMIAKTKRSVIGIVSEFIYDDLKKVAKEIEDKTGIRTRAIILAHTQRGGNPKAYERINASFLGIAAVESLLKNESGVALGFKGNKIISTPIPEALKAQNSAKNENELVTKINKINQS

SEQ ID NO: 22016 - protein, 376 aa, Coix aquatica
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRSPHGCHAQYMANMGSIASLVMAVIISSGGDDEQTSRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPNDYLFWFRSHTAKEIKWGGAKHHPEDKDDGQRMHPRSSFKAFLEVVKSRSLPW

SEQ ID NO: 22017 - protein, 376 aa, Cymbopogon flexuosus
ALSIAGAVQSQKLAVRAISRLQALPGGDVKLLCDTVVEHVRELTGYDRVMVYRFHEDEHGEVVAESRRDNLEPYLGSHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGRRMHPRSSFKAFLEVVKSRSLPW

SEQ ID NO: 22018 - protein, 215 aa, Xanthomonas axonopodis pv. citri str. 306
MSEAKRLAAEKAIDYVEDGMIVGVGTGSTVAYFIDALGRIGHRIKGAVSSSEQSTARLRQHGIEVLDLNHTGNLSLYVDGADECDPNRCLIKGGGAALTREKIIAEASERFICIVDPSKQVPVLGKFPLPVEVIPMARSLVARQILALTGGQPVWRDGVVTDNGNVVLDVHHLQVTDPVGLERSLNQIPGVVCVGLFARRPADVVIVGGEPPQVI

SEQ ID NO: 22019 - protein, 376 aa, Elionurus muticus
ALSIAGAVQSQKLAVRAISRLQALPGGDVKLLCDTVVEHVRELTGYDRVMVYRFHEDEHGEVVAESRRDNLEPYLGLHYPATDIPQAPRFLFRQNRVRMIADCHATSVRVIQDPGLSQPLCLVGSTLRAPHGCHAQYMANMGSIASLVMAVIISSGGDDEQTGRGGISSSMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGITPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRTLPW

SEQ ID NO: 22020 - protein, 112 aa, Thiobacillus denitrificans ATCC 25259
MSDCIFCKIVRGELPASKVYEDEELLAFHDIHPFARVHLLIIPKLHVASLADCTVAHQDLLGKMLLLAPRLAKESGLDAGFKTLINTGRGGGQEVFHIHVHVFGGGDPAKRA

SEQ ID NO: 22021 - protein, 108 aa, Thiobacillus denitrificans ATCC 25259
MSDILDRLAEILEARKQASPDASYVARLYAKGTDAILKKIGEEATETVMAAKDDQAEKIIYEVADLWFHTLVLLAHKGLKPADVLEELARREGLSGLTEKANRQGGST

SEQ ID NO: 22022 - protein, 133 aa, Thiobacillus denitrificans ATCC 25259
MSDWLDAVKWDAQGLVPAIAQDAASGEILMVAWMNREALEETARTGRGVYFSRSRHKLWRKGEESGHVQTVSEIRLDCDNDVILLKIEQLGGIACHTGRRSCFFHKLTTDDRGHADWVATEPVLKNPDEIYRR

SEQ ID NO: 22023 - protein, 376 aa, Heteropogon contortus
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGEGEQTARGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTEAQIKDIIEWLTVCHGDSTGLSTDSLADAGYLGAVALGDAVCGMAVAYITPSDYLFWFRSHTAKEIKWGGAKHHPEDKDDGQRMHPRSSFKAFLEVVKSRSLPW

SEQ ID NO: 22024 - protein, 55 aa, Glycine max
  misc_feature (33)..(33): Xaa can be any naturally occurring amino acid
  unsure (1)..(55): unsure at all Xaa locations
KLFGEALERGTGFFKLISYYQTQSGPSYCGLHXLSFVVLNALAIEHGRNLKGMFL

SEQ ID NO: 22025 - protein, 195 aa, Thiobacillus denitrificans ATCC 25259
MRTAQVSRNTLETEITVSLNLDGSGTSRLATGVPFLDHMLDQIARHGLIDLDIAAKGDLHIDAHHTVEDTGITLGQAFAKALADKKGIRRYGHAYVPLDEALSRVVIDLSGRPGLEYHVDYTRARIGDFDVDLFLEFFRGFVNHAGVTLHIDNLRGINAHHQAETIFKAFGRALRMAVETDARLGDVTPSTKGAL

SEQ ID NO: 22026 - protein, 447 aa, Zea mays
MVASKAAPFDEVSSVEAGAYGGRDDDGRPRRTGTVWTASAHIITAVIGSGVLSLAWAIAQLGWAAGPAVMLLFAVVIYYTSTLLAECYRSGDPVAGKRNYTYMDAVRASLGGAKVRLCGAIQYANLFGVAIGYTIAASISMLAIKRADCFHAKGHKHACRSSSNPYMILFGVAEVVFSQIPDFDQIWWLSIVAAVMSFTYATIGLVLGIMQTVANGGFQGSLTGISIGAGVTPTEKDTVKAPPPSEAKVMKRATMVSVATTTVFYMLCGCMGYAAFGDAAPDNLLTGFGFYEPFWLLDIANVAIVVHLVGAYQVFCQPLFAFVEKWAAATWPDSAFIAREFRVGPFALSLFRLTWRTAFVCLTTVAAMLLPFFGDVVGLLGAVSFWPLTVYFPIEMYVVQRAVRRWSTHWICLQMLSAACLLVSVAAAAGSIADVIGALKVYRPFSG

SEQ ID NO: 22027 - protein, 385 aa, Ashbya gossypii ATCC 10895
MVNLNKVQPRSGGDHYLALGIEGSANKLGVGILKHPMLSQHKQGSLSHDCQAEILSNIRDTYITPPGEGFLPRDTARHHRNWVVRLVRRALVEAGIEDPRLLDVICFTKGPGMGAPLHSVVVAARTMSMLWDVPLVAVNHCIGHIEMGREITKAENPVVLYVSGGNTQVIAYSENRYRIFGETLDIAIGNCLDRFARTLKIPNDPSPGYNIEQLAKQCKNKDRLVELPYTVKGMDLSMSGILAHIDSLAKDLFRRNTKNYKLFDRETGKQLVTVEDLCYSLQEHLFAMLVEITERAMAHVNSNQVLIVGGVGCNVRLQQMMASMCQSRADGQVHATDERFCIDNGVMIAQAGLLQYRMGDIVKDFSETVVTQRFRTDEVYVSWRD

SEQ ID NO: 22028 - protein, 353 aa, Escherichia coli CFT073
MGLFVKIVAVALLHKHCRESFMKTLGEFIVEKQHEFSHATGELTALLSAIKLGAKIIHRDINKAGLVDILGASGAENVQGEVQQKLDLFANEKLKAALKARDIVAGIASEEEDEIVVFEGCEHAKYVVLMDPLDGSSNIDVNVSVGTIFSIYRRVTPVGTPVTEEDFLQPGNKQVAAGYVVYGSSTMLVYTTGCGVHAFTYDPSLGVFCLCQERMRFPEKGKTYSINEGNYIKFPNGVKKYIKFCQEEDKSTNRPYTSRYIGSLVADFHRNLLKGGIYLYPSTASHPDGKLRLLYECNPMAFLAEQAGGKASDGKERILDIIPETLHQRRSFFVGNDHMVEDVERFIREFPDA

SEQ ID NO: 22029 - protein, 378 aa, Haemophilus influenzae Rd KW20
MEIKQINSTIKSRAAVAFAPNQPLQIVEIDVEMPRKGEVLIRNTHTGVCHTDAFTLSGSDPEGVFPVVLGHEGAGVVVAVGEGVLSVKPGDHVIPLYTAECGECEFCRSGKTNLCVSVRDTQGKGLMPDCTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPAKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPQMVEDSMKGDIQLEPFVTHTMPLDKINEAFELMHEGKSIRTVIHY

SEQ ID NO: 22030 - protein, 449 aa, Haemophilus influenzae Rd KW20
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMAELYRHVGADTDVPAGDIGVGGREVGYLAGYMKKLSNQSACVFTGRGLSFGGSLIRPEATGYGLIYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 22031 - protein, 542 aa, Alteromonadales bacterium TW-7
MDQKRCAVASKESLKRIFTVPEAPDSTLSKIELEISSNLAGFLNENIAAIEKPLHEIEKDFQAAVIPENPTFVSAYAQDIMEQLVAHSVHTAAPSFIGHMTSALPHFLLPLSKLMVGLNQNLVKIETSKAFTPLERQVLGMMHHLAYGQNDAFYSKWMHSAKTSLGAFCSGGTVANITALWIARNRLLKADGEFTGIASQGIVAGMLHYGYRGLAVLISERGHYSLGKSVDLLGIGRDNLVGIKTTDDNKVDVNAMRDKARELESKGIKVMAIIGVAGTTETGNIDPLNEMADLAQEINCHFHVDAAWGGATLLSNTYRPLLNGIERADSITIDAHKQMYVPMGAGLVLFKDPAATDAIEHHAEYILRKGSKDLGSHTLEGSRPGMAMLVHACLRVIGRKGYEMLIDRSIKKAKYFADLIKADEDFELISEPELCLLTYRYVPKQIKQAIAEADEKTRIDIFASLNRFTASMQKRQRESGRSFVSRTRLTPAQYDNQPTVVFRVVLANPLTSGVILKEILAEQKELAKTDPVFKKYLSKYMK

SEQ ID NO: 22032 - protein, 510 aa, Mycoplasma mobile 163K
MKKTVILSVIDGLGLREEKQGNAFKLAKTPNFDKLFNEYPNSVIQASGDYVGLPDDQMGNSEVGHLNIGAGQIVYTGLSLINKDIKDNKFKQNAKFIAAFNAVKKNNETNTLHLMGLLSDGGVHSHEEHLFKLIEAAHENGLKNVSVHVFGDGRDVAPRSILTSIKKLEAITKKYNYAIGSIMGRFYAMDRDQIFTRNEQALEVMMGKTTNYFTNASEYIKAQYQKDISDEFFIPAINKDYLAKKLNLKDNDAVIFYNFRPDRARQLSHLLIQSNLYNYQSKNQVKLSNFTSMMKYEGLDTNIAYEEMKITNPLGNILAKNGLSQLRIAETQKYAHVTFFFDGGNDVLYENEERILIDSVKADSFADYPEMSAAGITDTLIANLGKYDVIILNYANPDMVGHTGNLKATIKALEFLDFQYGKILKAIEKTNHTLFITADHGNAEITEDENGNPATKHTTSPVMLIVTDKNLKLNSGTLANIAPTILDYLKIPKPKNMLDSLIMNNKRTSK

SEQ ID NO: 22033 - protein, 376 aa, Hyparrhenia hirta
ALSIAGAVQSQKLAVRAISRLQALPGGDVKLLCGTVVEHVRELTGYDRVMVYKFHEDEHGEVVAESKRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHSSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDNLADAGYLGAAVLGDAVCGMAVAYITPSDYLFWFRSHTAKEIKWGGAKHHPEDKDDGQRMHPRSSFKAFLEVVKSRSLPW

SEQ ID NO: 22034 - protein, 376 aa, Ischaemum afrum
  misc_feature (261)..(261): Xaa can be any naturally occurring amino acid
  unsure (1)..(376): unsure at all Xaa locations
ALSIAGAVQSQKLAVRAISRLQALPGGDVKLLCDTVVEHVRELTGYDRVMVYRFHEDEHGEVVAESRRDSLEPYLGLHYPATDIPQASRFLFRQNRVRMIADCHATPVRVVQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYXGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22035 - protein, 153 aa, Zea mays
  misc_feature (76)..(76): Xaa can be any naturally occurring amino acid
  misc_feature (86)..(86): Xaa can be any naturally occurring amino acid
  misc_feature (93)..(93): Xaa can be any naturally occurring amino acid
  misc_feature (98)..(98): Xaa can be any naturally occurring amino acid
  misc_feature (146)..(146): Xaa can be any naturally occurring amino acid
  unsure (1)..(153): unsure at all Xaa locations
MAPLGDGGAAAAAASNNLVVSFGEMLIDFVPDVAGLSLAESGGFVKAPGGAPANVACAIAKLGGSSAFVGQFCDDXFGCMLTNILXAYYCDSXGCLFXQHARTRLAFVTLKYDGEREFTVYRNPSADMLLTDGKLALCLERRASVXHYGCISL

SEQ ID NO: 22036 - protein, 308 aa, Xanthomonas axonopodis pv. citri str. 306
MSLDPALRSRIDTLLQSSRVVLFMKGQPGMPQCGFSAKAVGVLDGLGIDYAHVNVLADQEIREGIKAYGDWPTIPQLYVDGELIGGSDIIVQMADSGELSSMLGLQAPDRSPPKITITPAAVEMLKGALADAPDASLTLAIDANFQPNFQLAPTNPNAIAAESNGLRVQFDLASARRADGITIDWVDDIRGRGLAIDNPNAPKPVQELSVRDADDRLKAGSLTLVDVRPADERALATVAAPFRTLDAHERAAIEQLPKDTPLAFLCHRGGRSLQAAEHFRGLGFTNVYNVTGGIDAWSDEVDNGVAKY

SEQ ID NO: 22037 - protein, 1175 aa, Nostoc punctiforme PCC 73102
MTQVQKQKRKRGLILTLEGLQKLQSGKIALEDRENYGNRYTLEDLSERVKVNTVTVSKVLSRGEGVDKKTLELFFQAFNLELDKADFTNSDKSRHLDWGEAIGGSVFYGRTEEIATLEQWILKERCQIVAILGMGGIGKTSLSVKLVEQIKENFEYIIWRSLQDAPPLNTLLASLIQFLSDERETEAILPESTAPRLTRLLHYLREHRCLLILDNMESILRSGSRAGLYRDGYEGYSELLKRLGETEQQSCLILTSREKPKEVASMEGGGLCVRSFLLKGLLANDGQEILKIKGISASDDELRTLVARYGGNALALKVVATTIQDLFGGNVSEFLKQDAVVFGDIWDILEQQFERLSNLEKEIMYWLAINHEPVSLSELQKDIISALTFQKFLEVLESLVRRSLVEKSEALFTLQPVVMEYVINRLVEQVCQEISTHNIEIFRCHALVKATTKDYVRESQIHLILKPVIEGLFAIFRSQRTLENHLIQILTTLRETSPLEQSYTAGNIINLLCYLGTDLSGSDFSHLTIWQADLRNVNLQNASFVNANLAKCVFAETIGGIHAVAFSPDGKLLATGDTNGEVRLYQVADGKQLFICKGHTGFIWPVTFSPDGHLLASGSDDQTVKLWDTSTGQCLATFQGHSAGIWSVSFSSDGQTLASSSEDTTVKLWDTSTGQCIQTLQGHSSRVWSVAFSPDGTILASGNDDSSIRLWDISTSQCIKTLVGHTHRVQSVAFSPDGDKLISGCHDRTVRLWDINTSECLYTFQSHTDLVNSVAFSSDGDRLASGSDDQTVKLWDVNTGLCLKTLKGHGSRVWSVAFSPDGKMLASGSDDQTVRLWDVNTGGCLKTLQGYCNGIWSVTFSSNGQILASGNNDQTVKLWDTSTGLCLKTLRGHSNRVTSVSLSQDGNLLASGSEDQTVKLWNANTGQCLKTLGGHSNRIISVAFSPDGKILATGSDDQSIKLWDVNTGKCLKTLQGHTQRIWSVAFSPDGQTLASGCHDQTVRLWDVCIGSCIQVLEGHTDWIWSVVFSPDGMTLASSSGDQTVKLWDISTGKCLRTLQGHTNCVYSSAISIDGCILASGSGDQTIKLWDLSTNKEIKTLSGHNKWVWSVAFNPQGKILASGSEDETIRLWDIETGECLKTLRCERPYEGMNITGVTDLTEATIATLKVLGACNF

SEQ ID NO: 22038 - protein, 607 aa, Glechoma hederacea
SGKPFYAIIHRVTGSLIIDFEPVKPHEVPMTAAGALQSYKLAAKAITRLQALPSGSIERLCDTMSQEVFELTGYDRVMIYKFHEDDHGEVFTEIRKPGLEPYVGLHYPATDIPQAARFLFMKNKVRMICDCRANHVKVVQDENLPLELTLCGSTLRAPHSCHLQYMENMNSIASLVMSIVVNEGEEEGSDSTHPDKRKRLWGLVVCHHTSPRFVPFPLRYACEFLTQVFAIHVNKELELENQMLEKNILRTQTLLCDMLLRDAPLGIVSQSPNVMDLVKCDGAALLYKNKKYRLGMTPGDFQIRDVVSWLDEYHRDSTGLSTDSLYDAGFPGALALGDAVCGMAAVKITDKDWLFWFRSHTAAEVRWGGAKHEPDEKDDGRKMHPRSSFKAFLEVVKTRSLPWKDYEMDAIHSLQLILRNSYKEDEDTDTYAKAIHTRLSDLQIEGIQELEAVTSEMVRLIETASVPILAVDVDGMVNGWYTKIADLTGLPVDKAIGCHFLSLVEESSADAVSSMLELALKGEEERNVQFEIKTHGERSESGPISLVVNACASRDIKESVVGVCFIAQDITAQKSMMDKFTRIEGDYKAIVQNPNPLIPPIFGTDEF

SEQ ID NO: 22039 - protein, 488 aa, Bacillus cereus G9241
MNSATNQTTSQTETTKGKGELRRGLKSRHLTMISLGGTIGTGLFLASGGVIHSAGPGGALIAYAAIGIMVYFLMTSLAELAAYMPVTGSFSTYATKFVDPSLGFALGWNYWYNWAITIAAELAAVTLIMKFWFPDTPSLIWSGLCLAIIFLLNYLSVKGFGESEYWFALIKVVTIIIFLIVGFMMIFGIMGGETVGFKNFTVADAPFNGGIMAIIGVFMAAGFSFQGTELLGVAAGETSDPERNIPKAIRSIFWRILLFYILAILVIGLLIPYTTESLAASDVTVSPFTLIFEKAGVAFAASVMNAVILTAVLSAGNSGMYASTRMLWDLARQGKAPKFLGKLDSRGVPVNALIVTSIVGSIAFIASLFGDGVVYIWLLNASGMSGFIAWVGIAISHYRFRKAYIAQGKDLNDLPYRAKWFPFGPIFAFALCIIVILGQNYGAFMGESIDWNGVLVSYIGLPLFLVLWLGYKFTKKTKVIPLDKCELK

SEQ ID NO: 22040 - protein, 617 aa, Hyobanche atropurpurea
SGKPFYAIAHRVTGSLVIDFEPVKPQEVPMTAAGALQSYKLAARAIARLQALPSGSLERLCETMAQEVFELTGYDRVMVYRFHDDDHGEVFAEITRPGLEPYVGLHYPATDIPQAARFLFLKSKVRMICDCRAAHVKVVQDEGLSSDLTLCGSTLRAPHSCHLCYMENMNSIASLVMSVIVNEGTDEESSTSSSSHPDKRKRLWGLVVCHHTSPRFVPFPLRYACEFLSQVFAIHVSKELELLNQTLEKNILKTQTVLCDMLLRGNPLAVVTQSPTVMDLIKCDGAVLLYKGKKHRLGVTPSDPHIWDIVLWLDEYHRDSTGTSTDSLLDAGFPGAVALGDAFCGMAAVRITGHDWLFWFRSHTEAEVRWGGAKHEMGGEDDDRKMHPRSSFKAFLEVVKARSVPWRDFEMDAIHSLQLILRNACEKEEEEEERRRKDMVVAGEIQARLNKLHIDGARDMEAVTSEMVRLIETALVPILAIGVDGLVNGWNAKIADLTGLPVDGAIGRHFLALVGEASADTFSRMLELALQGQEERNVQFEIKTHGPRTDFGPISLVVNACASRDVKDNVVGVCFIAQDVTTVRSMMDKFTRIEGNYRALVQNPNPLIPPIFGSDEF

SEQ ID NO: 22041 - protein, 455 aa, Deinococcus radiodurans R1
MPSPRFASLRNMTLSETHPTARSEALFVRARAVTPGGVNSPVRAFRSVGGVPRFIASAQGAYLTDADGARYLDYIGSWGPMILGHNHPAVRDAVAQALASGTSFGAPNEREVELAELIVELTGAERVRFVSSGTEATMSALRLARGYTGRKFIVKFRGNYHGHADGLLVEAGSGLLTNAEGDLGAAAPSSAGVPEEYAGLTLVLDYNDPEALDALMAQRGDEIAAVIFEPVVGNAGVLIPTSDFLAALHRVRDFGAVLIADEVMTGFRLSLNGATGLLSLDPDLRCWGKIVGGGLPVGAYGGRADIMDFVSPQGPVYQAGTLSGNPLAMAAGIATLRELKANPGLYRQLDEYAARLAAGLRGAAERAGVAVSINHIGSMLTVFFQDAPDGSVRDYAAAARSDTAAFAAWFQGLLARGIYWAPSQFESIFISAAHGEPELAATLEAAAQAFEGVKP

SEQ ID NO: 22042 - protein, 186 aa, Pyrobaculum aerophilum str. IM2
MPYVRKTLETEVAVELRRGGDLAVETPIPFLTHMLETLLKYAGLGGVVKAVELRKLDDGHHVIEDVAIAVGRALDALLEDRRGIARFGHAVVPMDESIVMAAVDLGGRAYWVVRAKLPDVTIGGYPLRMFPHFVRTLAVEAKATIHIYARGTDPHHKVEAAHKALGLALRQALSPGEGLSTKGVLG

SEQ ID NO: 22043 - protein, 434 aa, Medicago truncatula
MVNTSEENNSNAVMPRKFQGGMNQVGRGGGRIVGQNRRALGGINQNFVHDRPYPCVVHKRVLSEKHEICEKKQADLGHRPITRRFAAQIAGSQQSYAEKTKNSNPLNSNEFGNSIAVDDELKSPEDQPEPMTLEHTEPMHSDPLEMEEVEMEDIEGEMILDIDSCDANNSLAVVEYIEDLHAYYRKIEYLGCVSPAYMDEQLDLNERMRAILVDWLIEVHDKFDLMQETLFLTVNLIDRFLAKQNVVRKKLQLVGLVAMLLACKYEEVSVPVVSDLIHIADRAYTRKDILEMEKSMLNTLQYNMSLPTAYVFMRRFLKAAQADKKLELVAFFLVELSLVEYEMLKFPPSLVAAAAVYTAQCTVSGFKHWNKTCEWHTNYSEDQLLECSMLMVGFHQKAGAGKLTGVHRKYGSAKFSFTAKCEPACFLLENKNQP

SEQ ID NO: 22044 - protein, 557 aa, Candida glabrata CBS 138
MSSLSRIVNLKKSSKLAKGALRVGSRGLHMRPMARLGSSTLLLRELNLALVSGGLMYLTYSYFSEKRNPLEVFKAFKEYSTIHNDGGKLISSSGGSQNSNADFKILSQEEVDRRLRAREQSFFVKRNKGLVRYDVAQLPSNNPIEDNHVEKLITFPSPDGSKPLKDREDEAFDNDLYFFGIFDGHSGAFTSAKLSTDLVPYVAHQIADVYQQHNKALTSDYTHNMNFDVALEKGFVQLDNDIVYHSLGKLLKEPTNDNMLAALPAISGSCALLAVYNSYESTVKVAVTGDSRALIGGLDSNGEWYVKSLSTDQTGDNLEEVQRIRSEHPGEDNVVRNGRVLGSLQPSRAFGDYRYKVKEIDGKKLSDLPDHLKLYFRKEPRDFKTPPYVTAKPVVTTAKVNDNTKFMVLASDGLFELLSNTEIAALVVKWMEKHSDDTKVKSLSFKKQLPKVKDLSTDSESQRPAFRYRKDQSLENMSYFLEDANVATHLIRNALSAGGQNEYVSTLVSIPAPMSRKYRDDLTVTVAFFGENNSSVVPDTQTILPNLDATTPVQSKL

SEQ ID NO: 22045 - protein, 90 aa, Medicago truncatula
MCPLRFILVFFSAVLAGYFAWRTVRSSPNIDLACDDSIEEEKSPFKKEDFDFKKMIQNGFWVFVDMASGRYLWRNLRQTNKDEELKSSKN

SEQ ID NO: 22046 - protein, 564 aa, Arabidopsis thaliana
MGYEKFTWVIKNFSSLQSEYIKSDIFVIGGCKWCLLAYPNGKQNASYLSLYLDGPTLKTLPCGCRRRIRFRLTVVNQLSENLSRRGEGKRWFDKKLPLCGYEEVLLLTKLNAKHGGFLVNNEVKIVAEVDVLEVIGKLDVSKESQEVIKPRKRMRLYGDGGAVSSHLHKETSSVDVNGFQVLPSQAESVKRIFERHPYMALEFRAKNQQLRASCINVLLSLIKTLCQSLQDISIDDLGQTEQVLTFLQNSGFKVDWLERKLEEVKEKKIQEHIGKSRMQGLEEDLKVFKKKCSDIEALLEKEKEELKGLKQKCSDIEALLEKEKGKVLAAAARTPLTLDRMNILIGYREMISLTKLNAKKGGFLVNNKVKIVVEVDVLQVVGGLDVSQEVTQPLKRIRLNDDGAASTHLQTIDVNGFLVLASQVESVKRIFESHPEMTLTFRANNQQLRTSCINVLLNLIETMCMSPQNLSIADLGQTEQALTYLKNSGFKVDWLERKLEEVTEKKIQEHIGKSRMQGLEEDLKEELKDLKQKCSDTEALLEKEKTKVLAAARAPPLTLDDVVS

SEQ ID NO: 22047 - protein, 197 aa, Yersinia pseudotuberculosis
SSIGGWKGINESDMVLMPDASTAVMDPFFADSTLIIRCDILEPGTMQGYDRDPRSISKRAEDFLKSSGIADTVLFGPEPEFFLFDDIRFGSSINGSHVSIDDVEGAWNSSTKYEGGNKGHRPAVKGGYFPVPPVDSAQDLRSAMCLTMEEMGLVVEAHHHEVATAGQNEVATRFNTMTKKADEIQIYKYVVHNVAHA

SEQ ID NO: 22048 - protein, 152 aa, Escherichia coli CFT073
MRLVIKVWLPIMSQTFYRCNKGEIMSKTIATENAPAAIGPYVQGVDLGNMIITSGQIPVNPKTGEVPADVAAQARQSLDNVKAIVEAAGLKVGDIVKTTVFVKDLNDFATVNATYEAFFTEHNATFPARSCVEVARLPKDVKIEIEAIAVRR

SEQ ID NO: 22049 - protein, 69 aa, Glycine max
MASSMISSPAVTTVNRAGAGMVAPFTGLKSMAGFPTRKTNNDITSLASNGGRVQCIQVSSEARCLRGSQ

SEQ ID NO: 22050 - protein, 393 aa, Idiomarina loihiensis L2TR
MSVIAMTDLDLSNKRVLIREDLNVPVKNGKVTSDARLKAALPSIQQALKAGAKVMVMSHLGRPTEGEYDEEFSLQPVVDYLQEVLDCPVRLCKDYLDGIELKAGELVVFENVRFNVGEKKNNDELAKKLASLCDVYVMDAFGTAHRAQASTHGVAKYAPVACAGPLLAGELEALGKALENPKRPLVAIVGGSKVSTKLTVLESLSGVVDQLIVGGGIANTFVAAAGHNVGKSLYEADLTDEANRLMAQAKAKGGDIPLPVDVVTGKEFSAEAKAETKAVNAVADDDMIFDIGPDTAEQLAAMLKNAGTIVWNGPVGVFEFEQFGHGTKTIAEAIAQSDAFSIAGGGDTLAAIDQYAIADKISYISTGGGAFLEFLEGKTLPAVAILQERANDA

SEQ ID NO: 22051 - protein, 666 aa, Idiomarina loihiensis L2TR
MSERQYLANAIRALSMDAVQKAKSGHPGAPMGMADIAEVLWRDYLKHNPHNPGWADRDRFVLSNGHGSMLIYSLLHLSGYDLSIEDIKQFRQLDSKTPGHPEYGYTPGIETTTGPLGQGLANAVGMALAEKVLAAQFNRDNHEIVDHHTYTFLGDGCLMEGISHEVCSLAGTLGLGKLIAFYDDNGISIDGEVEGWFTDDTAKRFESYGWHVINKVDGHDSAAITRAIDEARANDDKPTLIICKTVIGYGAPNKQGSESCHGAPLGDDEIVAARKQLNWPHQAFEVPADVYQKWSAVDKGAAVESSWNKRWVAYEQEYPQLAKELKRRLNGELPEGFENTVHNYAKQLQSSPEAVATRKASLNVLNEFGPKLPELLGGSADLAGSNLTLWNDAKGITADDASGNYVFYGVREFGMSAIMNGVTLHGGFKAYGATFLMFMEYARNAVRMSALMKQPSIFVYTHDSIGLGEDGPTHQPVEQLANLRQTPNLQCWRPCDQVETAVAWGAAVQSSKTPSALVFSRQGMQQQERNDDQLTNIARGGYVLKDSDGEPDVILIATGSEVDLAVNAFEQLTEEGHKVRVVSMPSTNVFDIQDAEYKESVLPSSVTRRVAVEAGIADFWYKYVGLNGEVVGMTTFGESAPAGDLYKHFGITTENTVAAAKRLLGA

SEQ ID NO: 22052 - protein, 181 aa, Mycoplasma mobile 163K
MLKFIKSSTKESEWLKNPKNEICFVGRSNVGKSSLINALFKTRVVKVGKTPGKTKLINFFEDERGNSVVDLPGYGYAKLSKEAQSEISDMIFEFLTKRVEIKKLFLLIDSRLGFTPIDQEFYDFLKEAPFEIIIVATKRDKLNQSQTYQIKKSLDELKVKYFLVSITKKEFLQDLVNNLFN

SEQ ID NO: 22053 - protein, 521 aa, Desulfitobacterium hafniense Y51
MRVVSAQQMRELEERAIRDFGIPSLLLMENAALAVIQEVRQMLEDRHIQLSAGRATVFVGKGNNGGDGLAVARHLLILGMDITVYSFARAEEFKGDAALNYRLYQNTGGKLFTIEGEKQRRLVRISLAQADVIIDAIYGTGFRGALPSLIDEYVEEINRAQVPVVAVDIPSGVEADTGKVYRKAIMADATVTFGLPKLGHFLGVGPAYAGRVSVDPISIPERFLDDEKLTTSILTEDVCQYLPIRSLQGHKGTHGRGVLVAGSEGMTGAALLAGKAALRSGIGLLQMVVPRGLAEGIDLALTEATVWGAESEKALNGNAWPVIYERAEKAQALAIGPGLGQEPELLLVIEEVLRNLPLPVILDADALNVLAKEPGILGWRQGRGPLILTPHPGEMARLCGCTTEEVQANRLELAISKAVEWESIIVLKGAITIIAAPDGRAFLNPTGNPGLGTGGTGDVLTGSILAWLAQGVEPLAAACLGVYLHGKAADQLTGEFGLSGYTAGEVADQLPKARRSLENNH

SEQ ID NO: 22054 - protein, 184 aa, Brassica napus
  misc_feature (99)..(99): Xaa can be any naturally occurring amino acid
  unsure (1)..(184): unsure at all Xaa locations
MATTTATSDAGEGPVMALINKRLRALRKKLNRIAQMEESISQGKTLNKEQQEVLRSKPSVLVLIEELDKLRNPLSNAVSEEIALATTHHNAPSSDQNTXVAVAPEEKEKEKEVEKLEDLVNLLYFGSLFDVKSQNELASIMMTRTHERGCCLVYDTVTDESTADLLCDKDLDLISRLWSMMVSR

SEQ ID NO: 22055 - protein, 462 aa, Arabidopsis thaliana
MASNGVDEQIKLVEGPAGYVLEDVPHLSDYILDLPTYPNPLQSNAAYSVVRQYFVDEDDTVQEKIVVHKDSPRGTHFRRAGPRQKVYFKPSDVRACIVTCGGLCPGLNTVIREIVCGLHFMYGVTEVIGVDCGFRGFYSKNTVALTPKTVSDIHKRGGTILGTSRGGHDTSKIVDNIQDREINQVYIIGGDGTQKGANAIYKEIRRRGLKVAVAGIPKTIDNDIPVIDKSFGFDTAVEEAQRAINAAHVEATSVENGIGIVKLMGRYSGFIAMYATLASRDVDCCLIPESPFYLEGKGGLYEFIAKRLRENGHMVIVIAEGAGQDLVAESIEQQDASGNKLLKDVGLWMSLKIKEYFAKHNVMDITLKYIDPTYMIRAIPANASDNVYSTLLAQSAVHGAMAGYTGFVSGLVNGRHTYIPFNRITERQNKVVITDRMWARMLSSTNQPSFMNPPKGTTEFTD

SEQ ID NO: 22056 - protein, 440 aa, Chlamydophila pneumoniae J138
MLNCSNQKHTVTFEEACQVFPGGVNSPVRACRSVGVTPPIVSSAQGDIFLDTHGREFIDFCGGWGALIHGHSHPKIVKAIQKTALKGTSYGLTSEEEILFATMLLSSLKLKEHKIRFVSSGTEATMTAVRLARGITNRSIIIKFIGGYHGHADTLLGGISTTEETIDNLTSLIHTPSPHSLLISLPYNNSQILHHVMEALGPQVAGIIFEPICANMGIVLPKAEFLDDIIELCKRFGSLSIMDEVVTGFRVAFQGAKDIFNLSPDITIYGKILGGGLPAAALVGHRSILDHLMPEGTIFQAGTMSGNFLAMATGHAAIQLCQSEGFYDHLSQLEALFYSPIEEEIRSQGFPVSLVHQGTMFSLFFTESAPTNFDEAKNSDVEKFQTFYSEVFDNGVYLSPSPLEANFISSAHTEENLTYAQNIIIDSLIKIFDSSAQRFF

SEQ ID NO: 22057 - protein, 395 aa, Musa acuminata
MALQASFLPSALSARKEGKVACTVKESAFLGSSILEHHKSHPVLRTKRESNHSVGVVKAQTTAVAAPGLNQSAVHGKKVLRKGVVVITGASSGLGLAAAKALAETEKWHVVMACRDFLKAEKAAQSAGMAKENYSIMHLDLASLDSVRQFVHAFRQSGRPLDVLVCNAAIYRPTARTPTYTADGYEMSVGVNHLGHFLLANMLLEDLKKSDYPSRRLIILGSITGNTNTLAGNVPPKAGLGDLRGLAGGLDGRNSSAMIDGGAFDGAKAYKDSKICNMLTMQELHRRFHEDTGITFASLYPGCIATTGLFREHIPLFRLLFPPFQKFITKGFVSEDESGQRLAQVVGDPSLLKSGVYWSWNNNSASFENQLSEEASDAVKAQKLWEISEKLVGLA

SEQ ID NO: 22058 - protein, 376 aa, Tripsacum dactyloides
ALSIAGAVQSQKLAVRAISRLQALPGGDVKLLCDTVVEHVRELTGYDRVMVYRFHEDEHGEVVAESRRDNLEPYLGLHYPATDIPQASRFLFRQNRVRMIADCHATPVRVIQDPGLSQPLCLVGSTLRAPHGCHAQYMANMGSIASLVMAVIISSGGDDEQTGRGGISSAMKLWGLVVCHHTSPRCIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYLGAAALGDAVCGMAVAYITPSDYLFWFRSHTAKEIKWGGAKHHPEDKDDGQRMHPRSSFKAFLEVVKSRSLPW

SEQ ID NO: 22059 - protein, 376 aa, Tristachya superba
ALSIAGAVQSQKLAVRAISRLQALPGGDVKLLCDTVVEHVRELTGYDRVMVYRFHEDEHGEVVAECRRDNLEPYLGLHYPATDIPQASRFLSRQNRVRMIADCHATPVRVIQDPGLSQPLCLVGSTLRAPHGCHAQYMANMGSIASLVMAVIISSGGDDEQTARGGISSSMKLWGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYHGATALGDAVCGMAVTYITPSDYLFWFRSHTAKEIKWGGAKHHPEDKDDGQRMHPRSSFKAFLEVVKSRSLPW

SEQ ID NO: 22060 - protein, 376 aa, Urochloa mutica
ALSIAGAVQSQKLAVRAISRLQALPGGDVKLLCDTVVEHVRELTGYDRVMVYRFHEDEHGEVVAECRRDNLEPYLGLHYPATDIPQASRFLFRQNRVRMIADCHATPVRVIQDPGLSQPLCLVGSTLRAPHGCHAQYMANMGSIASLVMAVIISSGGDDEQTARGGISSSMKLWGLVVCHHTSPRFIPFPLRYACEFLMQAFGLQLNMELQLAHQLSEKHILRTQTLLCDMLLRDSPTGIVTQSPSIMDLVKCDGAALYYHGKYYPLGVTPTESQIKDIIEWLTVCHGDSTGLSTDSLADAGYHGATALGDAVCGMAVAYITPSDYLFWFRSHTAKEIKWGGAKHHPEDKDDGQRMHPRSSFKAFLEVVKSRSLPW

SEQ ID NO: 22061 - protein, 596 aa, Hyobanche glabrata
PYEVPMTAAGALQSYKLAAKGIARLQAMPSGSLERLCETMAQEVFELTGYDRVMVYRFHDDNHGEVFTEITRPGLEPYAGLHYPATDIPQAARFLFMKNKVRMICDCRAAHVKVVQEESLSSDLTLCGSTLRAPHSCHLRYMENMNSIASLVMSVVVNEGTDEESSASSSSSSSSSHPYRRKQLWGLVVCHHTSPRFVPFPLRYACEFLSQVFAIHISKELELLNQTLEKNILKTQTVLCDMLLRGNPLSIVTRSPTVMDLVKCDGAVLLYKGKNHRLGLAPSDLQIRDIVSWLDEYHRDSTGTSTGSLLDAGFPGAGLLGNAFCGMAAVRITGRDWLFWFRSHTAAEVRWGGAKHEKGDEDDGRRMHPRSSFKAFLEVVKARSVQWRDFEMDAIHSLQLILRNACEKEEEEDRRKDMVVAREIQARLNELHIDGAKEMETVTSEMVRLIETASVPILAVGVDGLVNGWNTKIADLTGLPVDGAIGRHFLALVEEASVDVVRRMLELALQGQEEQNVQFEIKTHGPRTESNPISLIVNPCASRDVKDNVVGVCFIAQDVTTERSMIDKFTRIEGDYQAIVQNPNPLIPPFFGSDEF

SEQ ID NO: 22062 - protein, 618 aa, Hyobanche rubra
SGKPFYAIAHRVTGSLVIDFEPVKPQEVPMTAAGALQSYKLAAKAIARLQALPSGSLERLCETMAQEVFELTGYDRVMVYRFHDDDHGEVFAEITRPGLEPYVGLHYPATDIPQAARFLFLKNKVRMICDCRAAHVKVVQDEGLSSDLTLCGSILRAPHSCHLCYMENMNSIASLVMSVIVNEGTDEESSTSSSSHPDKRKRLWGLVVCHHTSPRFVPFPLRYACEFLSQVFAIHVSKELELLNQTLEKNILKTQTVLCDMLLRGNPLAVVTQSPTVMDLIKCDGAVLLYKGKKHRLGVTPSDPHIWDIVLWLDEYHRDSTGTSTDSLLDAGFPGAVALGDAFCGMAAVRITGHDWLFWFRSHTEAEVQWGGAKHEMGGEDDDRKMHPRSSFKAFLEVVKARSVPWRDFEMDAIHSLQLILRNAYEKEEEEEEERRRKDMVVAGEIQARLNELHIDGARDMEAVTSEMVRLIETALVPILAIGVDGLVNGWNAKIADLTGLPVDGAIGKHFLALVEEASADTFSRMLELALQGQEERNVQFEIKTHGPRTDFGPISLVVNACASRDVKDNVVGVCFIAQDVTTVRSMMDKFTRIEGNYRAIVQNPNPLIPPIFGSDEF

SEQ ID NO: 22063 - protein, 594 aa, Hyobanche sanguinea
PYEVPMTAAGALQSYKLAAKGIARLQAMPSGSLERLCETMAQEVFELTGYDRVMVYRFHDDNHGEVFTEITRPGLEPYAGLHYPATDIPQAARFLFMKNKVRMICDCRAAHVKVVQEESLSSDLTLCGSTLRAPHSCHLRYMENMNSIASLVMSVVVNEGTDEESSASSSSSSSHPYRRKQLWGLVVCHHTSPRFVPFPLRYACEFLSQVFAIHISKELELLNQTLEKNILKTQTVLCDMLLRGNPLSIVTRSPTVMDLVKCDGAVLLYKGKNHRLGLAPSDLQIRDIVSWLDEYHRDSTGTSTDSLLDAGFPGAGLLGNAFCGMAAVRITGRDWLFWFRSHTAAEVRWGGAKHEKGDEDDGRRMHPRSSFKAFLEVVKARSMQWRDFEMDAIHSLQLILRNACEKEEEEDRRKDMVVAREIQARLNELHIDGAKEMETVTSEMVRLIETASVPILAVGVDGLVNGWNTKIADLTGLPVDGAIGRHFLALVEEASVDVVRRMLELALQGQEEQNVQFEIKTHGPRTESNPISLIVNPCASRDVKDNVVGVCFIAQDVTTERSMIDKFTRIEGDYQAIVQNPNPLIPPFFGSDEF

SEQ ID NO: 22064 - protein, 484 aa, Ralstonia eutropha JMP134
MKQFRNFINGEFVATNKTFENRAPVDNRVIGRVHEAGQAEVDAAVAAARAALHGDWGRMPVARRVELLHAVADEINRRFDDFLEAELADTGKPRSLAAHIDIPRGAANFKVFADIVKNAPTESFEMTTPDGGTAISYALRAPLGVVAVVCPWNLPLLLMTWKVGPALACGNTVIVKPSEETPATATLLGEVMEKVGVPKGVYNVLHGFGPGSAGEFLTRHPGVNGITFTGETRTGEAIMAAAAKGVRPVSFELGGKNAGIVFADADFDKAVAGIARSAFENCGQVCLGTERVYVQRPIFDRFVQALKEKAESLRIGPSDAPGVGLGPLISAEHKAKVMSYYDVARSEGATVVTGGGAPSMPPELAEGHWVQPTIWTGLPESARVIREEIFGPCCHIAPFDTEEEAIALANATDYGLATTVWTQDLGTAHRMARAIDVGLCWINSWFLRDLRTAFGGAKASGIGREGGVHSLEFYTELRNVMVKL

SEQ ID NO: 22065 - protein, 608 aa, Lamium purpureum
SGKPFYAIIHRVTGSLIIDFEPVKPHEVPMTAAGALQSYKLAAKAINRLQSLPSGSIERLCDTMVQEVFELTGYDRVMVYKFHEDDHGEVFTEITKPGLEPYVGLHYPATDIPQAARFLFMKNKVRMICDCRATHVKVIQDGNLPIDLTLCGSTLRAPHSCHLQYMENMNSIASLVMSVVVNEGDEEGSGSDSPPEKRKRLWGLVVCHHTTPRFVPFPLRYACEFLAQVFAIHVNKEFELESQMLEKNILRTQTLLCDMLLRDAPLGIVSQSPNVMDLVKCDGAALLYKGKKYRLGMTPTDFQIRDVVSWLDEYHRDSTGLSTDSLYDAGFPGALALGDAICGMAAVKITDKDWLFWFRSHTASEVRWGGAKHEPGEKDDGRKMHPRSSFKAFLEVVKTRSIPWKDYEMDAIHSLQLILRNAFKESGGTDVEARAIHMKLSDLQIDGIQELEAVTSEMVRLIETASVPILAVDVDGLVNGWNTKIADLTGLSVDKAIGRHFLDLVEDSSAHTVNQMLKLALEGNEEHNVQFELKNHGEMTEAGPISLVVNACASRDVKESVVGVCFIAQDITAQKSMMDKFTRIEGDYRAIVQNPNPLIPPIFGTDEF

SEQ ID NO: 22066 - protein, 114 aa, Blastopirellula marina DSM 3645
MSEKTIFKRIIDGEIPADIVYEDDLCLAFRDIAPKAPTHVLVIPKKEIATLDDVTDEDAALMGHLWIVVRDVARKLHLDKGYRVVVNCKEEGGQEVPHVHLHLMGGRKLTWPPG

SEQ ID NO: 22067 - protein, 329 aa, Prochlorococcus marinus str. NATL1A
MKGTLLFNALREAIDEEMGRDPLVCVMGEDVGQYGGSYKVTKDLYEKYGEFRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLTEELPEGDYVCALDQADLVKQGSDITILTYSRMRHHCLKAVELLEAKGIDVELIDLISLKPFDMNTISESIKKTHRVIIVEECMKTGGIAAELMSLITENCFDDLDSPPVRLSSQDIPTPYNGNLENLTIIQPHQIVDAAEKIIKNGGLD

SEQ ID NO: 22068 - protein, 329 aa, Arabidopsis thaliana
MENHTTMKVSSLNCIDLANDDLNHSVVSLKQACLDCGFFYVINHGISEEFMDDVFEQSKKLFALPLEEKMKVLRNEKHRGYTPVLDELLDPKNQINGDHKEGYYIGIEVPKDDPHWDKPFYGPNPWPDADVLPGWRETMEKYHQEALRVSMAIARLLALALDLDVGYFDRTEMLGKPIATMRLLRYQGISDPSKGIYACGAHSDFGMMTLLATDGVMGLQICKDKNAMPQKWEYVPPIKGAFIVNLGDMLERWSNGFFKSTLHRVLGNGQERYSIPFFVEPNHDCLVECLPTCKSESELPKYPPIKCSTYLTQRYEETHANLSIYHQQT

SEQ ID NO: 22069 - protein, 401 aa, Arabidopsis thaliana
  misc_feature (180)..(180): Xaa can be any naturally occurring amino acid
  misc_feature (216)..(216): Xaa can be any naturally occurring amino acid
  unsure (1)..(401): unsure at all Xaa locations
MASATFSVAKPSLQGFSEFSGLRNSSALPFAKRSSSDEFVSFVSFQTSAMRSNGGYRKGVTEAKIKVAINGFGRIGRNFLRCWHGRKDSPLDVVVINDTGGVKQASHLLKYDSTLGIFDADVKPSGDSALSVDGKIIKIVSDRNPSNLPWGELGIDLVIEGTGVFVDRDGAGKHLQAGAXKKVLITAPGKGDIPTYVVGVNAELYSHEDTIISNAXSCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDAAEKELKGILDVCDEPLVSVDFRCSDVSSTIDSSLTMVMGDDMVKVIAWYDNEWGYSQRVVDLADIVANNWK

SEQ ID NO: 22070 - protein, 1310 aa, Petunia x hybrida
MESETQTIAYRQPSMLQRILSASMPMLLIAIGYVDPGKWAAMVDGGARFGFDLIMLALLFNFAAILCQYLSACIALVTDQDLAQICSEEYGKVTCIFLGIQAEVSMIALDLTMVLGTAHGLNVVFGVDLFSCVFLAATGAILFPLLASLLDNGSAKFICIGWASSILLSYVFGVVISQPESPFSIGGMLNKFSGESAFALMSLLGASIMPHNFYLHSSIVQQGKESTNLSRGALCQDHFFAIVFVFSGIFLVNYAIMNSAANVSFSTGLLLLTFQDSLSLLDQVFRSSVAPFSIMLVTFISNQITPLTWDLGRQAVVHDLFGMDIPGWLHHVTIRVISVVPALYCVWNSGAEGLYQLLIVTQVVVALVLPSSVIPLFRVASSRSIMGIHKISQLMEFLSLGTFIGLLGLKIIFVIEMIFGNSDWVNNLKWSIGSGVSTPYVFLLIAASLSLCLMLWLAVTPLKSASSRFDAQAFLQTPMPESYREHNQVDVSDTTFGLERSTQKQEPAFHVEKSLGSHPDLSTSDPDEILPESLLDFEKVHHLTTIDESKSETTFSTPSFSCPEVSASAGETAKSVLNEVSGGESVDTRDFNAASVDVVEKTLRIEGDTPTDKDDDGDSWEPDDVPKDVSENTQSYTSDGPESFKSLSVRSEDTGSGTGSLSRLAGLGRAARRQLTVVLDEFWGQLFDYHGMPTSQAKFKKLDVILGLDTKVDPKPAPVSLKLENSRGDSNAYIPSGSARVPESWINSNIYSPKQQCASGALDSGYRVPKEPASWSSHMKLLDAYVQSSSGNTLDSGERRYSSMRIPASSAGYDQQPATVHGYQISAYLSQIAKGRGSDYLNGQLESASPRSVSSLTSNHAEPLARALGQKPQSGVSSRAPPGFGSVPARNNSMQPVNTSTDLSSTENAESVAGSANSKKYYSLPDISGRYVPRQDSSLPDGRAQWYNSMGYGQSIGRSAYEQPYMTGPMRAGGPPRFEHSPSKVCRDAFTLQYSSNSGTGSLWSRQPFEQFGVAGKADVSSDHGTVQSSSTQESTSLVDLEAKLLQSFRSCIVKLLKLEGSEWLFRQDDGADEDLIDRIAAREKFLYEAETREISRLTNIGESQFSSNRKPGSAQKPEEMDYTKFLVMSVPHCGEGCVWKVDLVVSFGVWCIHRILELSLMESRPELWGKYTYCLNRLQGIVDLAFSKPRSPTSHCFCLQIPIGRQQKSSPTPISNGSLPPQAKQGRGKCTTAPMLLDMIKDVEMAISCRKGRTGTAAGDVAFPKGKENLASVLKRYKRRLSNKPVGNQEAGGGPQRKVTSPSSTSFGL

SEQ ID NO: 22071 - protein, 443 aa, Candida glabrata CBS 138
MNNTEDMFRDVENASQNMASTVNTSRMDQRQRRALTDLTSQKVNRIHTSKTIKDIPAYLSNYTADGENKNIDQAFNHSNDQDIGLVNQINSGYANVENEPGKETDHIFIDQDDLSDLDIVQEDSLREQLEEFEHDFENFVEPLSPIFNDEIQDTLDRAFKEYYRATPDMEDDDTFDAVMVTEYGSDIFRYMRKLELKYRPNPYYMAGQPELKWEYRKTVIDWIVQVHERFQLLPETLYLTINIIDRFLSRKNITLNRFQLVSATALLIASKYEEINCPTIKDIVYMVDNTYSRDDIIEAEKYMIDALDFEVSWPGPMSFLRRISKADDYEYRTRNLAKYLLETTLMESSLISALPSWLAAGAYFLSRIILGYEEWTLKHVYYSGYTHEQLYPLATLILDNCQNYEESHQAIWTKYSQPQYHQVSILVTKFLGRVSSDDMSEIY

SEQ ID NO: 22072 - protein, 209 aa, Pyrococcus horikoshii
MGSSHHHHHHSSGLVPRGSHMMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEDEIFKGLPKRLKVWESHMDEVKELPPKFKILARSETCPIEAMKHEELPIYGVQFHPEVAHTEKGEEILRNFAKLCGEL

SEQ ID NO: 22073 - protein, 341 aa, Alteromonadales bacterium TW-7
MKALSKLKAEPGIWMTDAPKPEVGHNDLLIKIRKTAICGTDVHIYKWDEWASKTIPTPMVVGHEYVGEVVDMGQEVRGFSVGDRVSGEGHITCGHCRNCRAGRVHLCRNTTGVGVNREGAFAEYLVIPAFNAFKIPDNISDELASIFDPFGNAVHTALSFDLVGEDVLITGAGPIGIMAAAVAKHVGARHVVITDVNEYRLELARKMGATRAVNVANEKLEDVMTDLGMTEGFDIGLEMSGVPSAFNSMLNNMNHGGKIAMLGIPPSDMAVDWNQVIFKGLVIKGIYGREMFETWYKMASLIQSGLNLSPIITHQYSVDDFQAGFDMMISGQSGKVILNWD

SEQ ID NO: 22074 - protein, 150 aa, Zea mays
  misc_feature (60)..(61): Xaa can be any naturally occurring amino acid
  misc_feature (75)..(75): Xaa can be any naturally occurring amino acid
  misc_feature (115)..(115): Xaa can be any naturally occurring amino acid
  unsure (1)..(150): unsure at all Xaa locations
AAHAPSARPSVVSRSPWPSGVGARELHLPAKECRRRHETLARSIRKPRGVDGEDKYDDKXXLSFDLDHISDTTGXGNLYGSDPAAAYHPLQSMFFKTLWAPVTDTGLLVKCLLLXGVSLLGYVSAWVSPDLLAIKKGPQEPTQSVPRGKI

SEQ ID NO: 22075 - protein, 491 aa, Bacillus licheniformis ATCC 14580
MNVQTPSEKLVKPFDCQHYINGRYFPSEKGSTFDNINPATQEIIGSVAEGGKKEVDLAVAAARRALNGRWKNMTADERIRIIRKVGDIILERKDELARLETLDTGKPLSLSSTLDIPRAAFNFHFFADFMRGAGTEAYQTDDLAINYAIRRPVGVVGLINPWNLPLLLLTWKLAPCLAAGNTAVIKPAELTPMTATLLGEICHDAGMPDGVVNIVHGFGPDSAGAALSEHPDVDAISFTGETTTGKVIMEAASKTLKKLSFELGGKNPNIIFADADMDEAVSTSLKSSFVNQGEVCMSGSRIYVEREAYDEFLNKFVEKTKKLKVGDPFDPDTNIGALISSEHTERVMNYIELAKREGGNILTGGKRPEGQESGCFLEPTIITGLSRNSRLIKEEIFGPVVTVIPFDDEEEVIAQANDTHYGLSATLWTNDLRRAHRVAGQIESGMVWVNSWFLRDLRTPFGGMKQSGLGREGGIHSLEFFSELTNICIKL

SEQ ID NO: 22076 - protein, 217 aa, Mangifera indica
MAGFRAEDDYDYLFKVGLIGDSGVGKSNLALRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGNLLAERESLSFMETSALEATNVDNAFAEVLSKSTALLARRLWKLVIIDQDAVPSKSEKIDVSKDVSAVKKVGCCSG

SEQ ID NO: 22077 - protein, 506 aa, Zea mays
MMASQAMVPLRQLFVDGEWRPPAQGRRLPVVNPTTEAHIGEIPAGTAEDVDAAVAAARAALKRNRGRDWARAPGAVRAKYLRAIAAKVIERKQELAKLEALDCGKPYDEAAWDMDDVAGCFEYFADQAEALDKRQNSPVSLPMETFKCHLRREPIGVVGLITPWNYPLLMATWKVAPALAAGCAAVLKPSELASVTCLELADICKEVGLPPGVLNIVTGLGPDAGAPLSAHPDVDKVAFTGSFETGKKIMAAAAPMVKPVTLELGGKSPIVVFDDVDIDKAVEWTLFGCFWTNGQICSATSRLLVHTKIAKKFNERMVAWAKNIKVSDPLEEGCRLGPVVSEGQYEKIKKFILNAKSEGATILTGGVRPAHLEKGFFIEPTIITDITTSMEIWREEVFGPVLCVKEFSTEDEAIELANDTQYGLAGAVISGDRERCQRLSEEIDAGIIWVNCSQPCFCQAPWGGNKRSGFGRELGEGGIDNYLSVKQVTEYISDEPWGWYRSPSKL

SEQ ID NO: 22078 - protein, 388 aa, Lathraea clandestina
PVKPYELPMTAAGALQSYKLASKAISRLQSLSCESIERLCETMVQEVFELTGYDRVMTYKFHGDDHGEVFTEITKPGLEPYVGLHYPATDIPQAARFLFMKNKVRMICDCRANHVRVIQDENLPMDLTLCGSTLRAPHICHLQYMENMNSIASLVMSIVVNEGNEESAPDETSQQLDKRKRLWGLVVCHNTSPRFVPFPLRYACEFLAQVFAIHVNKELELENQMLEKNILRTQTLLCDMLLRDAPLGIVSQSPNVMDLVKCDGSILLHKNQKYRLGITPGDFQIRDIVSWLDEYHHDSTGLSTGSLYDAGFPGALALGDVVCGMAAVRITDRDWLFWFRSHTASEIRWGGSKHELGERDDGRKMHPRSSFKAFLEVVKTRSLPWKDS

SEQ ID NO: 22079 - protein, 170 aa, Triticum aestivum
  misc_feature (2)..(2): Xaa can be any naturally occurring amino acid
  misc_feature (5)..(5): Xaa can be any naturally occurring amino acid
  unsure (1)..(170): unsure at all Xaa locations
LXQAXQPKTSYSSSSNTLMAKFAEHACSPPVRRSEPDSPAAAKRPRIEAPSPLPTFKVRKEKLGDRITALQQLVSPFGKTDTASVLHEANEYIKFLHDQVASLTYPYLKNVNPLQQFQQKGSENAKDDGGEPKKDLRSRGLCLVPVATTYTVASETVPEFWYPTFGGTFR

SEQ ID NO: 22080 - protein, 380 aa, Mesembryanthemum crystallinum
MVCQMEANNKVNGGGENGSSSEGRPPNPLAATYRQCYSATRVSSTCKKTLMRHPSLVKATDIPIEPLAVADCESEFLPIVRSGAWTDIGFRSNMEDAYLCVDDFIHHYGVEHINESPNAFYGVFDGHGRKHAADFACCHLPRFIFEDNDFPREIERVITSAFLQTDNAFAEACSLDAGLASGTTALAALVLGRSLVVANVGDCRAVLCRRGKAIEMSRDHKPHCSREIKRIEASGGYVDDGYLNGQLNVARALGDWHMEGMKGADGGPLTAEPELITTELTQEDEFLIIGCDGLWDVFRSQNAVDFARRRLQDHNDPVMCSRDLVDEALKRKSGDNLAVVVVCFQPQPPPNLIVPRARVQRSVSAEGLRELQSFLDGLES

SEQ ID NO: 22081 - protein, 612 aa, Lathraea clandestina
SGKPFYAIIHRVTASLIIDFEPVKPHGVPTTAAGALQSYKLASKSIARLQSLPSGSIEWLCETMVQEVFQLTGYDRVMTYKFHEDDHGEVLTEITKPGLEPYVGLHYPATDIPQAARFLFMKNKVRMICDCRANHVRVIQDENLPIDLTLCGSTLRAPHSCHLQYMENMNSIASLVMSVVVNEGNEDAAPGETSQQLDKRKRLWGLVVCHNTTPRFVPFPLRYACEFLAQVFAIHLNKELELENQMLQKNILRTQTLLCDMLLCDAPLGIVSQSPNVMDLVKCDGSILLHKNQKYRLGITPTDFQIRDIVSWLDEYHRDSTGLSTDSLYDAGFPGALDLGDVVCGMAAVRITDRDWLFWFRSHTASEVRWSGAKHELGERDDGRKMHPRSSFKAFLEVVKTRSLPWKDFEMDAIHSLQLILRKASSKEMEERKDLEGVEIQARLNELQIDGVQELEAVTSEIVRLIETASVPIFAVGVDGLVNGWNTKIADFTGLPVDKAIGVHFLSLVEESSAEAVSKMLELALEGKEEQNVHFEIKTHSPNSDSSPISLIVNACASRDVRENVVGVCFIAQDITTQKSVMDKFTRIEGDYRAIVQNPNPVIPPIFGTDEF

SEQ ID NO: 22082 - protein, 283 aa, Burkholderia xenovorans LB400
MLLIDTHAHVLSPDRTTFPRDYGLDMAWARGDLSAQQLVAAMDESSISKTLLIQAYSAYRYDNSYLESVIGEFPDRFAGVCMVDPLARDVSDRLTSLIVDRKFAGTRIVIVQPEPRLDDPAMAPFYETCAELRTPLCVLTIPPKLKELEVPLSQWPSLQVVVEHLGLIHTASGDSVSKERPLLDLARFPNCILKFSTISLRVAAAFEGGAQGQFERLIDAFGAQRLMWGSDYPSTPEGGIPGLVNEMHQALDFLPHHDLALLSGEAACRIWSTLRPVSSRGLA

SEQ ID NO: 22083 - protein, 1132 aa, Oryza sativa (japonica cultivar-group)
MAATAAALAVTDELALPLRAVGDLAAAAGVSREEVVVITQCASLGGKLPFDDASVGSVLAVIKKVENLGDLFITEISRVLKAGGMVLIQSSPSDQDPNNSIQRKLLLGGFVDVQASAASSQDSEHSVTIKAKKVSWSMGSSFPLKKATKGLPKIQIDDDSELIDEDSLLTEDDLKKPELPVVGDCEVGATRKACKNCTCGRAEAEEKVEKLNLTSEQINNPQSACGNCGLGDAFRCGTCPYRGLPAFKPGEKVMTSLPDRGVSSSSSDPLCEGNIAPCSSSSEQKEDCSLKQSKTSILSCVFNSPFNIFEAHQDSSANKSPKSSSGSYDWSRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPLEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGTDAGGVGVTYGMRGTTMPPPADVARFLSRDTIFDRVRLLDADPRALRAFAGTGLAVDVTVPNADVPRLAASRASARRWVRASVAPYAEATNVSRVLVGDEVISQANRTLLLSLVPAHAETCTRRWPPCCRRRRRRREIIKVSTPHSLGILAASTPPSAGRFHDGYDTAVVKPLLGFLRATGAPFMVNAYPFYGGLTNDTLDYVLFRVNDGVTDNATGLLYANMLDAQLDAVQSAMRRLRDAIRHFGSGVGTPLMPNRTFELSIFSLFDENLKPGPVSERNFGLYHADMTPVYDAGILTAPQEIVGTKVTPAPAPALAPAEDGRRRWCVPKPAADEVALQVNIDFVCGQGGIDCGAIRAGGSCYDPNNVQAHAAFAMNLYFQSNGQHEFDCDFGQTGVITTVDPSYKSCKFT

SEQ ID NO: 22084 - protein, 418 aa, Neisseria gonorrhoeae FA 1090
MANKLRNYTINFGPQHPAAHGVLRMILELDGEQIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPGFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCADWLRVNPGPVITANHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 22085 - protein, 454 aa, Oryza sativa
  misc_feature (97)..(97): Xaa can be any naturally occurring amino acid
  unsure (1)..(454): unsure at all Xaa locations
RHASRYAIETASRVVESRSTNSPRAETPPCSPLNPPPRADSLPRVSQRGVGGVPGASWGWFFQAAAGSPELDPAEERISGKGAAKLLDGRLVLDNAXRARIHADPAPEFDQFDCLPDPVVLLILNKLEDVRSLGRCAAVSKRFSGLVPLVSDVYVKIDRVVATDGDADDALNLSSAKPKNIFSHFFKLMLFTIVKPFHSMRNLNGTGRPLFPLAQHSPVHVLRNFSDVWNLRVELPSGDVGTEEGVLLKWRAEYGSTLRNCVILGGTLVDRKPIGAEHESSVEDNGSMPESFYTNGGLKLRVVWTISSLIAASTRHYLLRSIIKDHPTLRSLVLADADGQGTLYMGMEQLREFRENKLSASACSNRTQVPACNMKLKYAPYLELPGGMTLQGATLVVIKPSNDGGSGGHSSRKETEAFVSSAFDEPFRFAVKALMKRRTYLLEMNAEQLQSCLE

SEQ ID NO: 22086 - protein, 223 aa, Pyrobaculum aerophilum str. IM2
MLKRLLAREAIRLVKSGMVVGLGSGTTAREFIKALAEAGVDDVLLVATSSDSEILAYEVGLGDRLRPMWAVDRIDLAVDGADEVTKDKVLLKGKGGALLREKIVDYAAEKFVVLIEEHKLVERIPSNNPVPVEVVPWAWRFVAREVEKRFGGVAKLRQDGGKLGPVVTDNGNYIIDWNPPGFIDPYLEDELKAIPGVVENGVFSKRRDATILVASSDGTIKTL

SEQ ID NO: 22087 - protein, 1101 aa, delta proteobacterium MLMS-1
MTEDTSKQVCKPAAIDSDALRANLQETAVDCIELPAKWGILLEVVADYKGIHATLEELLYEIAHPYRNWRLILPRYRSFVLKHLDHYRRHPRGPEACLRLLEILLLALAENQRQETLLLQSAEVLAALFDKLVSIIKPADLPTFHQTIQESCNRLAELDEELLRPLVAGQHSLKKTIGRLVSKCDGESEVKICELTAPARLLKRVLILNYRNWLAEEDPQPWFASECEEICQGWEAGQLFAEISHDRLRQHLATAEATDCEHDELALPKLLELPDHMDIVRLYREIPDRLSSRPGQPQETESDDRFAENRKLLFLFRIMDTGGLALIHEETLREINRGLVQLIRRQTFEEIERFLLTTLALLKSNVRRYPHTSLQCIQIIGTEVFRRGNSRLVETFLWEAVRFGFQYANVTGIGEDWQPLANPAHLANIRVWLNLIGQEPKWCSTLFSALIINLKLSGTCLKDTDLFQRDISELLNQPIEPVYNLVTQFAKQVPVFYNDIGAEGTLREVSTEMDEIHQRRDKLIHFLRKQSHVESSNLIVDFIESIILFWRDRDKNVLAPYLPEEVLREIAPEGEYVDDLHRLSKRIWALNHIHRPTDLLNWDYNQRRHYLEAQEDIPAGERRRFDLLVRMYRLCHQKYNLGTEELRQHLKQAAAGDFPEMEQLLADLEICDTFECLSALLEHLERLKEIILSEERFTAQESIYHKRHIAIDIPSVYGRYQERKFDALSLTFRLENLANTYLEKLPETVNLNIITKATFIRILKCLRLYLRALKIDGITSRKLTTYMSLLSNSLGIKRFSYTQFLDIFRGLSEGVKDVIYTYYTNIHENNLSIIIPQIGHDNLLPKYRYLWRGQDPVGNVNRLSESFMRDLIAGTFGLQHLDNFITRIHQTLEAQREVLDEDHLDLLMTYNPDRAISPLQPRHSRNANLILLGNKGYNLSLLAIDGQPVPPGLTVTTEVFRCWPVIRQFTKCRDDFMTRLRFGLNQIEERTGRRFGDPAAPLLLSVRSGAAISMPGMMATIHNVGLNEDIVGEFACQEGRGFLAWDNFRRFIQSWAMAQGVERERFQGLMNAAKERCNVRYKRDFTAEQIRELTLNTRKQP

SEQ ID NO: 22088 - protein, 243 aa, Pseudomonas fluorescens PfO-1
MSDKDKQPLAASAQAAPVAESADAALKRIVDGFLHFHHEVFPQQEELFKKLATAQSPRAMFITCADSRIVPELITQSSPGDLFVTRNVGNVVPPYGQMNGGVSTAIEYAVLALGVQHIIICGHSDCGAMRAVLNPDSLEKMPTVKAWLRHAEVAKTMVHDNCNCTDEKESMPILTEENVIAQLQHLRTHPSVASRMANGHLFIHGWVYNIETSEIKAYDADQGCFLPLDGSHPIPVATPKARF

SEQ ID NO: 22089 - protein, 552 aa, Festuca ovina
TEQWKALQAHVGAIHKTHLRDLMADADRCKAMTAEFEGVFLDYARQQATTETVDKLFKLAEAAKLKEKIEKMFNGDKINSTENRSVLHVALRAPRDAVINSDGVNVVPKVWSVKDKIKQFSETFRSGSWVGATGKPLTNVVSVGIGGSFLGPLFVHTALQTDPEAAESAKGRQLRFLANVDPVDVARSIKDLDPETTLVVVVSKTFTTAETMLNARTIKEWIVSSLGPQAVSKHMIAVSTNLKLVKEFGIDPNNAFAFWDWVGGRYSVCSAVGVLPLSLQYGFPIVQKFLEGASSIDNHFRTASFEKNIPVLLGLLSVWNVSFLGYPARAILPYSQALEKLAPHIQQLSMESNGKGVSIDGVPLPYEAGEIDFGEPGTNGQHSFYQLIHQGRVIPCDFIGVIKSQQPVYLKGETVSNHDELMSNFFAQPDALAYGKTPEQLRSENVSENLIPHKTFKGNRPSLSFLLSSLSAYEIGQLLAIYEHRIAVQGFIWGINSFDQWGVELGKSLASRVRKQLHASRMEGKPVEGFNPSSASLLARYLAVEPSTPYNT

SEQ ID NO: 22090 - protein, 473 aa, Kluyveromyces lactis NRRL Y-1140
MSALLSRVAPRMSVLACAARLQLRTYASYPPYTIIGMPALSPTMVQGGLTEWSKNVGDRLEPGDVLAEVETDKAQMDFEFQEEGYLAKILVPAGTKDIPVNKPLAVYVEEESDVPAFANFTAADAESATAAKEAAKNGAKQPAKEESKEESKEGAKPASKPAAKKSSGSSASSGTRIFASPLAKSIALEHGVSLKEVEGTGPRGRITKDDVEAFLASAPSRESSAAKAAPALAAPTPASATYEDVPISNMRQIIGDRLLQSTQNIPSYIVSSQISVSKLLKLRQSLNATAKDQYKLSINDILIKAIAVAAQRCPDANAYWMPEQGVIRKFKNVDVSVAVATPTGLLTPIVKNAESKGLVSISKEIKDLGKRAKDNKLKPEEFQGGTICISNLGMNPAVSMFTSIINPPQSTILAIGTVNKVPVEDAGSEFGFTFDQKMNITGTFDHRTIDGAKGGEFMKELKKVIENPLELLL

SEQ ID NO: 22091 - protein, 163 aa, Haemophilus influenzae Rd KW20
  misc_feature (44)..(44): Xaa can be any naturally occurring amino acid
  unsure (1)..(163): unsure at all Xaa locations
MTNIHYHKILILDFGSQYTQLIARRVREIGVYCELWAWDVTEQXIREFAPELYQGRAFKSYRGMGSLGAMAKGSSDRYFQSDNAADKLVPEGIEGRIPYKGYLKEIIHQQMGGLRSCMGLTGCATIDELRTKAEFVRISGAGIKESHVHDVAITKEAPNYRMG

SEQ ID NO: 22092 - protein, 845 aa, Aeropyrum pernix
MRISVLFKYFIHLPPGLTPFIWCLCVERRLILWLDEISKDLLPLVGGKAAGLGEMIKAGIPVPPGFVVTSEAYRRFVFETGIAGFIKHILEETIVSGRPEEYEKASELIRSKFVRTPMPPYLRRAIVDAYRKLGTLVGVEEPRVAVRSSATVEDLPEASFAGQQETYLNVKGEEEVVEKVKTAWASLWTARALSYRDSLNIDHETALMAVVVQKMVSSRSSGVMFTIHPVTGEEDKIVIESIWGLGEYIVGGKVTPDRFVVSKSDLEILEVRISRKDKALFYDPDLNENVEIKIPESGEELEDLRRKHPAVAEVVEKYGIRPDAPSLSEKEVKELARLAIKVENHFARPMDIEWAIDFELSPPENILLLQARPETVWSRKKEEAEAKPPEEEAVPEGEVLVRGVPASPGVASGRVKVALTVEEAAKKMEKGDVLVTKMTDPDWVPYMKMASAIVTDEGGMTAHAAIVARELGIPAVVGTGDATKKLKDGMLVTVDGSRGVVYAGAVKTEEAREEEARPELGAAVAEVLSEVYPVTATKIYMNLGHPEEIDRYKHLPFEGIGLMRIEFIISSWIGYHPMYLIEQGRGVYFIDKLAEGVAKVASAIYPRPVVVRFSDFKTNEYRRLKGGEKYETLDERNPMIGWRGVSRYIHPNYEPAFRLEVRAIKKVREEWGLKNVWVMFPFVRTTWELERALKIMEEEGLSRGRDFKVWIMVEVPSTVFLADEFAKMVDGFSIGSNDLTQLVLGVDRDSGFLAKMGYFDERDPAVLRSIEILIEKAHSQGATVSICGQGPSVYPELVEFLVRRGIDSISVNPDAVVRVRRQVASIERRIMLERLEELGSRLSRL

SEQ ID NO: 22093 - protein, 523 aa, Haemophilus influenzae Rd KW20
MTNIHYHKILILDFGSQYTQLIARRVREIGVYCELWAWDVTEQQIREFAPTGIILSGSPESTTEENSPRAPEYVFNAGVPVLGICYGMQTMAMQLGGLTETSDHREFGYASVSLENSTALFANLNDNLTASEPKLDVWMSHGDKVTRLPENFKVTGTTLTCPIAAMSDESRRFYGVQFHPEVTHTKKGLELLTNFVVNICGCETKWTAENIIEDAVARIKEQVGDDEVILGLSGGVDSSVVALLLHRAIGKNLHCVFVDNGLLRLHEGDQVMEMFGDKFGLNITRVDAESRFLGELAGVSDPEAKRKIIGKVFVDVFDDESKKLTNVKWLAQGTIYPDVIESAASKTGKAHVIKSHHNVGGLPDYMKLGLVEPLRELFKDEVRKIGLALGLPAEMINRHPFPGPGLGVRVLGEVKKEYCDLLRRADAIFIEELRNSGWYEKTSQAFSVFLPVKSVGVMGDGRKYDWVISLRAVETIDFMTAHWAHLPYDLLGKVSNRIINEVNGISRVVYDISGKPPATIEWE

SEQ ID NO: 22094 - protein, 286 aa, Clostridium acetobutylicum ATCC 824
MLDLWYSESHADDTKFSIRVKEHLYSEKTPFQQIDFFKSETFGTFFTLDGYIMMTEKDEFIYHEMITHVPMAVNPKIKKVLIVGGGDGGTSREILRYNTIEKVDMVEIDERVVRLCQKYLTQTSCKLDNDSRLTMHFEDGKEFVKRAETGFYDLILVDSTDPIGPGEGLFTNEFYRDCERILSDDGILINQHESPYYKDYCHEMKRAHSKIKDKFPISMVYQFHMPTYASGHWLFGFASKKYHPLNNLNADSWNSLGLKTKYYNTNLHKGAFALPNYVIDELEKTE

SEQ ID NO: 22095 - protein, 452 aa, Desulfitobacterium hafniense Y51
MSNQENGMHRGLKNRHIQMIALGGAIGTGLFYGSAATIELAGPAITFSYLIGGLVIFFIMRMLGEMAVDEPVSGSFSHFAYKYWGEFPGFLSGWNYWFNYIVVSMAELTAVGIYINFWFPDIPHWLTALVCLVLVTLLNLISVGTFGEFEFWFAIVKVVAIIGMIVFGLFLIFSGINGEATGFDNLWIHGGFIPNGMIGILFSLVPVMFSFGGIELIGITAGEADNPQKSIPKAINQVMWRILIFYVGALSVLMVLYPWNQVGADGSPFVMIFSKIGIPAAATLLNIVVLTAALSVYNSGVYSNGRMLYSLAMQGNAPKLFAKLNKRGIPVAGVLVSSGITLVGVILNFLLPGKIFTYLMAVAIIAAVITWTTIIIVNLKFRKAKIAQGEGDALHFKTPLHPYTNYFCAAFLVMIVILMAFTESMKMAVLVLPIWLLILWISFKIKKSRESK

SEQ ID NO: 22096 - protein, 126 aa, Desulfitobacterium hafniense Y51
MSINVLHTDKAPAAIGPYSQGIKAGNLVFTSGQLPLNPVTGELETDIRKATHQSLENVRNILESAGTSLAKVVKVVVFLRDMNDFAAMNEIYGTFFTTNPPARSAVQVARLPKDAIIEIEAIALAD

SEQ ID NO: 22097 - protein, 319 aa, Mesembryanthemum crystallinum
MGYLDSVLSSSNQVHVEEQPVSGGGISQNGKFSYGYASSPGKRSSMEDFYETRIDGVEGEVVGLFGVFDGHGGARAAEYVKQNLFSNLIKHPKFISDTKSAIAEAYTHTDSEFLKSENTQNRDAGSTASTAILVGDRLLVANVGDSRAVICRGGEAIAVSRDHKPDQSDERQRIEDAGGFVMWAGTWRVGGVLAVSRAFGDKLLKQYVVADPEIQEEVVDSSLEFLILASDGLWDVVTNEEAVTMVKPIQDTEEAAKKLMQEAYQRGSADNITCVVVRFLDNPIDSSSNRISGNHGDTSSRVLGGSHTDSSNRFLGKPR

SEQ ID NO: 22098 - protein, 544 aa, Chlamydophila pneumoniae J138
MELLSLNKSYFEIQRLRYRPEILTLLETIRSKHIQETSSPPSPPPELQKHIPNLCRIPEVSIYTEQETSSKPLKIGVLLSGGQAPGGHNVVIGLFDALRVFNPKTRLFGFIKGPLGLTRGLYKDLDISVIYDYYNMGGFDMLSSSREKIKTEEQKKNILNTVKQLKLDGLLIIGGNNSNTDTAMLAEYFLAHNCKTSVIGVPKTIDGDLKNCWIETSLGFHTSCRTYSEMIGNLAKDALSAKKYHHFIRLMGQQASYTTLECGLQTLPNIALISELIATRKISLKQLSEQLALGLVRRYKSGKNYSTVLIPEGLIEHIFDTRKLIDELNVLLANGDSSIEKILSKLSPETLKTFHLFPKDIANQLLLARDSHGNVRVSKIATEELLAVMVKKEIEKIKPHMEFHSVSHFFGYEARAGFPSNFDCNYGIALGIISALFLVRQKTGYMITINNLAQSYTEWQGGATPLYKMMHLENRCGTETPVIKTDSVDPKSPAVQHLLQQSDSCLVEDLYRFPGPLQYFGKEELIDQRPLTLLWENQTHSPLL

SEQ ID NO: 22099 - protein, 520 aa, Thiobacillus denitrificans ATCC 25259
MHQKILILDFGSQYTQLIARRVREAGVYCELHPNDVSEDFVREFAPQGIILSGGPNSVYEDETPRAPDVVFTLGVPVLGICYGMQTMAAQLGGAVESAAKREFGYAEIRARGHTQLLRDIQDRVTGEGHGMLDVWMSHGDKVTALPEGFKLMASNAATPIAGMADEARRFYGVQFHPEVTHTLQGKHILNRFVHDICGCGSDWNMPDYVEEAIGKVRSEVGSDEVILGLSGGVDSSVVAALLHRAVGDQLTCVFVDNGLLRLNEAEQVMETFAQNLGVKVIHVDATERFMRELAGVSDPEQKRKIIGREFVHVFQEEAEKLPKAKWLAQGTIYPDVIESASAKTKKAHTIKSHHNVGGLPETLHLQLLEPLRELFKDEVRELGIALGLPHDMVYRHPFPGPGLGVRILGKVKREYADLLRRADAIFIEELRASGWYEKTSQAFTVFLPVKSVGVMGDGRTYDYVVALRAVQTQDFMTAHWAELPYTLLGKVSNRIINEVRGINRVVYDVSGKPPATIEWE

SEQ ID NO: 22100 - protein, 609 aa, Lindenbergia philippensis
SGKPFYAIIHRVTGSLVIDFEPVKPHEVPMTAAGALQSYKLAAKAITRLQSLPSGSMERLCDTMVQEVFELTGYDRVMIYKFHDDDRGEVLTEITKPGLEPYVGLHYPATDIPQAARFLFMKNKVRMICDCRAINVKVVQDGNLPFDLTLCGSTLRAPHSCHLQYMENMNSIASLVMSVVVNEGDEEASTPDSSLHPDKRKRLWGLVVCHNTTPRFVPFPLRYACEFLAQVFAIHINKEVELENQMLEKNILKTQTLLCDMLLRDAPLGIVNQSPNIMDLVKCDGAMMLYKNQKYRFGLAPNDFQIRDLVSWLDAYHGDSTGLSTDSLYDAGFPGALALGDAVCGMAAVRITDKDWLFWFRSHTAAEIRWGGAKHERGEKDDGRKMHPRSSFKAFLEVVKTRSLPWKDYEMDAIHSLQLILRNASREADKKDLEGMEIHARLNDLQIDGIQELEVTSEMVRLIETASVPIFAVDGDGLVNGWNTKIADLAGLPVEKAIGMHFLDLVEDSSADTVGKMLKLAIQGVEERNVQFEIKTHGPRSDSTPISLVVNACASKDVKENVVGVCFIAQDITTEKSVMDKFTRIEGDYRAIIQNPNPLIPPIFGIDEF

SEQ ID NO: 22101 - protein, 127 aa, Pyrobaculum aerophilum str. IM2
MKVRDLLKDNVIFCYADEPVECAVAKMYAANVGSVVVMDRANRPVGIVTERDIVRFLAQEIDLKTPLEQVAKKSLITVSPEESIVSAAAKMIENNIRHMPVVEGGRVVGVISIRDVLRALVTAEAFP

SEQ ID NO: 22102 - protein, 465 aa, Solanum berthaultii
MSTKPTPLELPEMSTMSLEETFHPSKVSESTESSSSSTTPLSPHTGGDVRWDAINSATGRGGPPLNLSNFRLLKRLGYGDIGSVYLVELRGTNAFFAMKVMDKGSLASRNKLLRAQTEREILSLLDHPFLPTLYSHFETDKFYCLVMEFCSGGNLHQLRQKQPNKHFTEEASRFYASEVLLALEYLHMLGIVYRDLKPENVLVRDEGHIMLSDFDLSLRCSVNPTLVKSSSVHGGGGNPSSGSGILDNDNAVQGCIQPSTFFPRNILPTKKNRKSKSDFGLFVGGSLPELMAEPTNVRSMSFVGTHEYLAPEIIRGEGHGSAVDWWTFGIFLYELLHGTTPFKGAGNRATLFNVVGQPLRFPETPQVSAIARDLIRGLLVKEPHKRIAYKRGATEIKQHPFFEGVNWALVRSAVPPSIPEPVDFAQYASKEASAPCSDKKMPDTESHDKSKNTSNDSSYMDFEYF

SEQ ID NO: 22103 - protein, 496 aa, Coccidioides immitis RS
MALFQKIETPSCTYEQPLGLFINNEFVKGVEGKTFETINPHNEKPIVAVHEATEKDVDIAVAAARKAFEGEWKKVTPTDRGRMLNKLADLLEQHCDTLAAIEALDNGKAVSMAKVDVANSAGCIRYYGGWADKLHGKVVDTDHETFNYTRHEAVGVCGQIIPWNFPLLMWAWKIAPALATGNTIVLKSAEQTPLSALYACQLVKEAGFPPGVLNVISGFGRVAGAAISSHMDIDKVAFTGSTLVGRQILQAAAKSNLKKVTLELGGKSPNIVFNDADIDNAISWVNFGIYFNHGQCCCAGSRILVQEGIYEDFLQRFKERAMKNKVGDPFNPDTFQGPQISQLQFDRVMGYIDQGKKAGAKVEIGGERLGTEGYYIQPTIFSNVNEDMSIVKEEIFGPVCSIQTFKTEEDAIKIANGTSYGLAAAIHTKDLNTAIRVSNEIRAGTVWVNCYNLLSYQTPFGGFKESGLGRELGEYALDNYTQVKAVRIRLGDAMFG

SEQ ID NO: 22104 - protein, 856 aa, Candida glabrata CBS 138
MTIISEDEKSVARDREGVLARAIKVVNRKFRRKDVRREKLERALSCDNQMTLNSTNLYAAQQQEYQRREENDIEENQEPEGGNDDIDYDISILSDEMSTVDDASLLFAEPPQKQSHMMSIVVGAFVAVGGFLFGYDTGLINSIVDMRYVRENIAPNHVGFTAQQLAILVSFLSLGTFVGALSAPVISDKYGRKKTIMFSTAVVFSLGNSLQVGAHNIQLLIAGRVISGLGVGLVSAVVPLYQAEAAHKSLRGAIISTYQWAITWGLLVSSAVSQGTHNRNDASSYRIPIGLQYVWAYILAAGMLWLPESPRYYVLRDQLDKAAQSLSFLRGVPIHDSGLLEELVEIKATFDYESSFGKTTFWDCFKSNKSRPKQTLRMFTGIAIQAFQQFSGINFIFYYGVSFFNRSGVENSYIVSLITYAVNVGFSVPGMFLVEYFGRRSVLLYGGAIMTLSNFIIAIVGSSTQSVVANKVMIAFICLFIASFAATWGGVVWVISAELYPLGVRAKCTAICAAANWLINFVCAFITPYIVDTGERRALIGPKIYFIWGSLNALGILVVYFTVYETRGLTLEEIDELYTKSPNGIVSAKWNRRIRHREKTYGHKEQQNRDRNQQTTKENLRKNVVNEDMLSDDLTPRNDSINTHHSVDSNEKYQSENTDNTLAPAVNDRSMMDFGNDMILHICNRGPPSISTAASVEEFGGNSTQMENLSYNESNSVEKKKVGLFSKFKLGSRKSSINGTEEDSKPKSPQLGQAEFSPSPLDVKVSDDDHNDFVDLGNGFGLYSVTRRLSSGVPDTSDEESAYDLGNAPSSTNTYRNRGNLDSINTYMSQLIQSNTYTSQNTGYSQNDNDQTQHHQ

SEQ ID NO: 22105 - protein, 187 aa, Escherichia coli CFT073
MAGESFILMGVSGSGKTLIGSKVAALLSAKFIDGDDLHPAKNIDKMSQGIPLSDEDRLPWLERLNDASYSLYKKNETGFIVCSSLKKQYRDILRKGSPHVHFLWLDGDYETILARMQRRAGHFMPVALLKSQFEALERPQDDEQDIVRIDINHDIANVTEQCRQAVLAIRQNRICAKEGSASDQRCE

SEQ ID NO: 22106 - protein, 406 aa, Oryza sativa (japonica cultivar-group)
MLSSGGELKSSSLVQQMVWVGTGNSSSSSIMGSLRQLPCSEEQDAASSPASMLFLPQQLLLHASSNSSPCLNIPEVNLSTGLHPLGSFHGDVQQQEIISGMPDQSWRQLLLGGLVGDHEKYSVATALLSKGLDDEASMPHEASAAAYDFYGHGGGAGDGILQASPEASSCKSQLSQMLLQAAASSPRSCVTTSGLGSSMMDFSNTAAVAPAAEPELTRKHHAGQSDNSSECNSTETGSALKKARVQASSSAQSTLKVRKERLGDRITALHQIVSPFGKTDTASVLQETIGYIRFLLGQIEALSYPYLGQCCSANPMQQQTGIMAGERSTDGLFPEFPAGQDAEKDGKKQQAKKDDDLRSRGLCLVPVSCMPHLAADNDVVVGSDFWAAAGGGGGGGAPPLAGMNLR

SEQ ID NO: 22107 - protein, 433 aa, Roseovarius nubinhibens ISM
MNDASPIPNDLDSFWMPFTSSRAFKAAPRLVSGAKGLYYTTVDGREVFDGTGGLWCSNAGHGHPRIIEAIQKQAAEMDFAHCFGQGHPIAFQAASRMVALAPGFDHVFFTNSGSESVDTALKIALGYHSARGEGQRRILVGRQKAYHGINFGGLSVGGIGLNKGQFGTLYPSAQHLRHTNLPENRMSKGQPETGAHLAEDLAMICETHGGHNVAAVIVEPVAGAGGVFPPPKGYLERLREICDQHGILLIFDEVITGFGRMGTPFASQHFGVKPDIFTAAKGMTNATVPMGGVFTTAKVREAFLSGPEALPDLFHGYTYSGHPLASAAAIATLDVYRDEGIFENAAKMAPIWEEMLHSFADVPDVIDIRNMGLIGAMEIDPNSSRTAPELAKKAWDIGLSFRPIGNNFAMSPPLTIDEEHIGKVKDMLTKVLR

SEQ ID NO: 22108 - protein, 427 aa, Idiomarina loihiensis L2TR
MSRSEELYTKAQISIPGGVNSPVRAFNGVGGSPIFFESAEGAYMIDADGKRYIDYVGSWGPMILGHNHPAVLEATLQAAKRGLSFGTPTEVEITMAETIRKIVPSIEKVRMVNSGTEATMTAIRLARGYTGRDKILKFEGNYHGHADSLLVKAGSGALTLGVPNSPGIPEDFAKHTLTATYNDIESVKQIFAEMGDEIACIIVEPVAGNMNCIPPVDGFLEGLRSICDDHGSVLIFDEVMTGFRVAPGGAQDRYKIKPDLTTLGKVIGGGMPVGAFGGKKEVMDYIAPVGPVYQAGTLSGNPVAMAAGLAALQQLSTPGLYDQLYQRVDTLLDGLQERADRAGVPMTTNRAGSMFGFFFTEEPEVTTYAQATQCNMEHFKTFYHAMLEQGVYLAPSAFEGGFMSAAHSEEDIQNTLNAAEKAFAKLV

SEQ ID NO: 22109 - protein, 340 aa, Legionella pneumophila subsp. pneumophila str. Philadelphia 1
MKSLVKAKKEPGIWMQDIPVPEYGVNDVLIKIKRTAICGTDIHIYSWDEWAQATIPVPMTVGHEFYGEIVEVGKEVQGLKVGQRVSGEGHITCGFCRNCRAGKRHLCRNTLGVGVNRPGCFAEYLALPATNVIALPDNITEEQAAILDPFGNAAHCALAFDVVGEDVLITGAGPIGIMAAAIVRHIGARHVVITDVNDHRLELARQMGVSRAVNVKYQKLSDVANELGMLEGFDVGLEMSGNPMALNDMMKAMNHGGHVALLGIPPQETPIDWNQVIFKGLVIKGIYGREMFETWYKMIAMLQSGLNISPVITHNFPVDEYQHAFQIMASGQSGKVILNW

SEQ ID NO: 22110 - protein, 250 aa, Oryza sativa (indica cultivar-group)
MEEQPIKNAVHIGETPVTGDWACPDGGNTEVAAFLDKAGAEAEAEAEAEAESSGSHPLGEIAGSAGHLLLLKLWQREESRLGRRACALEALMDAARRDAFYLCAAFLAFHGLSLALLFAASVSASASAAVVSPPAEQRAACCSLAGGGGCRRPCRWSRPSRSRRPCSSGSAPGVRTATRALARCVQELRMKGAAFGLSKEPQYGGDEGQVRQRRGRRCVGPALVVLPEHRRRRHHVLRQVHLVLVGRRLR

SEQ ID NO: 22111 - protein, 307 aa, Alteromonadales bacterium TW-7
MPTTDYQRVLNEITQEVAPLLSKGKVADYIPALAEVDPEQFSIAIYTTEGEIICAGDCSQRFTIQSVSKVMTLTMALQRYGDELWNRVGKEPSGTAFNSLTQLEFEKGVPRNPFINAGAIVTCDALYSRLSAPMHSMLETFRLLSGNRGIVIDKKVANSEYEFRHRNAAMAHLMKSFGNFENDVDDVLWSYFNFCSIELNCVELAKAYSFLANKGVDQLSGEQVLSSRQNKQLNSLLFTSGLYDAAGDFGYRVGMPGKSGVSGTILAVLPNKFTVAVYSPGLNSFGNSVAGIAALELLSKKLDISIF

SEQ ID NO: 22112 - protein, 388 aa, Oryza sativa (indica cultivar-group)
MMQIFSVRIAALSAAAAPVQIYGYMAARDLYELLRNYVFRRSRDDPFVLPGHYSDPDSLVSLWGPKRDTSRCRIPPCMIEYDLKMKRGEEEQDDLQLINGVAAFSDLSPFHGVYSQRIHGVHGAVDISLALLREGMECTIEIRVPKEQPIKNAVHIVEIPVTGDGACPDGGNAEVAAFLDKAAEAESSGSHPLGEIAGSAGHLLLLKLWQREESRLGRRACALEALMDAARRDAFYLCAAFLAFHGLSLALLFAASVSASAVSPPAEQRAACCSRWWVPSSLSLVASLALAAAVQLRVCAYWRASRRLRRERGDARALARCVQELRMKGAAFDLSKEPQYGVTRAKCASVEGAGAWGPLRWCYQNIVAACLLAVAAATMCSGKFILCS

SEQ ID NO: 22113 - protein, 446 aa, Glycine max
LTTTTTTTTTIAREMHTASRSNGGGVLASRTSSRSVTETVNGSHKFVIKGYSLAKGIGVGKHIASETFTVGGYQWAIYFYPDGKNPEDNSAYVSVFIALASEGTDVRALFELTLLDQSGNGKHKVHSHFDRSLESGPYTLKYRGSMWGYKRFFKRAQLEASTFLKDDCLKINCTVGVVVSSIDCSKLNTIQVPESDIGAHFGMLLENEEGSDVTFSVGGERFHAHKLVLAARSTAFETEFFNGMEEDDHDIVVTDMEPKVFKALLHFIYRDTLIDDEELFMSRSSFLPSVSESFAAKLLAAAEKYGLPRLKLMCESVLCKDISIDSVAYILALADRYRATELKSVCLQFSAENLVAVMQSDGFEYLKENCPLLQSELLKTVAGCEEEFSGEGKCRSVWAQFSDGGDTNDRSVRQQTWENGVERSQSLWVHLSDGVNNNDRSPGQEA

SEQ ID NO: 22114 - protein, 306 aa, Bacteroides fragilis YCH46
MRKVIGIGETILDIIFRNDQPSAAVPGGSVFNGIVSLGRMGVNVCFISETGNDHVGNIILQFMRDNHIPTDHVNVFPDGKSPVSLAFLNEHSDAEYIFYKDYPKQRLDVLFPSINEDDIIVIGSYYALNPVLRDKILELLDIAKEKRAIVYYDPNFRSSHKNEAMKLTPTIIENLEYADIVRGSLEDFYYMYGIKDVEKIYKDKIKFYCPLFLCTAGAERISLRTNAISKEYPVAPLEAVSTIGAGDNFNAGLIYGMLKYDVRYRDLQHLSEETWDKVIQCGQDFAAEVCKSFNNSISGEFAANYR

SEQ ID NO: 22115 - protein, 201 aa, Bacteroides fragilis YCH46
MIESIQELLQKEAQAVLNIPVTDAYEKAVELIVEQIHRKKGKLVTSGMGKAGQIAMNIATTFCSTGIPSVFLHPSEAQHGDLGILQENDLLLLISNSGKTREIVELTQLAHNLNPGLKFIVITGNPDSPLASESDVCLSTGHPAEVCTLGMTPTTSTTVMTVIGDILVVQTMKRTEFTIEEYSKRHHGGYLGEKSRKLCVK

SEQ ID NO: 22116 - protein, 485 aa, Acidobacteria bacterium Ellin345
MKSLHSYIGGRFVPGKRGFADINPADGSVAATVTEASAEMVDEAVAAARKALHGEWGKLGARGRATVLYKIAEGIEKRFDCFVQAEVADTGKPLSLASRLDVPRAAANFRVFADVIKIAGLEAFETELPDGRRALNYTVRKPIGVVGIVTPWNLPLLLLTWKVAPALACGNAVVVKPSEETPATATLLAEVMQEAGVPDGVYNVVHGFGPNSAGEFLVSHPGVNAVTFTGESQTGASIMRACAPTVKPVSFELGGKNAAVIFADCDFDATIAGMSDAVFLNTGQVCLCAERVYVERRIFDRFVAALTERAKSYDLGWPMEPATSMGPLISKVHREKVLSYFDLAREEGATVVIGGGVPTFGDGRDSGFYVQPTIFTGLKESARCVKEEIFGPVCHVAPFDSEEEAVALANDTRYGLAASIWTSDLQRAHRVAPQMNAGITWVNCWFLRDLRTPFGGVGLSGIGREGGMHSLNFYSELNNICIRTE

SEQ ID NO: 22117 - protein, 605 aa, Melampyrum pratense
SGKPFYAIIHRLTASLIIDFEPVKPHEVPMTAAGALQSYKLASKSIARLQSLPGGSMERLCETMAQEVFELTGYDRVMVYKFHEDDHGEVLTEITKPGLEPYVGLHYPATDIPQASRFLFMKNKVRTICDCRANHVRVIQDENLPVDLTLCGSTLRAPHSCHLQYMENMNSIASLVMSVVVNEGNEDAGPDDSSLDKRQRLWGLVVCHNTSPRFVPFPLRYACEFLAQVFAINVNKELELENQMFEKNILRTQTLLCDMLLRDAPLGIVSHSPNVMDLVKCDGAILLHKNQKHRLGMTPNDSQFRDIVSWLEEYHRDSTGLSTDSLYDAGFPGALDLGDVVCGMAAVRISDEDWLFWFRSHTASEIRWGGARHESCERDDGQKMHPRSSFKAFLEVVKSRSLPWKDFEMDAIHSLQIILRNASSKETEERKEVGVQIQARLNELQIDGVQELEAVTSEMVRLIETASVPIFAVDVDGLVNGWNTKIADLTGLPADKAIGMHFLSLVEESSIEAVSKMLELALDGKEEQNVHFEIKTHGPSPISLIVNACASRDVKENVVGVCFIAHDITTQKSVMDMFTRIEGDYRAIVQNPNPIIPPIFGTDVF

SEQ ID NO: 22118 - protein, 382 aa, Melampyrum sylvaticum
PYEVPMTAAGALQSYKLASKAIARLQSLSSGSMERLCETMVQEVFELTGYDRVMTYKFHEDDHGEVFTEITKPGLEPYLGLHYPATDIPQAARFLFMKNKVRMICDCRANHVRVIQDENLPSELTLCGSTLRAPHGCHVQYMENMNSIASLVMSVVVNEGDEEAGPDDSSQHPDKRKKLWGLVVCHNTSPRFVPFPLRYACEFLTQVFAIHVNKEVELENQMLEKNILRTQTLLCDMLMRDAPLGIVSQSPNVMDLVKCDGAILLHKSQKHRLGITPSDYQIRDIISWLDEYHRDSTGLSTDSLYDAGFPGALSLGGGVCGMAAVRITDKDWLFWFRSHTASEIRWGGAKHEPNDRDDGQKMHPRSSFKAFLEVVKTRSLPW

SEQ ID NO: 22119 - protein, 246 aa, Bacillus cereus G9241
MVVALMAITAGCSEVNQPITPKSTGIWNEYFVYPLSQLITYFANLFGSNYGLAIVVTTLIIRFALLPLMIKQTKSTKAMQALQPEMVKLKEKYSSKDQATQQKLQQEMMQLYQKNGVNPLAGCLPIFVQMPILFAFYHAIMRTSEISKHTFLWFDLGQADPYYILPVVAAITTFIQQKLAMAGTAGQNPQMAMMIWLMPIMILIFAINFPAALSLYWVVGNIFGIAQMYLIKGPEIKASKAGGSSK

SEQ ID NO: 22120 - protein, 466 aa, Melasma scabrum
SGKPFYAIIHRVTGSLVIDFEPVKPHEVPMSAAGALQSYKLAAKAIARLQALPSGSLERLCETMVQEVFELTGYDRVMVYKFHDDDHGEVFAEITRPGLEPYAGLHYPATDIPQAARFLFMKNKVRMICDCRSAHVKVVQDESLSSDLTLCGSTLRAPHSCHLRYMENMNSIASLVMSVVVNEGRDEESSASSSTSLHPEKRKRLWGLVVCHHTSPRFVPFPLRYACEFLSQVFSIHVGKELELLNQTLEKNILKTQTLLCDMLLRGNPLAIVTQSPTMMDLVKCDGAVLLYKGKNHRLGLAPSDLQIRDIMSWLDEYHRDSTGTSTDSLLDAGFPGAAALGDAFCGMAAIRITGRDWLFWFRSHTAAEVRWGGAKHEKGDEDDGRRMHPRSSFKAFLEVVKARSVPWRDFEMDAIHSLQLILRNACEKEMEEEERRKDMVVAGEIQARLTELHIDGAREMEAVTS

SEQ ID NO: 22121 - protein, 612 aa, Melasma scabrum
SGKPFYAIVHRVTGCLVVDFEPVKPHEVPMTAAGALQSYKLAAKAIAHLQALPSGSLERLCETMAQEVFELTGYDRVMVYRFHDDDHGEVYAEITRPGLESYAGLHYPATDIPQAARYLFMKNKVRMICDCRAAHVKVVQDEGLSSSLTLCGSTLRAPHSCHLRYMENMNSIASLVMSVVVNEGTDGESSSSPHQPDKRKRLWGLVVCHHTSARFVPFPLRYACEFLSQVFAIHVSKELDLLNQVIEKSILKTQTVLCDMLLRGNPLAVVGQNPTVMDLVKCDGAVLLYKGKNHRLGLAPTDPQIRDIVLWLNKYHRDTTGTSTDSLLDAGFPGAAALGDALCGMAAVRITGRDWLFWFRSNTAAEVRWGGAKHEKGDEDDGRKMHPRSSFKAFLEVVKARSVPWRDFEMDAIHSLQLILRNACEKEEERRKDVVVVGEIQSRLNDLNIYGAREMEAVTAEMVRLIEKASVPILAVGVDGVVNGWNTKIADLTGLPMDKAIGQHLLELVEEASADAVSRMLELVLQGQEEQNIQFEIKTHGPRAESGPISLVVNASATQDVKHNIIGVCFIAQDVTTERSMTDKFTRIEGDYRAIVQNRNPLIPPIFGSDEF

SEQ ID NO: 22122 - protein, 124 aa, Zea mays
  misc_feature (11)..(11): Xaa can be any naturally occurring amino acid
  misc_feature (18)..(18): Xaa can be any naturally occurring amino acid
  misc_feature (40)..(41): Xaa can be any naturally occurring amino acid
  unsure (1)..(124): unsure at all Xaa locations
MAYSMLSSAAXCYLPGSXHMVAPFTGLKSSSAFPVTGRAXXDLTLLVSNGEKVNWMEGGPQLGKKNFETLFLTFRDLYPKFKLGGGEGEKLFSPKKGGVPLGGEEIPRGGEHPFFFFGPRGETQ

SEQ ID NO: 22123 - protein, 450 aa, Yersinia pestis CO92
MTKHYDYLAIGGGSGGIASINRAAMYGKKCALIEAKQLGGTCVNVGCVPKKVMWHAAQIAEAIHLYGPDYGFDTTVNHFDWKKLIANRTAYIDRIHQSYERGLGNNKVDVIQGFARFVDAHTVEVNGETITADHILIATGGRPSHPDIPGAEYGIDSDGFFELDEMPKRVAVVGAGYIAVEIAGVLNGLGTETHLFVRKHAPLRTFDPLIVETLLEVMNTEGPKLHTESVPKAVIKNADGSLTLQLENGTEVTVDHLIWAIGREPATDNLNLSVTGVKTNDKGYIEVDKFQNTNVKGIYAVGDNTGVVELTPVAVAAGRRLSERLFNNKPDEHLDYSNIPTVVFSHPPIGTIGLTEPQAREKFGDDQVKVYTSSFTAMYSAVTQHRQPCRMKLVCVGAEEKIVGIHGIGFGMDEILQGFAVAMKMGATKKDFDNTVAIHPTAAEEFVTMR

SEQ ID NO: 22124 - protein, 128 aa, Triticum aestivum
MFFSISIQLRSAQMGREEISSSKIHVSVESGSTICSTCENLTNKAVSYLSEKPTQDEIMEILHGACSQTFSLEQKCLEMVDSYATLLFAKVTGIKPDEFCKRYGLCRDVSFLSGAKSETPCAFWHHSF

SEQ ID NO: 22125 - protein, 523 aa, Medicago truncatula
MGNCCSGGTEDPEDKGENNQQNNDANGDSSATTPPPWSKPSPQPSKPSKPSAIGPVLGRPMEDVKATYSMGKELGRGQFGVTHLCTHKTTGKQYACKTIAKRKLANKEDIEDVRREVQIMHHLTGQPNIVELIGAFEDKQSVHLVMELCAGGELFDRIIAKGHYTERAAASLLRTIVQIVHTCHSMGVIHRDLKPENFLLLSKDENSPLKATDFGLSVFYKQGDQFKDIVGSAYYIAPDVLKRKYGPEVDIWSVGVMLYILLCGVPPFWAESENGIFNAILRGHVDFSSDPWPSISPSAKDLVRKMLNSDPKQRITAYEVLNHPWIKEDGEAPDTPLDNAVLNRLKQFRAMNQFKKVALKVIASCLSEEEIMGLKQMFKGMDTDNSGTITIEELKQGLAKQGTRLSETEVKQLMEAADADGNGIIDYDEFITATMHMNRLNREEHVYTAFQFFDKDNSGYITIEELEQALHEYNMHDGRDIKEIISEVDADNDGRINYDEFVAMMGKGNPEANTKKRRDSTLY

SEQ ID NO: 22126 - protein, 147 aa, Triticum aestivum
  misc_feature (83)..(83): Xaa can be any naturally occurring amino acid
  unsure (1)..(147): unsure at all Xaa locations
MASKGLVVFAVLLAAAFLVATAEQTQAKKEETKAGVQGYHGGGGGGGGYHGGGGGGGYPGHGGGGGGGYPGHGGGGGGGYPGXGGGGGGGYPGHGGGGGGGYPGHGGGGGGGSGCRYQCCGHGRGGCRCCASPNEIPEPMYRAEVRN

SEQ ID NO: 22127 - protein, 124 aa, Medicago truncatula
MTTISLRKGNTRLPPEVNRVLYVRNLPFNITSEEMYDIFGKYGAIRQIRIGTNKDTRGTAFVVYEDIYDAKTAVDHLSGFNVANRYLIVLYYQQAKMSKKFDQKKKEDEIARMQEKYGVSTKDK

SEQ ID NO: 22128 - protein, 381 aa, Cicer arietinum
WRSLRRACATKIFSPQQLDSTQFHRKRKVQDLLNYVQKCCEKGEALDFGEVVLATVMNSISETFISMDLFHYCDPSNDDDNKKSREFKEMVFGIMEEVGRPNVVDFFPFLKLFDPQGVRTRMRNHFEKLLAFFYEVMKERMRLRASGESKEYKDVLDSFLDLLNEENSQLCRHDVLHLFTDLFVAGIDTTSTTMEWAMAELLHNPSKLARLRKELEQIHGKFGQIEESDASKLPYLRAVVKEILRLHPSVPFLVPHKSKDDGELGGFMVPKNAQILVNVWSIGRNSSIWDNQIHLNLKDFWRVKLISKGRDFELVPFGAGRRICPGLPLASRSIHYIMASLLHHFNFKLADDLKPDDMDMSHKFGVTLHKAQPLRVVPIKA

SEQ ID NO: 22129 - protein, 200 aa, Candida glabrata CBS 138
MSEPDFNDFEESTNDDKYKVSEKKTVDEYKKLDAEDESLAKWKESLGLSSDVLPLEFPGDTRKVVIQKIQLLVDTEKEPITFDLTNETTIKELASKRYKVKEKSIYKLRITFKVQHEIITGLRYVQYIKKAGIAVDKIDDHLGSYAPNTKQKPFYEVELPESEAPSGFLARGNYSAVSKFIDDDKTTHLTLNWGVEIVKK

SEQ ID NO: 22130 - protein, 213 aa, Glycine max
MASQVLLQQALFAPKLSFPSSSRNVALISRVPSTPISWRCTPLIAKPSFVVRADTNLDGGGEATEDVPSDNAEKVSEGEAEQVSDSEAPKSPRKPRVKLGDIMGILNQRAIEASEKQRPTPDIRTGDIVEIKLEVPENKRRLSIYKGIVISKQNAGIHTTIRIRRIIAGTGVEIVFPVYSPNIKEIKVVSHRKVRRARLYYLRDKLPRFSTFK

SEQ ID NO: 22131 - protein, 149 aa, Bryonia dioica
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQTNYEEFVKVMMAK

SEQ ID NO: 22132 - protein, 549 aa, Idiomarina loihiensis L2TR
MSPKTDIAEVNQESLYRIFTIPEAPDSTLGKIEKHLSENLMGFLGEHIVAREKPLQEIERDFDKSQIPEEPAFVSDHTEFLLDKLVAHSVHTASPRFIGHMTSALPYFLLPLAKLMVGLNQNLVKIETSKAFTPLERNVIGMMHHLVYQQDAPFYNRWMHSAQHSLGAFCSGGTIANMTALWVARNRLLQADGDFAGISADGLAAGLQHYGYSKLTVVVSERGHYSLSKAADVLGIGRRNLVSVATDSDNRIRIDELRKTCEKIAKEGGKVLALVGVAGTTETGHIDPLDEMATVAEEVDAHFHVDAAWGGATLLSEQHRPLLAGIERADSVTIDAHKQMYVPMGAGLVLFKNPALVKSIEYHAEYIIRQGSKDLGSHTMEGSRAGMAMMVFSAMHVIGRRGYELLINNSIDKARYFSKLISEQDDFEVITEPELCILTYRFVPIKVKTVLDKATPEQLARLTPHLNALTRYIQKRQRETGQSFVSRTKLTPAQYHHEPTVVFRVVLANPLTTNEMLQEVLCEQRKIAAKATSLRGALHTEMRELGMLI

SEQ ID NO: 22133 - protein, 97 aa, Zea mays
  misc_feature (55)..(55): Xaa can be any naturally occurring amino acid
  unsure (1)..(97): unsure at all Xaa locations
SERCKIKKWNVVSLWAWHIVRDSCAICRNHIMPLCIECQANQPSATSEERTVAWXVCNHAFHFHCITRRLKTRQVCPLDNTDWEFQKYGHYILGTVM

SEQ ID NO: 22134 - protein, 309 aa, Brassica napus
MASTSLVLTLAPPLFSRRPDSARVALKKKTEPSPSVKFRRRCSGKEEVLLEGMPPEYYDDEWQARQREKTKELRRMQREEEEEEERKIEEYREIGLRLKEFPEEDLRKARKLVSSFITAAEEVEERIEEAAEKGELDELVLMIIWNRLDLARRDDEKDAIRSLDLLYRRVETEILKRQASPAMKLLNDLLNMHDGFGDDAWLKDCRKRMAETFPREDPFSILMPPGFDIDMHQGPLRSLVETDNTLLRVDFVREVDALLHEVRLIEEDEEEAGKKGDPEAIARKLKQQEKKRTIRQVEALLDLALNLKW

SEQ ID NO: 22135 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFSNYKPRTDLPNVVELYMKKELEVEKFITHSVPFAEINKAFDLMA

SEQ ID NO: 22136 - protein, 270 aa, Nostoc punctiforme PCC 73102
MNKTSESRQKKTALITGAASGIGYQLTQIFARHGYNLVLVDKNEQKLTEIINEFPQKFGIFVKILAKDLSIPTSPEEIFRELQQESIKIDVLVNNAGFGTYGAFSETDLSIELQMLQVNMVTLTHLTKLFLKDMVEQDYGKILNVASAAAFQPGPLMAVYFATKAYVLSFSEAIANELEGTGVSVTVLCPGPTASEFQQTAAMEDSKIASVNRMMDTATVAKIGYQGLMKNKTVVVPGMRNKILTESVRFTPRNLVTKVVRSMHELKKNR

SEQ ID NO: 22137 - protein, 293 aa, Zea mays
IIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 22138 - protein, 720 aa, Xanthomonas axonopodis pv. citri str. 306
MTLSRGALPFVLGLLPLAACADPAFDRCLAGLQTQAAAKGVDAASFQRFTAGLAPDSSVLPLLDAQPEFTTPIWDYLASLVDSQRVTDGQAMLVTHRELLSRLSDQTGVDPATIVAVWGVESDYGRVTGKRPLLVSLATLSCAGRRQPFFRGEFLALLSLLQQGDLSADGLTGSWAGAFGQTQFMPSTYARIAVDGDGDGRRDLVTSIPDALASTANYLVKAGWERARPWGMEVTLPRGFDASKAGRTRRQPLQAWQSAGLLGTDGKPLAPTGLPAETPAALLLPAGATGPAFLVFRNYDAIYAYNAAESYALSIALLADRLRGGAGLIAAWPTDDPGLGRPERRELQQLLLARGYQIGEADGMVGSATRRAIQVEQTRLGLQPADGRPGQRILAALRAAPPVAGAAAMRATAFKLPAAYPAFAQSPSVQKASPMSDTTGLTTGDFHGFPSLLIDTPFSTAAISLFGGQLLSFVPEGGQDVMWLSPSAQQPPTPIRGGAPVCWPYFGRQDQAGDVPAHGFVRTVAWQLTESHREDDGTVVLTLTPPRFDDLALRLRMTLRIGRTLEQRLITENTSVAPVRFTQALHNYFRVGDALKVSVQGLDGLDYLDKYENYATAHRQQGDWSLRDPRDPGRSDRIYTNAGGRYTLTDPVLGRRIVIATEGSRSLVAWNPGEDAGKKMADVGEGWRDYVCLEAANAGPDVIELAPGASHTLTQTISVE

SEQ ID NO: 22139 - protein, 356 aa, Zea mays
MERLISTPAASPTQTRIRGPLSLPSRLPAAAAWPRLRCRPGAIALASPLRHEALSAAPEEARSQPPPPAAVGSPWELLGSLLPKACTAALFLLMTVVTSSLHSSLPAYASMQPVAKTGGGGGLFTTEILSSGWAGFLAGCLHTLSGPDHLVALAPLSIGRSRLESGLVGALWGCGHDAGQVIFGLLFLLLKDRLHIEVFRAWGTRVVGLTLLIIGAMGVREASEVQESSLVLEGVDTSSMSSNEPLQPASAPRKKKVGFATFATGIVHGLQPDALLMVLPALALPSRFAGAAFLGMFLVGTVFSMGSYTAFVGSCSEALKEKVPRITEKLTWAASLVAIAMGVALLVGQFFGFSLY

SEQ ID NO: 22140 - protein, 576 aa, Azoarcus sp. EbN1
MPFTMHGLPVSQGIAIGHVHLVSHAMLEVNHYHVASKYLPEEMDRLDEAVATVQGELIGLKAAATAGQSHSEVGAFVDLQLMMLSDPMLVDAARELIEARRCNAEWALVQQMEHVVEQFEQIEDPYLRERKADVVQVVERLVKVLLGHPGHLPPKRRDGLGTIVVAHDLSPSDTIGFRDHNIGGFVTDVGGPTSHTAIVARSLRIPAVVGLHHIRQLVEEDELLIIDGTRGVVIVGPDEHIVEEYRLRRTELEVERSKLNRLKDTRATTLDGENVNLLANIEGPKDLNQVKAVNADGVGLYRTEFLFIGRDALPDEEEQYEAYRAVLKSMPGKPVTIRTFDVGADKALNGVGTRFEPNPALGLRAIRYSLAEPQMFKTQLRALLRASAHGQLQIMIPMLAHAHEIDQTLTLIEKAKVELRAERVKFDERLAVGGMIEVPAAALALGMFIRRLSFLSIGTNDLIQYTLAIDRSDEAVVHLYDPLHPAVLKLISGTIQAGARFGLPVSVCGEMAGDAAYALLLLGMGLRNFSMHPGNILEIKQQVLRADVGELAPRVQRILKMDEQSKIREAVLRLAG

SEQ ID NO: 22141 - protein, 491 aa, Acidobacteria bacterium Ellin345
MRIAIIGGGISGLSAAYTLEKERAKGADVEYTLFESSNRLGGACYSEIVDGCVIEAGPDSFVSEKPWAAALCRELGIGDQLIGSNDNDRKTWIVNKGKLISLPDGLMFLVPTKILPTAFSPLFSWSTKLRMARELMHPPRPMNGDETVAAFVERHFGREMVDRLADPMLSGIYGGDTDQLSVRATLARFVEMEAKYGSLSRAMLVANKKMKAAMAGKPKPPLFTSLRNGMQQMVDAVLAKLPSECLTLNTAVESIEKRDGKYYLTLSSAQGFVSGQRFSAAETAPMENGALAPANAEIFDAIILATPANIAGRLLANIDNHLSEDLAAIPYSSSATVILAYDMADLKSLPGGHGFLVPRTEGRRMRACTFVHNKFPHRAPPDKGVLRCFMGGANDAAILQSSDEEITAIVQRELREIVHLEAQPKLVRVYRWRGAMAQYPLSHLDRVDRIEKAIAAIPGLAVAGNAFRGIGVPDCVRTGTVAAQSVLDHRK

SEQ ID NO: 22142 - protein, 555 aa, Prochlorococcus marinus str. MIT 9313
MSEKMSRHFDRGSFRAVSDVHQLMSFPDFSASDAHVQWQRFNNLLWHHNDLGIWLDISRMHINAEDFERLGPRFDQAFKAMQALEQGAIANTDEQRMVGHYWLRQPQLAPDQEVCDHIAKEIDLIETFGSNVINGLIKAPNGKKFTDVLWIGIGGSGLGPLLMIRALQNAEQGLRFHFFDNVDPDGMSRVLGNLGDALSTTLVVTVSKSGATPEPHLGMEQARQRLEAMGGHWAGQAVAVTMLNSQLDQLAQKESWLKRFDMFDWVGGRTSITSAVGLLPAALIGCDIRAFLAGAAQMDEATRVSDLHSNPASLMAAAWFVAGDGLGRRDMVVLPYRDRLEVFSRYLQQLVMESLGKRLDRDGNVVHQGLAVYGNKGSTDQHAYVQQLRDGVDNFFATFIEVLEDVENIPAINNEHPGDFLDGFLQGTRAALSQGGRQSLTISMRRFDPRRLGALVALFERAVGLYGELVNINAYHQPGVESGKKAAAAILNLQSRVEDLLADGVERSAGEIHQVIGDGSEEAIFWIMRHLTANKRGYVAEGDWGIPTSLRFSKG

SEQ ID NO: 22143 - protein, 343 aa, Neisseria gonorrhoeae FA 1090
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAVSEAGALKGVLGYNTLPLVSMDFNHTTEASHFDATLTKVVDGNMVKVFAWYDNEWGFSCQMLNTARRMFGLEVRPLK

SEQ ID NO: 22144 - protein, 608 aa, Orobanche californica
  misc_feature (598)..(598): Xaa can be any naturally occurring amino acid
  unsure (1)..(608): unsure at all Xaa locations
SGKPFYAIIHRVTGSLIIDFEPVNPHEVPMTAAGALQSYKLAAKAITRLQALPSGSVKRLCDTMVQEVFELTGYDRVMVYKFHDDDHGEVFSEITKPFLEPYVGLHYPATDIPQATRFLFMKNKVRMICDCQANHVKVVQDDNLPFDLTLCGSTLRAPHSCHLQYMENMNSIASLVMSVVVNEGDEDGPDSSSGPNKRERLWGLVVCHNTSPRFVPFPLRYACEFLAQVFAVHVTKELEWENQLLEKNILRTQTLLCDLLLRNTPLGIVSGSPNVMDLVRCDGAVLLHKNTKYRLGLTPTDFQIQDIVSWLDEYHRDSTGLSTDSLYDAGFPGALALGNAVCGMTAARVTDKDWLFWFRSHTAGEVRWSGAKHEPGEKDDGRKMHPRSSFKAFLEVVKTRSLPWRDYEMDAIHSLQLILRNASRENDEKALEGREIQARLNVLQIDGVKEIEAVTSEMVRLIETASVPIFAVDLDGLVNGWNTKIADLTGLGVDEAIGSHFLALVEDSSADTVSKMLELALQGKEEQNVQFEIKTHGQRSESGPITLIVNACASRDVQENVVGVCFIAHDITTQKSMMDKFTRIEGDYRSIIQTRTRXSHLFSEPTSL

SEQ ID NO: 22145 - protein, 472 aa, Coccidioides immitis RS
MAYRLSPVCRASKLSYGNNLFLIHSARHVRAFHVPSESPENLPQTPWDSSKSEAAAAATAVVRPSPPQRILDRMPTASLLRSIMLQTVMSRPRLMDMASTVIHRNVQFLTGNALFRFLLDNMFYAQFCAGRTEAEIRETVEGLRSMGYRGVILAYAREVDLSNSQFQSGTADSDALHKEHVAQWLQGTLRTINYAQRGDYVAVKYTGAGIGCVHALETGQNPDNLMADALEQICASARKQEVKLLFDAEHYVQKAGIDSWTMDLMQKYNRDGQTVVYNTYQMYLKESTATLESHLRMAQEGKFSLGVKLVRGAYINSDPRHLIHDTKEDTDRAFNNAAVMLATQHIDNPSAPKIGLVLASHNKESTEMMRELRQEQLRRGLPLADVVYAQLMGMADELSMSLTQKVPDLEEENNHVFKYVVWGTTQECMMYLLRRAEENRDAVERSSVSKQALWEELRGRLTLPSLLDRRGS

SEQ ID NO: 22146 - protein, 427 aa, Methanocaldococcus jannaschii DSM 2661
MLYNMDERFEIKDIVAREVIDSRGNPTVEVEVITKGNGYGSAIVPSGASTGTHEALELRDKEKRFGGKGVLMAVENVNSIIRPEILGYDARMQREIDTIMIELDGTPNKSRLGANAILAVSLAVAKAAAATAKIPLYKYLGGFNSYVMPVPMMNVINGGKHAGNDLDLQEFMIMPVGATSISEAVRMGSEVYHVLKNVILEKYGKNAVNVGDEGGFAPPLKTSREALDLLTESVKKAGYEDEVVFALDAAASEFYKDGYYYVEGKKLTREELLDYYKALVDEYPIVSIEDPFHEEDFEGFAMITKELDIQIVGDDLFVTNVERLRKGIEMKAANALLLKVNQIGTLSEAVDAAQLAFRNGYGVVVSHRSGETEDTTIADLSVALNSGQIKTGAPARGERTAKYNQLIRIEQELGLSKYAGRNFRCPF

SEQ ID NO: 22147 - protein, 327 aa, Idiomarina loihiensis L2TR
MKRLLPTLRADQTSESLISVINTIQIAAKEISFRLHQGALAGVLGSTLDENIQGETQKKLDVVANQLLKTLLLESPNVHAVASEEEDSIVESPNSGHYLVAFDPLDGSSNIDINGGVGTIFSILRKPEGEETSENMFLQPGKAQVAAGYVLYGPATMLVMTTGKAVRIYTLDQTVGEFLLTHEKAEIPKDTKEFAINMSNRRHWADPIRAYISDLLEGEEGPRGKNFNMRWNAAMVSDVHRVISRGGLFTYPWDARKPEKPFKLRLLYEAAPMAMLVEKAGGKATDGYSRLMEIVPEHIHQRVSVVMGSANEVDVCMDYHKQHPKPY

SEQ ID NO: 22148 - protein, 213 aa, Zea mays
MASSPPLKKVLVPIANGTEPMEAVITIDVLRRAGADVAVASVEPGAAQVAASWGVKLAADALLADLAEADFDLISLPGGMPGASTFGDCKISENMVKKHAEKGKLYAAVCAAPAVALGAWGLLNGLKATCHPSVMDKLPSEVQAVQSRVQIDGNCVTSRGPGTTMEYSVVLVEQLYGKEKADEVAGPMLMRPQHAAEFSMKELNSTSWNVGEN

SEQ ID NO: 22149 - protein, 360 aa, Magnaporthe grisea 70-15
MGYAKNDSKAANASSVEIPFDMPVIDYKGMHGSPEERAKWLKELDRGFQTYGFCYLSNSTISEELLEEAFEWSRRLFALPFETKMKAEHPAYETPYSHRGYAKQGVGHTVQLLFDHDEIEKTKITEPEIKETFELGNGLPNSGLVPNNYVPEEDLPGFRAFHEKWFVECTKLAQSLLKDCGDSLGLTDPELFCKQHSMNDAHISLMHYPEISIEPLHSGKAARLNAHTDYGSLTMLFQGEIGGLEVYDGEVFKPIVPKKGTVILNVGDMLERQSNGRWKSSLHRVVGPRDIMMQEGFDPKGTVVDRYTIVYFCQPDASVMIDTVPGCEEAGAWKPTMVGDWGDKMTSLEWLHKRYLAEFH

SEQ ID NO: 22150 - protein, 341 aa, Coprinopsis cinerea okayama7#130
MANEEPPSTDLITLTRHVLSDQIRLGSSATGDLTLLLNAIQLTSKFIATNVRKARLINLVGLAGETNVQGEEQKKLDVLSNDIMVNALRASGKTAVLVSEELDEAIFIDDPYKGKYCVVFDPLDGSSNIDAGVNIGTIFGIYKVQPESTGTIEDVLRPGREMVAAGYTMYGSSCNLVMSTGNGVNGYTLDAALGEFILTHPNITIPPRGKIYSFNEGNSMYFYPPTTAYLKSIKYPANNKSPYSARYIGSMVADVHRTLLYGGIFGYPSDKKSKSGKLRLLYEAFPMAYLTEQAGGIATTGTQRILDITPKTIHERCPVFLGSRDDVQELMRFYKEVPLEG

SEQ ID NO: 22151 - protein, 200 aa, Clostridium acetobutylicum ATCC 824
MIIKQAEFIISAAWKKQFPIDGKDEIAFVGRSNVGKSSLINAITNRRKLVKVSGTPGKTRLVNFFMINNDFYFVDLPGYGYAKVSKKELEKWSQTIEGYLVGREQLKKVILLVDSRHKPTKDDITMYNWIKYYDYKCIVIATKSDKIKRSEKVKNEKLIKETLKFNDSDEFYFFSSATKQGRDELINNICSGINYSENSL

SEQ ID NO: 22152 - protein, 717 aa, Burkholderia xenovorans LB400
MTSTSRRRFLQTVASSAGAAAALTALPESIRNALAVPAFSRTGTIRDVEHIVVFMQENRSFDHYFGHLRGVRGYNDRFPIPLSSGKPVWYQPSKENPAQPVLPFHLDTATTSAQCVGDLDHSWYKTHAAIDGGRYDQWPANKTDMTMGYHLRSDIPFHYALADAFTVCDAYFCSLPGPTHPNRAYLMTGMVDPSGTLGGPLLDNNDFVDGDGPPNYQLLSWTTYPERLQAAGISWQVYQQGLTGSDPLNGNYGTNILQNFTNFINAQPGSPLYERAQTVRTIDDLKADVLANKLPQVSWLCPPAAYSEHPSYTPAYGAEYTSQILDALTSNPEVWSKTVLFIMYDENDGFFDHLVPPQPATTAAQGQSTVSTEGEIHNVVNPLRGGSYTADGLPYGLGPRVPMTIVSPWSKGGFVCSQVFDHTSVIRFIEARFGVYEPNITAWRRAVCGDLTTAFDFRTPDSKVPPLPDTSNYKSIADNQCATQPKPTVPATPGAIDPQESGIRFARALPYELHVNGHADAKKNTFELSIGNTGDQGAHFYVYSTNRTDGPWRYTVEAGKSLSETFDLTVTSGAYTFEVFGPNGFVRKFAGNTQQPKAHNAPFGGGHGNNKPAEPEVKVQYDVANGNVFLKFSNKGGGIARLTVTDNAYGARPRPVLVPAGAQIEEAWVLASSHHWYDLTVTSNDDASFSRRLAGHVENGRPSISDPAAVAPVLVAI

SEQ ID NO: 22153 - protein, 416 aa, Dechloromonas aromatica RCB
MNPFTPATIAPLAQQFGTPLWIYDADTITRQIAALRLFDVVRFAQKANSNTHILRLMKRQGAVVDSVSLGEIERALAGGFTPGLHNGDADIVFTADLLDRATLARVVELNIPVNCGSMDMLDQLGAVNPGHPVWLRINPGFGHGHSKKTNTGGEHSKHGIWHGDLVRACEKIKANGLALQGLHMHIGSGVDYAHLQEVCGAMLKLVEVVNAQGLDLHAISAGGGLSVPYQAGEPTIDTAHYFSLWDAVRHAVEQLLEHPVKLEIEPGRYLMAESGVLVTEVRATKQQGANHFVMVDAGFSDLVRPALYGAYHGMELIHSDGTAVNGLQFDTVVAGPLCESGDVFTQGDGGVLLHRSLPQAQVGDLLVLHDTGAYGASMSSNYNARPLIAEVLMENGEPRLIRRRQTVAELLALEAV

SEQ ID NO: 22154 - protein, 220 aa, Arabidopsis thaliana
FVDFPFQFLLQPAIKLPNKTISDRRNITKDSSPSDLPSIRFFSFLILLHCSISAQNEGITKACGCPLLPLKSHIKGPAPISEQDKTDIVDEAITFFRANVFFTNFDIKSPADKLLIYLTFYINVALKRLEGCRTLAVGTKAIINLGLEDIPVPGETGFPFPGLFSLPQSQDEAELFRNYLKQVREETSGRLLSVAYRANGTPNKWWLAFAKRKFMNVVVL

SEQ ID NO: 22155 - protein, 585 aa, Triticum aestivum
RRRPFSSATPDHGPPLSRRPGMSVRGDPAAAAPGVETAEELLARVRGMVPPAVGAATAAEGFPGRWKAIAAKLGTLPARLSDLSSHPCFARNALCRELLHSVAATLADAAELASRCRGPPRDGKLQTQSAIDALGARLDVNLRDCALLVRTGVLSDSDASAVAAPATAQADVRELLARLQIGHAEAKTRAVDGLLDALNRDEKSVVSVLGRANLSALVQLLTAPAPKAREKAAMVICRLAESGGGACEGLLVSEGALPPLIRLAESGSSLVGREKAVLTLQRLSASPDVARAIAGHGGVRPLLEICQTGDSVSQSAAAGALKNLSAAPEARQALADEGIVRVMVNLLDYGTVLGSKEHAADCLQNLTSGGDSFRRAVAHDGGLRSLLLYLDAPSPQESAVRALGNMVDAISPDTIVSLGVLPRLAHALRAGSPGAQQAAATAICRISASGSRDMKRLVGEHGCIPLLVRMLDAKSAGAREAAAQAVASLAAGHPGNAREVRRDERSVPSLVQLLEPSPANTAKKYAIACLATLSPAKRCKKLMVSHGAIGYLKKLSDMEVAGARDLLERLQERGKLRSIFGSKNQ

SEQ ID NO: 22156 - protein, 411 aa, Rickettsia mongolotimonae
DSEFAELKIRGKIFKLPILKASIGEDVIDISRVSAEAGCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPR

SEQ ID NO: 22157 - protein, 175 aa, Triticum aestivum
MPPPVMAWSATSVAPLQGLESTGVLPVSRRSNGDSLDSVSNGGRIMCMQVWPIEGIKKFETLFYLRPLSTEALLKQVDYLIRSKWVPCLEFSKVGFIFREHNASPGYYDGRYCTMWKLPMFGCTDATQVIHEVEEVKKEYPDAYVRIIGFDNMRQAQCVSFIAFKPPGCEESGKA

SEQ ID NO: 22158 - protein, 219 aa, Azoarcus sp. EbN1
MHEIDQLFTNNRNWSERIRGEDPAYFRRLANQQSPQYLWIGCSDSRVPANQIIGLAPGEVFVHRNVGNVVVHTDLNALSVIQYAVDVLQVKHILVVGHYGCGGVSAALNNSRLGLIDNWLRHVQDVRDLHETMLAAIEDPLQRINQLCELNVMQQVVNISQTSVLREAWERGQPVMLHGWCYGLCDGLVRDLGVSATCRSEALERYRDAVNAALRTKPR

SEQ ID NO: 22159 - protein, 608 aa, Orobanche corymbosa
SGKPFYAIIHRVTGSLIIDFEPVNPHEVPMTAAGALQSYKLAAKAITRLQALPSGSVKRLCDTMVQEVFELTGYDRVMVYKFHDDDHGEVFSEITKPFLEPYVGLHYPATDIPQAARFLFMKNKVRMICDCLANHVTVVQDDNLPFDLTLCGSTLRAPHSCHLQYMENINSIASLVMSVVVNEGDEDGPDSSSGPNKRERLWGLVVCHNTSPRFVPFPLRYACEFLAQVFAVHVTKELEWENQLLEKNILRTQTLLCDLLLRNTPLGIVSGSPNVMDLVKCDGAVLLHKNTKYRLGLTPTDFQIHDIVSWLDEYRRDSTGLSTDSLYDAGFPGALALGNAVCGMTAARVTDKDWLFWFRSHTAGEVRWSGAKHEPGEKDDGRKMHPRSSFKAFLEVVKTRSLPWRDYEMDAIHSLQLILRNASRENDEKDSEGREIQARLNELQIDGVKEIEAVTSEMVRLIETASVPIFAVDLDGLVNGWNTKIADLTGLGVDEAIGRHFLALVEDSSADTVSKMLELALQGKEEQNVQFEIKTHGQRSESGPITLIVNACASRDVQENVVGVCFIAHDITTQKSMMDKFTRIEGDYRSIIQNPNPLIPPIFGTDEF

SEQ ID NO: 22160 - protein, 906 aa, Burkholderia xenovorans LB400
MTDLSDGALQLRSLERGHEDSDPEETAEWLEALDAVAAHVGRDRAQYLFDRLAAHALSLGVESSRTRVTPYINTIGFNEQPRYPGNLELEERLAAALRWNALAMVVRANKAYGELGGHIASYASAADLFEVGFNHFFRASNQQAGEGSGGDLVYFQPHSSPGVYARAYLEGFLGEEHLQHYRREIAGPGLCSYPHPWLMPDFWQFPTGSMGIGPINSIYQARFMRYLQNRGLAQTEGRKVWGFFGDGEMDEPESLGALSLAAREGLDNLVFVINCNLQRLDGPVRSNGRIIDELEAHFNGAGWNVIKVVWGSDWDALFARDRTGALMRAFAHTVDGQFQTFSANDGAYNRERFFGQNPELAALAAQLSDEEIDRLRRGGHDVRKLHAAYAKALSHRDQPTVILAKTMKGFGMGTSGQGRMTTHQQKKLDFDDLKAFRDRFRLPLSDEDVEQVKFYKPAEDSPEMRYLHARRAALGGYLPRRRRVASKGLTVPSMQTWAQFALEANGREMSTTMALVRMLTALLKDAEIGQRMVPIVADEARTFGMANMFRQVGIYSPLGQLYEPEDLGSMLYYREDTNGQILEEGISEAGAISSWIAAATSYSVHDLPMLPFYIYYSMFGFQRVGDIIWAAADQRARGFLIGATSGKTTLGGEGLQHQDGTSHLAASTIPNCRAYDPALAYEVAVIVDEGMREMVERQHDVFYYVTVMNENYAQPSAPPGVTQALREGILKGIYPLSSERKATARVQLLGAGAIFGEVLAAQQMLQDDWNIEAAVWSVTSFTELQRDGIACERHQRLGDMSDVPYVTAALGMSHGPIIAATDYVRAVPELIRAFVPRRYVTLGTDGFGRSDTRQALREFFEVDRASIVIAALKALADEAVLDAMTVAHARQRYGKSADDAIAPWQK

SEQ ID NO: 22161 - protein, 799 aa, Gibberella zeae PH-1
MAPSLFRKRHEAEDIIPIPGPLETVSASGRDYLENLQQFEKSHKFDPNLPIDDLTDVDAAIATGNAEKGIEIEHALMEDNSPYPEVRSVVRNYDVDVPANTIRAWVIGMVLCTIGSGVNMLFSLRNPSVTVTTYVVQLVAYPLGLGWDLIMPDREWNLFGLKFNLKPGKFNYKEHVVIVAMSNAAYGGGVLYATDVLLAQQIFYGQEFGWAFQILFGITTLCTGYGLAGLARRFLVWPAAMIWPTDLVNCALFYTLHDHSGSDPTKTNGWRMGRYRWFLIVGCGGFVWYWFPGWIFKGLSYFTWVCWIAPHNVTVNKLFGGMTGYGLMPTSFDWTVYSGYLQSPLIPPFHAIANVLVGIIVFFICISMGIHFTGTWYADYFPVQSSESYDNTGAIYNVSRILDSNFHFNETAYKEYSPLFLPTQFALSYGLSFAAVTAVVVHVVLYHGHEIWRQFKLARNQEDDVHMRLMKKYRDAEDWWYAALFVVMVAISIGVIAGWPTGFPVWAYFICLLIPVLWLIPIGVVQAITNIQLGLNVLTEFIIGYMVPGRPMAMMMFKNYGYICMGQALYFAQDLKLGHYMKVPPRVMFSSQLVASIWSAIVQICVMNWALGHIPDVCAIDQPNNYTCPGGRVFYTASVIWGAIGPSRIFSHGAIYSSLQWFWLVGAVTPIITWLLARKWPRSIWRYVSTPLIYGGAGMLPPASVYIYLCWGIVGAFFNRFVKRRYTGWWLQYNYVTSAALDCGLIMSTMVIFFTLYLTSASPPNWWGNYGAMETMDWKTHAISKSVPEGTIIGPSTWN

SEQ ID NO: 22162 - protein, 406 aa, Oryza sativa (japonica cultivar-group)
MTNQRRYKIPPPPPDHHSHSHTQHPSSSDLEIDAFHRHAADLLHDLLSDSNSDPSAPDLLSLAWTRRLLDSFLICLEEFRAILFALADSQPLSRPPLDRLLLDFLDRAVKALDLCNALRDGLDLIRQWRKHLAIAAAALAPAPAAQRGEAQIRRARKALTDLTILMLDDKDAGGVVGQRNRSFGRAGTTRDSLPHGHGHHRRSSSGGSSGSGSGSHLRSLSWSVSRTWSAARQLQAIGGGLTVPRANDIAATGGLASAVYAMGAVLFVVTWALVAAIPCQDRGLQAHLTAVPRTFPWAGPLITLFDRILDESKKKDRKHSCGLLKEIHQIERCSRQLMEVTDAAEFPLADDKDSEVQEATQELVQVCGSLKDGLDPLERQVREMFHRVVRTRTEILDYLSRPHNAG

SEQ ID NO: 22163 - protein, 350 aa, Listeria monocytogenes str. 4b H7858
MTYKITSLAGDGIGPEIMTSGLQVLEAVAKKYNHTFEIESHPFGGAGIDVAQDPIPSSTLKACRDADAILLGAIGGPKWDNAPKRPEDGLLALRKALGLFANIRPIQVPSSITHLSPLKKEIVENTDFVVVRELTGGLYFGEPKYWDNEAAVDSLTYTRAEIERIIEKAFEIAATRNKKVTSVDKANVLASSKLWRKIADEVASRHPDITLEHLYVDAAAMLMIQRPTTFDVIVTENLFGDILSDEASVITGSLGMLPSASHAENGPSLYEPIHGSAPDIANQNIANPMSMISSVSMMLRQSFSLFEEADATDAATARTMQAGFLTADLGGNTSTTDFTNEVLKQIEGGE

SEQ ID NO: 22164 - protein, 237 aa, Medicago truncatula
MYNQISSPSSQRTNSPNINMRSNFDAESQYLMELLSEHQKLGPFMQVLPLCSRLLNQEILRVSGKNGLLQNHQGFNDFDRMQFMNQSHMASSDLKPNFTGWNSLSHDMLAEVKGLNMDWQTAPVVPNSHIVKKILRLDIPKDGYPNFNFVGRLLGPRGNSLKRVEATTGCRVYIRGKGSIKDLDKEELLRGRPGYEHLSDELHILIEAELPANIVDVRLRHAQEIIEELLKPVRIIC

SEQ ID NO: 22165 - protein, 502 aa, Zea mays
  misc_feature (147)..(147): Xaa can be any naturally occurring amino acid
  unsure (1)..(502): unsure at all Xaa locations
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHNSYLTGNQLNSDSSDVPIVKALQXDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLPVKKTLKVKVYMGDGWRMDFSKTHFDAFSPPDFYTRVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 22166 - protein, 289 aa, Methanocaldococcus jannaschii DSM 2661
MFKGVYPAIITPFKNKEVDFDGLEENINFLIENGVSGIVAVGTTGESPTLSHEEHKKVIEKVVDVVNGRVQVIAGAGSNCTEEAIELSVFAEDVGADAVLSITPYYNKPTQEGLRKHFGKVAESINLPIVLYNVPSRTAVNLEPKTVKLLAEEYSNISAVKEANPNLSQVSELIHDAKITVLSGNDELTLPIIALGGKGVISVVANIVPKEFVEMVNYALEGDFEKAREIHYKLFPLMKAMFIETNPIPVKTALNMMGRPAGELRLPLCEMSEEHKKILENVLKDLGLI

SEQ ID NO: 22167 - protein, 202 aa, Roseovarius nubinhibens ISM
MSEALKELGAYIEAKRSDCVLSWEVVHGELTVDVALANITGLVEFLRNDQTCRFSTLVDITAVDYPARPKRFDVVYHFLSMYQNHRIRLRAAVREEDMVPSITDVHPSANWFEREVFDMFGILFSGHPDLRRILTDYGFRGYPLRKDFPTTGYTEVRYDEALKRVVYEPVSLVQEYRQFDFMSPWEGAEYILPGDEKQEEAK

SEQ ID NO: 22168 - protein, 407 aa, Roseovarius nubinhibens ISM
MMDGSKGFQDALTGEQKIRNFNINFGPQHPAAHGVLRLVLELDGEIVERCDPHIGLLHRGTEKLMESRTYLQNLPYFDRLDYVAPMNQEHAWCLAIEKLTGVEVPRRASLIRVLYSEIGRILNHLLNVTTQAMDVGALTPPLWGFEEREKLMVFYERACGARLHAAYFRPGGVHQDLPEDLIDDIETWAKAFPNVLADIDGLLTENRIFKQRNADIGVVTEKDILDWGFSGVMVRGSGLAWDLRRAQPYECYDEFEFQVPVGKNGDCYDRYLCRMEEMRQSLHIIHQAIEKLRAPDGKGDILARGKITPPKRGEMKTSMEALIHHFKLYTEGFHVPEGEVYAAVEAPKGEFGVYLVSDGSNKPYRSKIRAPGFLHLQAMDHVAGGHQLADVAAIIGTMDVVFGEIDR

SEQ ID NO: 22169 - protein, 419 aa, Aspergillus nidulans FGSC A4
MAYHKRPTSSYQPCDSYFVESYDDFTVPRMDPKEHAKLVARERQYAMADELSRVTSEEYRDDILSHMLDMDASTLPDVESIDIQTEIQWFMRPYLLDFLIEAHTAFQLLPSTLFLTVNLLDRYCSKRVVYKRHYQLVGCAALLIAAKYGDKKDRVPTIRELKSMCCSLYDDDMFIQMEWHVLQTLGWTIGHPTVDSFLQTAVMDTPYDPEVEHLALYIAEISLFHREFVSKPSSDLARASLALARCILNRPQPRHTEWASQYDSMTLVGLSQQLHQPSQVLARKYSSSHYSRVSKILEQFLARQASIASYTPPSPPSDVVNSESKPYEGEIGLATPQKAPHPTNMPHGYITPPITPENEAFVNGNAGYVKAVPVPSACSPSPTPSPSVQYVTHNPYQQESNYVTQQQYLQPQMSFTSGY

SEQ ID NO: 22170 - protein, 69 aa, Brassica napus
PLSHQCVGQRYALNHLVLFIAMFSTLLDFKRLRSDGCDEIVYCPTISPKDGCTVFLSRRVAAYPYLTLN

SEQ ID NO: 22171 - protein, 142 aa, Glycine max
VAFTEKQDALVSSSFEAFKANIPQYSVVFYTSILEKAPAAKDLFSFLANPTDGVNPKLTGHAEKLFALVRDSAGQLKASGTVVADAALGSVHAQKAVTNPEFVVKEALLKTIKAAVGDKWSDELSRAWEVAYDELAAAIKAK

SEQ ID NO: 22172 - protein, 204 aa, Bacillus cereus
  misc_feature (53)..(53): Xaa can be any naturally occurring amino acid
  unsure (1)..(204): unsure at all Xaa locations
EKIRKKLLEDSESKTLKKRWAHFDLTMLGIGAIIGQEYLVLTGLVASRDAGPXSIFSFMIAAIVCGFAALCYAEIASTLPVSGSVYTYSYATIGEFVAHLMGWTLLSVYIVTTAAVAGGWTGYFHNLLNGFGFEIPRSLLTIPTQGGIVNLPAVIITLLLTWLLSKGTKESKRVNNAMVLIKIGIVVLFISVGIFYVKPENWID

SEQ ID NO: 22173 - protein, 1111 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIEKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVELEFRIIHPAPGLPEDLVREMFQPLRKGTSREGLGLHITQKLVKLMERGTLRYLRESEMSAFVILTEFPLI

SEQ ID NO: 22174 - protein, 312 aa, Acidobacteria bacterium Ellin345
MAIPVTELIWHNGKMIKWDDAKIHVLSHVVNYGSSLFEGIRCYETKSGPAIFRLKEHMQRLLNSSKIYRIDVPFSVDELCNAAVELVGANKVSPCYIRPIVLRGYGELGVNPIGCPTEVYMANYAWGKYLGHGGPDDGVDVCVSSWTRFAPNTLPALAKAGANYMNSQLIKMEAILNGYSEGIALDANGYVSEGSGENLFIVRDGKIITPPLGNSVLPGITRDSVIQIADSLGIEVKEQIIPREMLYVADEVFFTGTAAEVTPIASVDKIQVGTGKAGAITKTIRKEFFALIHGEVEDRFGWLTPVKQPVGA

SEQ ID NO: 22175 - protein, 417 aa, Arabidopsis thaliana
MAASAATTTSSHLLLSSSRHVASSSQPSILSPRSLFSNNGKRAPTGVRNHQYASGVRCMAVAADASETKTAARKKSGYELQTLTGWLLRQEMKGEIDAELTIVMSSISLACKQIASLVQRAGISNLTGVQGAINIQGEDQKKLDVISNEVFSNCLRSSGRTGIIASEEEDVPVAVEESYSGNYVVVFDPLDGSSNIDAAVSTGSIFGIYSPNDECIVDDSDDISALGSEEQRCIVNVCQPGNNLLAAGYCMYSSSVIFVLTLGKGVFSFTLDPMYGEFVLTQENIEIPKAGRIYSFNEGNYQMWDDKLKKYIDDLKDPGPTGKPYSARYIGSLVGDFHRTLLYGGIYGYPRDAKSKNGKLRLLYECAPMSFIVEQAGGKGSDGHSRVLDIQPTEIHQRVPLYIGSTEEVEKLEKYLA

SEQ ID NO: 22176 - protein, 145 aa, Prunus dulcis
KKIGNAFDNRIDAKRTLREIKLLRHMDHENVIAIKDIIRPPQKENFNDVYIVYELMDTDLHQIIRSNQPLNDDHCRYFLYQLLRGLKYVHSANVLHRDLKPSNLLMNANCDLKIGDFGLARTTSETDFMTEYVVTRWYSAPEILL

SEQ ID NO: 22177 - protein, 294 aa, Prunus dulcis
MDQYEKVEKIGEGTYGVVYKARDRITNETIALKKIRLEQEDEGVPSTAIREISLLKEMQHGNIVRLQDVVHSEKRLYLVFEYLDLDLKKHMDSTPEFAKDPRQIKMFLYQILRGIAYCHSHRVLHRDLKPQNLLIDRRTNSLKLADFGLARAFGIPVRTFTHEVVTLWYRAPEILLGSRHYSTPVDVWSVGCIFAEMVNQRPLFPGDSEIDELFKIFRIMGTPTEDTWPGVNSLPDFKSSFPKWLAKDLATAVPNLESAGVDLLSKMLCLDPSKRITARTALEHEYFKDIAFVP

SEQ ID NO: 22178 - protein, 434 aa, Oryza sativa
ASARAHLQARGVTIYWCSRQKVAWSATGCTLLISLLFFFSDSPHRILLNKKPLNFKTAPSRLLREISISSSRVQRVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSDGCWHTPQVADEQDEVPMWNPVLFQLPSHELLLFYKIGQEVQKWSGAMKRSLDGGKTWSAREQLPPGILGPIKNKPFLVEDGRLLCGSSVESWNSWGAWLEVTKDAGQTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMTLEDTEGMEFSYPAVIQTMDDLIHITYTYNRTQIKHVVLQPSGKVRW

SEQ ID NO: 22179 - protein, 301 aa, Bacillus anthracis
GSSHHHHHHMIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMIAAFQAGEFKKAQKLHQLLVRVTDSLFMAPSPTPVKTALQMVGLDVGSVRLPLLPLTEEERVTLQSVMQSIPR

SEQ ID NO: 22180 - protein, 443 aa, Yersinia pestis CO92
MWFFLKSRDNVPLVTDQTQIDSSYKYWRIQLMWTMYIGYAAFYFTRKSFNFIMPAMLTDLGLSMSDVGILGTLFYITYGCSKFVSGMISDRSNPRYFMGIGLVMTGIINILFGMSSSLLVLGALWILNAFFQGWGWPPCSKILTSWYSRSERGGWWAIWNTSHNFGGALIPLLVGVITLHFSWRYGMIIPGIIGVVIGLLMCWRLRDKPSTMGLPSVGKWRNDAMELIQESEGQGLSNKEIVKRYVLTNKYIWLLAVSYVLVYIVRTAINDWGNLYLTQEKGYSLLTANSAISLFEVGGFIGSLVAGWGSDKWFRGNRGPMNLIFAIGIFLSVASLWTLPSISFVLQAGCFFAIGFFIFGPQMLIGMAAAECSHKDAAGAATGFVGLFAYLGAALSGYPIARVMEIWHWNGFFVVISVAACLSAFFLLPFLRAQSPQLKQATT

SEQ ID NO: 22181 - protein, 787 aa, Kluyveromyces lactis NRRL Y-1140
MTTDSVPRKNISQAIKLVFLRRKAQERNEAGSSEVPTGGKSNNASATSSPEEALENSGENFELTNFASLSEMESEIFLAPPAKQSKKISILVGMFVAVGGFLFGYDTGLINNISEMPYVNQKFAPNKNHFTTPQISILVSFLSLGTFIGALLAPLISDSYGRKTTMIFSTFVVFMIGNSLQVAAGSMTILVVGRVLSGMSVGLISAAVPLYQSEAAQKSVRGAIISCYQWAITWGLLVASAVSQGTYKRMDASSYQIPIGLQYIWSFLLGVGILFLPESPRYYVFKDRLDKAAKSLSFLRGVPEDDSGLLEELVEIKATYDYEMSFGKISYLDCFRSTRSRTKQRLRMLTGIALQAFQQVSGINFIFYYGVDFFNKSGVSESYLVSFVTYAVNVAFNIPGLFLVEYIGRRKLLLMGGILMTISNFIIAIVGLATDSMVANKVMIAFICLFIASFSATWGGGVWVISAELYPLGVRAKCTAICAASNWLINFICALITPYIMHIDSSVRQTSIGTKIFFVWGSLNAVGVLVVYFTVYETNGLSLEEIDELYKKSSSGINSIEWNKKIKAFPDLFQRTRPNNEGDGEADDNIHTDENYNHTISSYNGTQNNEKYPIQVQMPQFGVRNIEFLNTTGSSPQSDMTEPNFVDLGNGLGITTYQRGPPSVLTDSSEEEEEGQQQETDETEEGKSFKHQYTDARNKNRGERGSFNSNSSTSGTTRSSSHKASVQRMEEINLYMAQLMHRGGTEDLSRNTTDNTHQPISHDIMSQWNSSSQNKGPSTQTDINSNT

SEQ ID NO: 22182 - protein, 467 aa, Yersinia pestis CO92
MKNDSSTLKRGLSARHIRFMALGSAIGTGLFYGSAEAIRLAGPAVLLAYLIGGAAVFMVMRALGEMAVHDPVAGSFGHYASRYLGPLAGFLTGWTYTFEMVVVALADVTAFGIYMGLWFPDAPQWVWVLSIIFFIGALNLCSVKVFGEMEFWLSLLKVAAIIAMIAAGLGIMMFGFGAGHDSTGVSNLWAHQGFMPNGITGVIASFAVVMFAFGGIEIIGVTASEAKDPGKVLPRAINTVPIRILLFYVLTLFVLMAIYPWNSIGQNGSPFVEIFSSLGINSAANILNLVVITAAISAINSDIYGAGRMMYGLAQEGLAPKSFSRLTRNGVPYMTILVMAITLLCGVVLNYLIPKNVFLVIASIATFATVWVWLMILVSQVAMRRSMSKAQVARLAFPVPFWPLAPILTILFMAFIIAVLGYFPATRIAMYVGLAWVALMTLAWWIWLRKAPSCVIQERAKSSEMPS

SEQ ID NO: 22183 - protein, 532 aa, Triticum aestivum
  misc_feature (178)..(178): Xaa can be any naturally occurring amino acid
  misc_feature (181)..(181): Xaa can be any naturally occurring amino acid
  misc_feature (217)..(217): Xaa can be any naturally occurring amino acid
  unsure (1)..(532): unsure at all Xaa locations
MEVAVAATTLGVGGDVSSPSSLSLLCGLSALLVLLWALSRAAETCWLRPRRLSRALRAQGLGGTAYRFPAGDLADNGRLNEEARSKPMPPCHDIVPRVAPHLLNIVKEHGNVCITWFGPVLRMVIAEPKLVREILSDKSGHFEKFTNKRLGKLIALGLASYDGEKWATHRRVCVCARXLKXLQSMLPAFSTCCTELISSWESKLAGSDGSHEIDIWXDFQNLTGDVISRTSFGSSFMEGRRIFQLQAEQAERIIKAFQYMYIPGYLFFPTENNKRMKQINREIEGLLRGIIEKRERAMENDGLSSGNDLLGLMLQSNKESGASRMRMSTEDVIEECKLFYFAGMETTSVLLTWTLVVLGMHPEWQDRAREEVLSVFGKDKPNFDGLSRLKTVTMILYEVLRLYPPAVTLNRKTSRQMQIGGITYPAGVLLELPIIMVHHNPDVWGKDVLEFKPERFAEGISKATKDQPVFFPFGWGPRICIGQNFAMLEAKMALSMILQRFEFQLSPSYTHAPYTVITLHPQHGAQIILKSL

SEQ ID NO: 22184 - protein, 164 aa, Roseovarius nubinhibens ISM
MANIDYGRAAGYFLLSDFVKGFKLGLKYFFAPKTTLNYPHEKGPLSPRFRGEHALRRYPNGEERCIACKLCEAICPAQAITIDAEPRDDGSRRTTRYDIDMTKCIYCGFCQEACPVDAIVEGPNFEFATETREELFYDKERLLDNGDRWEAEIARNLEMDAPYR

SEQ ID NO: 22185 - protein, 202 aa, Coprinopsis cinerea okayama7#130
MTSLTVKLLLAVHYPSAYPDVLPELKLSAVEGEISEKEIEALMKDLHAIGEENLGMAMTFTLVSHLREQLTNLARSNKAEKARLEAEMERLALEEEEARTRGTPVTVDSFKAWKAKFDKEIAAAKAREEEEKLKGLTPKEREEYKRAQLRLTGRQLFERNRNLDERDEGLIEEGTTSVDISQYDRTQEDEEQEEGLTFSDSD

SEQ ID NO: 22186 - protein, 332 aa, Aeropyrum pernix K1 [sequence omitted]

SEQ ID NO: 22187 - protein, 245 aa, Aeropyrum pernix K1
MEAVWESARILANSRFAVAFTGAGISAESGIPTFRGKDGLWSRFDPRDLATPEAFNRDPRLVWEWYSWRIERVLAAKPNKAHRLLARLEDSGVLKAVITQNVDGLHRRAGSRRVLELHGNVLRARCTRCGSKLEWREKPSNLPPSCPRCGGVLRPDVVWFGEPLDTSLLEEAFGLARRSDVMIIIGTSGAVDPAGLLPLAAKESGATLINVNPEPNRYSGVADIELRMRAVEFAERLSRAMGIDI

SEQ ID NO: 22188 - protein, 334 aa, Xylella fastidiosa
MIPNPTRDAPNIPSFVAADVGGTHVRVSVVAAAPTCASPPQLLDVRTYRCADYPSLSTILNDFLGTRSAVRDCVIASAGFQRSDGTVITTNLPWPLSPHRLRADLDLAEVSLVNDFEALAYATEDMEAAQLLHLTGPAKAQDGPRLLLGPGTGLGAALWIPNNGRPIVLPTEAGQAALPSTTELEMQLVRHMLNNRTHVPIEHALSGPGILNVYRALCALQSVLPQHASPDAISHAAAAGTDMLSSQTLEVFCDFLGSIVGDLVMMYGAQGGVYLAGGILPQLREPLLRSHFVERFLNKGPMGEALQHVPVRLIEHGQLGIVGAARWYLNKKAT

SEQ ID NO: 22189 - protein, 103 aa, Glycine max
MSGRGKGGKGLGKGGAKRHRKVLRDNIQGITKPAIRRLARRGGVKRISGLIYEETRGVLKIFLENVIRDAVTYIEHARRKTVTAMDVVYALKRQGRTLYGFGG

SEQ ID NO: 22190 - protein, 869 aa, Oryza sativa
RVADSCGLLCGRRSRPFRAMASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYTVSQTEINERMRAILTDWLIEVHYRLMLMAETLYLTVYIIDQYLSLENVPRKELQLVGVSAMLIACKYEETWAPLVKDFLVISDNSFSRQQVLSTEKSILNKLQWNLTVPTMYMFILRYLKAALGDEEQEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKTNRYIWVFANAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 22191 - protein, 185 aa, Oryza sativa (japonica cultivar-group)
MLNESMGEGDAAYAKRVLLTAAGDDVSRGIASTLATHGCRLVLVGDEGALAGTAEEARRGGGGGDAVAVVGLDLHGCDEAAVDAAVGTAWRCFDGLDAMVNCYSYEGEVQDCLNISEDEFKKTMKANVMTPWFLVKAIAKRLRDSESSCGGSVVFLTQIIGAERGLYPGAAAYGTSLGAIHQLVR

SEQ ID NO: 22192 - protein, 490 aa, Mycobacterium tuberculosis H37Rv
MTRITRANGCPDGTLENAVVALDGGANYPREILGNKGHGIDMMRRHHLPVPPAFCITTEVGVRYLAAPGSTIAAIWDDVLDRMSWLETETSCTFGRGPNPLLVSVRSGATQSMPGMMDTILDVGMTDAVERVLARPGAADFAHDTRRRFTSMYRRIVGSAGPITDDPYAQLRASIEAVFASWNSPRAVAYRDHHGLDDQGGTAVVVQAMVFGNLTANSGAGVLSSRNPITGANEPFGEWLPGGQGDDVVSGLVAVAPITALRDQQPAVYDQLMAAARSLERMAGDVQEIEFTVEDSQLWLLQTRGAERSAQAAVRLALQLHHEGLIDDTETLRRVTPTHIETLLRPSLQTETRLAAPLLAKGLPACPGVVSGTAYTEVDEALDAADRGEPVILVRDHTRPEDVMGMLAAQGIVTEVGGAASHAAVVSRELGRVAVVGCGPGVAAALAGKEITVDGYEGEVRQGVLALSAWSESDTPELRELADIAQRISS

SEQ ID NO: 22193 - protein, 407 aa, Idiomarina loihiensis L2TR
MLKLSNFGPGALVAAAFIGPGTVVTASLAGANFGYALLWALLFSVVACVILQEMSARIGLVTQAGLGENIRNNLTSGWLRWLALLLIFSAIAIGNSVYQGGNLSGASLGASELLGPVPVLDVWLSNAWALIIGIIALLILWSGNARVIERALIVMVLLMSVAFIGTFLLTDPDWGAVFNGTFGFSMPTGATLTVVALIGTTVVPYNIFLHASSVSKKWKTAEELPAARRDLFLSIPFGGLISMAIVATAASAFFGQQVEIESAGDLAESLRPLFGDGATYLMAIGLFAAGISSATTAPLASAYALCGIMGWSVNLRSRAFRIIWFTILVIGIIISSVGIKPVTVIWFAQVANGILLPIIVGFLWWLCQSPLLGKYRNSLLQNILAAIIFLISVVLSGRSLGSAFGFW

SEQ ID NO: 22194 - protein, 251 aa, Zea mays
MSLPAISMYTSPPGAVYSSEFDPASRGSSPCTTAAPPPPAASYRLPSGGGGLSCLFSSPAAAAAPPRAPAHDDLGALWHNRSDDLSVPADGGGYSYSHSHSHSSSQLKRRDLHHHHHSPVSVFQGPSTSSPSRSPPASWLAARDRDRLFAGFVRNALGSCVDYAPPTSPRPEVGAGELAFELDENLAEASPACEPYARELLASAQDRHRIFHEELVVKAFLEAEKAHRGQTRASGDPYLQHCVETAVLLAK

SEQ ID NO: 22195 - protein, 766 aa, Vibrio fischeri ES114
MTFRLKTIIGISIIQCIMLLILVFSSVKFISDSNEQRLIARANASVHMFSNAIKDSILNNQYDKVASLMDDFITLEKICYIRIFREDGSLIVEGGPKLHEVANPDSSILHNASDGTYDVILPIITNDKTLGKVEIGFGTHGENTFLSQAKSWIYAIASIELIFVIGLSFLLGNALTRNLHKLKKAVNTVASQGPGAQVDISSIGDLGDVAQAFNNMSLKLEQNYQDLQQARNEAEAANKSKSRFLASMSHEIRTPMNAVLGLLAILKDTTLKPNQKELVNTATDSSELLLSIINDILDFSRMEANTFYLENHIFNIHKSLNSVLKTFHPQAQNKQLELSLFIADNVPTYVQGDAHRLRQILLNLVGNSLKFTDDGQVQILVNAEEHEGRIQLHCSVQDSGIGIQQEQLEYLFDEFTMADNSFSRTHEGSGLGLAICQRLVHMMDGTITVNSQYGLGSEFSFNIQLDKATTKEINYLLSKEKIEQQKDIEQQKNCVFSDANILVVEDNHANQIVIKNTLNYAGYSIDIAQNGKEAITKAINTQYDLIFMDISMPEMDGMTATKKIRSLSDTHQNMPIIALTAHALSGDKERFIEAGMTDYLSKPFNRSDLLECLAKYLFKQGKQDPSFCQECDLCEFNESTEEPKSMDNELLLVDEQIIQQIIADTDASVMPELIRFYIIESKERVETISNAAKNKDLYALEFEAHTLGSSALTLGNVALSTLAREIEIHCINQQFDDALEKTAHLPDLATLSLDALEKRNKQGFSK

SEQ ID NO: 22196 - protein, 411 aa, Pinus sylvestris
MASATLSMAAVANCSSTHASLQVSGKGFSEYSGLKSSSGFPCLRKYNEELRFQLVAFQTNAVGSSGQKRGVVEAKIKVAINGFGRIGRNFLRCWHGRKDSPLDVVVINDTGGVKQASHLLKYDSILGTFDPDVQVAGNDGISVDGKVIKVVSDRNPVNLPWKDYEIDLVIEGPGVFVDREGAGKHLQAGAKKVLITAPGKGDIPTYVCGVNEDKYYPAEEIISNASCTTNCLAPFVKVLDQKFGIIKGTMTTTHSYTGDQRLLDASHRDLRRARAAALNIVPTSTGAAKAVALVLPSLKGKLNGIALRVPTPNVSVVDLVVQVEKKTFAEEVNAAFRETADKELKGILAVCDEPLVSIDFRCSDVSSTVDSSLTMVMGDDMVKVVAWYDNEWGYSQRVVDLADIVANNWKS

SEQ ID NO: 22197 - protein, 276 aa, Triticum aestivum
  misc_feature (158)..(158): Xaa can be any naturally occurring amino acid
  misc_feature (224)..(224): Xaa can be any naturally occurring amino acid
  misc_feature (234)..(234): Xaa can be any naturally occurring amino acid
  unsure (1)..(276): unsure at all Xaa locations
MHPTRWELSHMVDLQAAALVISVVAAEVPPNPISSPPLPSARPNPIRSPPSSSVAMGRKFFVGGNWKCVESIVNTLNAGQIASTDVVEVVVSPPYVFLPTVKGKLRPEIQVAAQNCWVKKGGAFTGEVSAEMLVNLGVPWVILGHSERRSLMGESSEXVGEKVAYALAQGLKVIACVGETLEQREVGSTMAVVAEQTKAIADKIKDWTNVVVAYEPVWAIGTGXVASPAQAQEXHGHLRDWLRTNVSPDVAESTRIIYGGSVTCASCKELAGQPDL

SEQ ID NO: 22198 - protein, 465 aa, Acidobacteria bacterium Ellin345
MKRSFLVVLLALCLAAFSGCGSSSGGSGSGGSGGSGGGGGGSKPPGNGQLSQLNHIVFMLQENRSFDQYFGKLNDYRTAHGKGADVDGLPAGASNPSNDGTSTVASFHFATVCSENVTPSWNASRRDINRYNPTSTTYNMDGFVYSAAHYAQDNNAQRPGAYTDTEGIRAMGYYTDADLPYYYFMATQFATSDRFFSPILSRTPPNRLATFAASALGVVNDIPANTTYSQDTIFTLLQNAGITWKIYETSGNTYLGYFGSFYAKYKSTNIAPISQYFDDVKNGKLPQVAFIETGVETSDEGGTSSLDEHPDANIQKGAAYVAKIINALMTSSSWKDSAFILTYDEGGGNYDHVPPHSAAVPDSTPPMLQPTDDPDTYNRTGFRVPILVISPFTKVGYVSHTVMDTTAILKFIEKRFSLPSLTARDAAQADMSEFFDFTNIPNQTAPSGVPTQPTSGTCSIHSITP

SEQ ID NO: 22199 - protein, 518 aa, Triticum aestivum
  misc_feature (133)..(133): Xaa can be any naturally occurring amino acid
  misc_feature (361)..(361): Xaa can be any naturally occurring amino acid
  unsure (1)..(518): unsure at all Xaa locations
ARREESEGEELPRRVAVELAGTHRGCARRRGRGLAGCALLLLGALGDLWARRGGGRDGRTRAQQRRCRSAAEQSFRWWWWWWCPRHGQAAEGGHGRQARPQEHPPAPLATSATSRPTTGRRPPWGDIANVVNXRAAEGKPQPHEPVNRPVTRNFGAQLLKNAQEKAKNPVARPAVRRAHHVKPAPPPPEHVIEISSDSDVTKSEAGSVSSVRKYSRKKVVTTLSHVLSARSKFAAGITEEPAIQDIDKLDGDNQLAVVDYIEDIYKFYKVAENECRAKDYMDSQVEINAKMRGILIDWILEVHQKFDLMPESLYLTVYIIDMYLSLQTVLRRELQLVGVSALLIACNYEEIWAPEVNDFIXLISDSAYTREQILKMEKAILNMLEWNLTVPTPYVFLVRFAKAASSSDQKNDKEMENTVFFFAELALLQYGLVQSKPSMVAAAAVYAARLTLKKTPLWTDTLKHHTGFTEAQLMEAAKILVASHSTAPDSKLKVVYKKYSSEKLGGVALRPPATDFCK

SEQ ID NO: 22200 - protein, 192 aa, Ustilago maydis 521
MAAKVYVGNLSWNTTDDSLAHAFSTYGQLTDYIVMKDRETGRSRGFGFVTFATQAEADAAIAALNEQELDGRRIRVNMANSRPAGGMGGGYGGVTGQYGANAYGAQGGYGGYGGQPGGFQQPGGFQQQGGYPQQGGYGGYQQPGFQPQQGGYGAPQQGYGAPQQGGYGGYGAQQGFQQPAQQNSGSYNGQGY

SEQ ID NO: 22201 - protein, 489 aa, Trifolium pratense
MDYVGSGMLLLLTCIVACFIGSLYARSRKSNYRLPPGPSIFTIMSHVFELYYKPQQTLAKFAKFYGPVMLIKLCTETTVIISSSDMAKEILHTNDSLFTDRSVPDNTTTHNHNNFSLVFLPFSPLWQHLRKICHNNLFSNKTLDGSQELRRMKLKDLLNDMHKSSLKGETVDIGRAAFKACINFLSYTFVSQDFVESLDDEYKDIVSTLLSAVGTPNIADHFPILKILDPQGIKRHTTKYVAKVFHALDIIIDQRMKLRKSEDYVSKNDMLDSLLDISKEDSQKMDKKQIKHLLLDLLVAGTETSAYGLERAMTRLVHDPKAMSKARKELEETIGLGNPIEESDIDRLPYLNAVIKESLRLHPPAPMLLPRKARVDVEISGYTIPKGAQVLINEWAIGRTDIWDDADSFSPERFLGSEIDVKGRHFKLTPFGSGRRICPGSPLAVRMLHLMLGSLINSFDWKLENNMEAKDMNLDKPLRAIPVALNKVY

SEQ ID NO: 22202 - protein, 409 aa, Zea mays
MSALGTLSGGAAGVSGLLRLRRRAAPAPAIAAPSHLPAGTVKCAAAVPDAAPIVWGRQLRPALLLPAALLPSLQPARRHTLQPPAAAAESAGEAKSVGFLEKYPALVTGFFFFMWYFLNVIFNILNKKIYNYFPYPYFVSLIHLVVGVVYCLISWSVGLPKRAPINGTLLKLLFPVALCHGIGHITSNVSFAAVAVSFAHTIKALEPFFSAAATQFILGQQVPFSLWLSLAPVVIGVSMASLTELSFNWTGFINAMISNISFTYRSIYSKKAMTDMDSTNVYAYISIIALIVCIPPAIIFEGPQLMSHGFSDAIAKVGLTKFVSDLVLVGLFYHLYNQIATNTLERVAPLTHAVGNVLKRVFVIGFSIVVFGNKISTQTGIGTSIAIAGVALYSYIKAKIEEEKRKKSA

SEQ ID NO: 22203 - protein, 180 aa, Zea mays
  misc_feature (30)..(30): Xaa can be any naturally occurring amino acid
  unsure (1)..(180): unsure at all Xaa locations
SGGPADGHAENLWLVPDGRIGFIEFWIVCXIIARTWDAMEVFLASFATGEYDAMGSGLSDTGATGNDPNTNEFAKDLRKIFYIRQDLCTENIVVSARTPDATAVSANDDLDERQTIALFIDLYTVSEAYRLKFPRERALLMMQLMHCERYTRLLAASMIMLRDERINFCTDLQPRTERFE

SEQ ID NO: 22204 - protein, 465 aa, Oryza sativa (japonica cultivar-group)
MGKAARWFRSLWGGGGGKKEQGREHGRTAAAPPPPDRKRWSFAKSSRDSTEGEAAAAVGGNAAIAKAAEAAWLKSMYSDTEREQSKHAIAVAAATAAAADAAVAAAQAAVEVVRLTSQGPPTSSVFVCGGVLDPRGRAAAVKIQTAFRGFLAKKALRALKALVKLQALVRGYLVRRQAAATLQSMQALVRAQAAVRAARSSRGAALPPLHLHHHPPVRPRYSLQERYMDDTRSEHGVAAYSRRLSASIESSSYGYDRSPKIVEMDTGRPKSRSSSVRTSPPVVDAGAAEEWYANSVSSPLLPFHQLPGAPPRISAPSARHFPEYDWCPLEKPRPATAQSTPRLAHMPVTPTKSVCGGGGYGASPNCRGYMSSTQSSEAKVRSQSAPKQRPEPGVAGGTGGGARKRVPLSEVTLEARASLSGVGMQRSCNRVQEAFNFKTAVLSRFDRSSEPAAERDRDLFLQRRW

SEQ ID NO: 22205 - protein, 122 aa, Glycine max
MEEKEELKKSKVIKIDSQKSWEHHISYATNQKYPIVVHFSAFWCVPSLVMNPFFQELASTYEDVLFLTLDVDEVKEIASKMEIKAMPTFLLLSGGTPVDKIVGANPDEIRKRIDHFVHSTRS

SEQ ID NO: 22206 - protein, 363 aa, Oceanicola granulosus HTCC2516
MSGKRLKLGILNGDDIGHEIVPASVEVARAAAGKAGLGIDWTDVPIGAAALESHGHTMPEGTMETLEGLDGWILGPIGHRDYPKVPGAINPHPILRKGFDLFANVRPTRSYPGIGCLFDDIDLVIVRENNEGFQPDRNVVAGSGEFRPTEDVTISVRVITVEGCRKVVRAALDIARSRPRKKLTLVHKNTVFKLGCGMFVDTAYEVAKEYPDVEVDECIVDTFAMRLLRDPWAYDTVVTTNMFGDILTDEAAGMVGGLGMAPGLCIGRGAKAMAQATHGSAPDIAGKGIANPYAMIESTRMLIEHLGRAHDLPEAVRAAAYMREGLDAALADPASRTGDIKGTGGTADMVAGIVAGIERAKAA

SEQ ID NO: 22207 - protein, 186 aa, Arcobacter butzleri
MSEKNVLDENSKNILLDSIRTINDYPKPGIIFKDITTLLNNKNAFNLLMDHLEERYKSYNLDYIAGVEARGFFFASALASRLKIGFVPVRKKGKLPSTTICEKYELEYGFSEVELHLDAFNNEKNVNVLFVIDDIIVSGGTAYAAANLIKKLNVNLVESCFLMNIAILDGAKKLSEISPVYCVLEI

SEQ ID NO: 22208 - protein, 200 aa, Oryza sativa (japonica cultivar-group)
MAAGKGKGKEGECDMAAAAAEAEKKGEGSTVSRGAAGERVVEDSGGGRRTIHLKSKDGKQHDVTEASARLSKTIAGMILAGGGGGGADQCIPTPDIDHDTLRVVMQYCDKHAADDADEEDLKEWDEDFVDELDQDALFDVIAAANYLDIDGLLDLTCKRVADTIKGKTPEEIRKEFNIVNDLSKEEEEEIRRENPWAFEQ

SEQ ID NO: 22209 - protein, 397 aa, Burkholderia sp. 383
MLNSLLDFLSHGLLHFSWWQVALFALAVTHVTIIGVTVYLHRCQAHRALELHPIASHFFRLWLWMTTGMLTGQWAAIHRKHHAKCETEEDPHSPQTRGIWKVFLEGAELYRAEAKNEETMRKFGHGTPSDWVERNVYSKYPILGISLMMVIDVALFGVIGLTVWAVQMVWIPFWAAGVVNGFGHFWGYRNFNSTDASTNLFPWGIVIGGEELHNNHHTFATSAKLSNKWYEFDIGWMYIRIMSAFGLAKVKKVAPTPRLNKPKTVLDQETLQAVLSNRYEVMARYGKAVKRAYRQELAHLKEIGGEKYQMMRGARKWFHKDADGLDEPQKKLLPEIFANSQKLQTYFQLRQDLAAIWDRSTASREQLLAQLQDWCHRAEQSGIKALQEFATRLRRYA

SEQ ID NO: 22210 - protein, 206 aa, Photobacterium profundum SS9
MTNDDHNRTMTVAVCIAPGTEEMEAINTIDILLRAGFDVTTASVASDGALIVAGSRGIKLVADAALVAVADEQFDCVVLPGGVGGAECFRDSPLLVEFVEQHKYDGKLIAAICAAPALVLEHHNMFPTAIMTAHPAFQDYIPEVRRRAKRVVYDVNSNLLTSQGPGTSQEFALEIIVRLAGKEKAAEVAGPMVVWPNMHYDILPKT

SEQ ID NO: 22211 - protein, 409 aa, Oryza sativa (japonica cultivar-group)
MHSRHQRLASLTKLLTSHVNVGRHRDALAFFSRMVSDPSLPPLSDPSFAYAFPLALKSSSALRLPSAAAAADSLHALAAKCGFLSSPFFASALVASYGACASPALARRLFDELPHRNAIVCSAMISVHIRSGDLAGALRELDLMDVAPTASCFNSVIAAVAESGEHPARAIDLYRRMQRMGVLPSLITLLALVPSCTALGALSSIKEVHGFATRHGMFASCHLGSSLIEAYGRCGSLAGARNVFDQVQERDVVVWSSIVSAYAFHGHADVAMSLFRHMELDNVRPDGIMFLGVLKACGHAGHADDALKYFDVLTKIFGVEACGDHYSCLVDVLGRAGRLRQAYDVIQTMPVKVTAKAWGALLAACRKYGEVGLAEVAGRALFEIEPENAEQVRREMEQRVNCSERGNTL

SEQ ID NO: 22212 - protein, 142 aa, Glycine max
  misc_feature (108)..(108): Xaa can be any naturally occurring amino acid
  unsure (1)..(142): unsure at all Xaa locations
REGVKIYISLQMYKQATCCYEGWILSQATEAVYHLAYAELLYTLGGVENLQTANRYWGCTIEFSRGENTRALFNICLCTSAVTQVTKGESKEDKEGGHLQSLSANGLXKEYNQRAPDKVSQLTTGLQECNIVIMQHLLKSII

SEQ ID NO: 22213 - protein, 456 aa, Listeria monocytogenes str. 4b H7858
MLIYIKLGGVCLSRNYFCQGDLLILTIKFLIIALLIAISAFFVATEFAIVKMRPSRLDQLIAEKDKRAVLARHIYNHLNAYLSACQLGITISSLGLGWLGESTVEAALHPLFSLMELPQSAITILSFTIAFLFITFLHVVVGELVPKTLAIDKTEAVALAVARPLHIFYKVMFPFIWILNGSAVFIARLFGLEPASEHEIAHTEDELKIIVGESYKSGEINQSEFRYVNKIFDFDERMAKEVMIPRTEIVTVDTGSTIGELSDIMQNERYTRYPVIDGDKDHVIGVLNLKEILSAYVEHGSNPSFSIDPYVKPIIRVIETIPIKELLFRMQRERSHIAILLDEYGGTSGLVTVEDIVEEIVGDIRDEFDADEIPEIRKIKDGHFIVDAKLLIDEVNNILGTEIEEEEVDTIGGWFLTQNYEVEVGDEIDYDGFIFRVKQGEPHHIEYIEIIKKTND

SEQ ID NO: 22214 - protein, 202 aa, Synechococcus sp. WH 5701
MSKLRVGVAGPVGSGKTALVEALCRRLRQELELAVVTNDIYTQEDAQFLTRAGALEPERIRGVETGGCPHTAIREDCSINRAAVEELEIQFPDLDLVLVESGGDNLAASFSPELVDLCIYVIDVAAGDKIPRKGGPGITRSDLLVINKIDLAAMVGADLSVMQRDTELMRPGRPWCFTNLRSGEGLERVESFLREQLPSPRA

SEQ ID NO: 22215 - protein, 426 aa, Pichia pastoris
MSGDHKSFTVFNQEFIIDRDFELIKALGQGAYGVVCSAQYKGNEDGGKVAIKKVTNIFSKKILAKRALREIKLLRHFRGHKYITCLYDLDVIPDQNNNFNEIYLYEELMECDLHHIIKSKQPLTDSHYQSFIYQILGGLKYIHSADVLHRDLKPVNLLVNSDCELKICDFGLARGYSSDAEKNAGFLTEYVATRWYRAPEIILSFQTYTKAIDIWSVGCILAELLGGRPIFRGRDYVDQLNLILSTLGTVSEETLQSIRSERAQDYVRSLPFMPKIPFSQLFPGANPEAIDLLDRMLTVDPTHRITVTEALEHPYLKVWHDPNDEPVCSSKFDFSFEVVDDIETMKQMIVDEVLSLREFVRRPIQEQQLPFTEPDKHFDVSFDQPQIEPPAENYRDDHLPRPHELESQILDLEHELQYGLDRYGTQ

SEQ ID NO: 22216 - protein, 500 aa, Oryza sativa
MDVNQLWLLWATLAVSLLYYISNRRRRVGGRRRCPPGPMPLPLVGNLLNLRGHLPPALARLARTYGPVMMLKMGLTTTVVISSGDAAREAFTKHDRHLAARTVLDVTRSLDFADRSMIWLPSSDTVWKTLRGVTAASIFSPRGLAALRGVRESKVRDLVGYFRGRAGEVVDVRHAVYGCMLSLVSSAFFSVDVVDLSAESENEFRQSMTFLMEVVSKTNVSDFFPFLRPLDLQGWRRLTERYLGRVTCFLDDVIDRRFAADASANRHGDFLDSLLDLVSTGKIVGENVTTILLDVFIAGSDTITATVEWAMAELLRNPSEMAKVRAEMDGALGGKKTVDEPDIARLPYLQAVVKEAMRLHPAAPLLLPHRAVEDGVEVGGYCVPKGSMVIFNVWAIMRDPAAWERPEEFMPERFIRRGDDDEVDFWGKTFEFIPFGSGRRVCAGLPMAERVVPFMLASLLRAFEWRLPDGVSAEELDMRHRFTIANFRAIPLKAVPVVVS

SEQ ID NO: 22217 - protein, 276 aa, Brassica napus
STHASASLDPIRRSPEGSGHPQLAVPDNLDATMQLLFVACRGDVEGVQDLLDEGIDVNSIDLDGRTALHIAACEGHVDVVKLLLTRKANIDARDRWGSTAAADAKYYGNMDVYNILKARGAKVPKTKKTPMVVANPRHVPDYELNPQELQVRKADGISKGIYQVAKWNGTKVSVKILDKDLYKDHDTINAFKHELTLFEKVRHPNVVQFVGAVTQNVPMMIVSEYHPKGDLGSYLQKKGRLSPSKVLRFALDIARGMNYLHECKPEPSIHCDLKPK

SEQ ID NO: 22218 - protein, 142 aa, Prochlorococcus marinus str. MIT 9312
MNNEINPIEEDFNAALSKYKDGQDLIPIVQDFQKIIQQIPNHFAAWTCLSWLQLLLKNNEEALEAARQAVRLNQQDPQARMNLSLALLATNNKGVRDHVELIKKMSMMMPDVKSELKESVEDGFSRYPDWPELNKVKKWLEF

SEQ ID NO: 22219 - protein, 276 aa, Xanthobacter autotrophicus Py2
MAPHWQETSLQTQAGPMPARLYGVHPSKGAVPLILHLHGGAFTGGTLECGAYVAALLAEAGAVVVSADYPLACERPFPFALTAAFGALAALYGRRAEFAGRNAPLYVAGEESGGNLAAGLAMMARDQQAPPLAGQILISPMLDPSLATASLRAAEAGTCGCKWADGWQTYLGSPEKAAHPYAAPLASSRLQGLPPALVVSAQDCPMRDESARYACALEKAGVATELHILPGPTHWPEGISAPPEKPESWAGTMRTLFSRFFETSRPRRRKPAPAVL

SEQ ID NO: 22220 - protein, 421 aa, Burkholderia sp. 383
MKLHGFLIGQTETLLAEVLKFAGPADATTSRFFRAHPKLGHAERGVIAEAVFAVLRRKMEFSHLAESGTGTPARRLTLLGLMQTAGRNALKPFLSDTESAWLEHVSKIDPASLPVRIRTNLPDWIHQALSARFDADELAQLAAALNYPAPLDLRANVQKASRDQVIDGLRAEGIDAGATPFSPFGVRVVGKPALTRLRLFEEGAIEVQDEGSQLLCSLVAPRRGEMVVDFCAGAGGKTLALGAMMRSTGRLYAFDVSEKRLAKLKPRLARSGLSNVNPVLIDSEHDAKIKRLAGKIDRVLVDAPCSGLGTLRRNPDLKWRQTRTAIDELTPKQASILASAARLVKKGGRLVYATCSVLDAENERIVEQFLADHPEFVLVPAQKVLDDQRIELETGDYLSLWPHRHATDGFFAAVLERRAAQ

SEQ ID NO: 22221 - protein, 306 aa, Oryza sativa (japonica cultivar-group)
MAAPPLPRAPVSSSAAAASPGGRALLLLRVGGGGSGRCAGVAAAAAPGWRRPFPAASVAARSAGTTPGEVAVDPKVEAILDSVKWDSKGLAVAIAQNVDTGAILMQGFANKEALATTISTRKATFYSRSRSSLWTKGETSMNFINVHDIFLDCDRDSIIYLGKPDGPTCHTGAETCYYTSVYDALQGSKPNQDRQVVSTLYSLEDTISRRKEEIVTEGSGKPSWTKKLILDNRLLCSKISEEAGELNQTLLENEDESRTISEMGDLLYHAMVLLRVKGVRMEQVLEVLRKRFSQSGIEEKASRNKS

SEQ ID NO: 22222 - protein, 515 aa, Triticum aestivum
  misc_feature (160)..(160): Xaa can be any naturally occurring amino acid
  misc_feature (241)..(241): Xaa can be any naturally occurring amino acid
  misc_feature (259)..(259): Xaa can be any naturally occurring amino acid
  misc_feature (289)..(289): Xaa can be any naturally occurring amino acid
  misc_feature (332)..(332): Xaa can be any naturally occurring amino acid
  unsure (1)..(515): unsure at all Xaa locations
PEQGIMKRVSSHVSIASEAEINLDLSRLLIDKPRFTLERKRSFDEQSWSDLSHRHNDGFDSVAHSPAFRTGFESPFSTGSHFGEPSGPHPLVNEAWEALRKSVVYFRGQPVGTVAAVDHVSEEALNYDQVFVRDFVPSALAFLMNNEPEIVKNFPLRTVXCQSSEKMVDRFKLGAGAMPASFKVDRNVNRNTETLVADFGESAIGRVAPVDSGFWWIILLRAYTKYTGDASLSESPDCQKXMRLILNLCLSEGVDTFPXTLLCTDGCSMIDRRMGIYGYPIEIQALFHXLNNIYRYKTEEYSHTAVNKFNVIPDSIPEWVFDFMPCKGGYFXGNVSPAMMDFRWFALGNCIAIISSLATPEQSSAIMDLIEERWDELVGEVPLKIVYPALENHEWRIITGCDPKNTRWSYHNGGSWPVLLWLLTAACIKTGRPQMAKRAIELSEARLLKDGWPEYYDGKLGKFVGKQARKFQTWSIAGYLVARMMLEDPSTLMMISMEEDRPVKPTMRRSASWNA

SEQ ID NO: 22223 - protein, 357 aa, Oceanicola granulosus HTCC2516
MTSNKLNIAVIAGDGIGKEVVPEGLRVLEAAAKRYDLSFDFKEHDFASCDYYGRTGEMLPEDWKTRLEGSDAIFFGAVGWPDVVPDHVSLWGSLLKFRREYDQYVNLRPVRLMPGVPSPLANRAPGDIDFYVVRENTEGEYSSIGGKMYEGTDREIVVQETVISRHGTDRILKFAFELAQSRPAKHLTSATKSNGISITMPYWDERVEEMAKNYGDVKVDKYHIDILTAQFVLNPDWFDVVVGSNLFGDILSDLGPACTGTIGVAPSGNIDPTGRFPSLFEPVHGSAPDIAGKGIANPVGQIWAGAMMLEHLGHKEAADGIVQAIETVLSEQKLRTGDLGGPLGTVDCGKAIADALS

SEQ ID NO: 22224 - protein, 468 aa, Burkholderia sp. 383
MVVQGSGNAVTQQQRSFDDIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGTVEYAFSLLKIAAIVVFIVLGAYLVWSAPAASGVGFANYTAHGGFMPKGPWGTWVAVIVAIFSYMSIEAVAIAAGEARDPQHAVTRAFRSTVFRLVLFYLLTLSLMLAIVPWTQAGTDESPFVKVMAATHVPYAAGVINFVLLIAALSAMNSQLYVTTRMMFSLSRARLAPAVFGRLGTNGVPRAALWISTSGVAVAAVLVALAPDTAFTVMMAIAMFGALFTWLMIFVTHLRFRSRYRGPALAFRMWGHPFGSLLGAGLVAAILFTTAFTREFRMTMVVGVVFAVLLTLAYALHYRHQHAR

SEQ ID NO: 22225 - protein, 317 aa, Arabidopsis thaliana
MGQYATVWDQKEASEIIKDWNGVDQVLLRNPHGASAKISLHGGQVISWRNELGEELLFTSNKAIFKPPKSMRGGIQICYPQFGDCGSLDQHGFARNKIWVIDENPPPLNSNESLGKSFVDLLLKPSEDDLKQWPHSFEFRLRVSLAVDGDLTLTSRIRNINGKPFSFSFAYHTYLSVSDISEVRIEGLETLDYLDNLSQRQLLTEQGDAITFESEMDRTYLRSPKVVAVLDHERKRTYVIGKEGLPDTVVWNPWEKKSKTMADFGDEEYKSMLCVDGAAVERPITLKPGEEWTGRLILTAVKSSFCFDQLELQSKGF

SEQ ID NO: 22226 - protein, 289 aa, Listeria monocytogenes str. 4b H7858
MENRISGTTRLLGLIGTPVDHSKSPIMYNYSFQKAGLDYAYLAFDTPIEKVADTIKAIKTFNLRGANVTMPCKSEVLKHMDDLSPAARMIGAVNTIVNEDGKLTGHITDGLGFIANLRDASVDVTGKKMTIIGAGGAATAIQVQCALDGAKEITIFNIKDAFYDKAKQTAASIKQEVPNCIVHIYDLNDTEKLTAEIATSDILVNATLVGMHPNEHETPISDTSVFRKELIVADIIYNPKKTQLLLDAEAAGCKTVGGLGMLLWQGAEAYKLFTGKDMPVSEVKNLYFN

SEQ ID NO: 22227 - protein, 448 aa, Candida albicans SC5314
MSEKIVQSSNDEAATLTAVDYIQNQEELEKEARELMPYDPNECTYEMGELRQPLFACLTCSAENENQPIGVCYSCSIQCHSQHELVELFTKRSFVCDCGTTRMKNTKDGACKLRRHGKKESSGRKLSNSSATHSTYLELAAEDIPSSSNTYNQNYHGRFCGCKQVYNPLEETGHMIQCYFGFTCGEDWYHDRCVMGITFADEKANQKHGNSQEESVPDGTNIKTDISKAQSESADIDSIEKLQYFPKLETFDEFICWRCVTSFKDVFEDLDKHFPGVILSKLPRFSNTSTVEDWYAKREKLLEPCFKKIKIEESSGKLGKFHNQEYSLFLSNDFRFKLIDNYESLDHESKLYKFLLNNSFLFKDDPIFKPPEDDSEEDCYSSSNAGTGRALETLPRDKAIESIQAYDKIKSKLKDFFKPFAEQGKVVTEEEVRNFFGHIDDKNNDSGQ

SEQ ID NO: 22228 - protein, 398 aa, Triticum aestivum
  misc_feature (6)..(6): Xaa can be any naturally occurring amino acid
  unsure (1)..(398): unsure at all Xaa locations
TCSSRXEAGDGSGIQSLALGALDNSFLVGGAGIQVVKNFRHGVHGKGVSVRISGGRGGGTSTTSTNYSTPKKALLMRGETNMLLMSPGDTGAPHSNGVHHVDIETGKVVAEWRFEKDGTDITMRDIANDSKSAQLEPSGSTFLGLDDNRLCRWDMRDARGRVQTIGNSDDSPVLHWSQGHQFSRGTNFQCFASTGDGSIVVGSVDGKIRLYSRSSMRMAKTVFPGLGSPITHVDVTYDGKWILGTTDTYLVLICTIFKDKDGKEKTGFSGRMGSRIAAPRLLKLSPLDSILAGNDNKFHGGQFSWVTENGKQEKHLVATVGKFSLIWNFQKVKDSNHHCYRDQEGLKSCYCYKVVLKEESIVDSRFMHENFAGSDSPEAPLVVATPMKVSSFSIANRR

SEQ ID NO: 22229 - protein, 404 aa, Trifolium pratense
ILGLPAVAAALELVDPPGCRVIPYLELNPVWKDSSSFEDIFDVDHFIDVLKNDVSIVKELPEEYSWSSREYYALAIRDTRIKVAPVHATANWYIENVLPVLQSYGIAAISPFSHRLSFDNLPMDIQHLRCKVNFQALVFVPHIRALGDALVNRLRNPQHTTEEMGSNYLQEVTDADDNKNAGKFVVLHLRFDKDMAAHSACDFGGGKAEKLALAKYRQVIWQGRVLNSQFTDEELRSQGRCPMTPEEVGLLLAALGFDNSTRLYLASHKVYGGGARIATLKELFPLMEDKKSLTSPFERTLIKGKASLLAALDYYISMHSDIFISASPGNMHNALVGHRSYLNLKTIRPNMQLMGQLFLNKTMEWSEFEHAVVEGHETRQGQLRLRKPKQSIYTYPAPDCMCQA

SEQ ID NO: 22230 - protein, 143 aa, Arabidopsis thaliana
  misc_feature (34)..(34): Xaa can be any naturally occurring amino acid
  misc_feature (57)..(57): Xaa can be any naturally occurring amino acid
  misc_feature (73)..(73): Xaa can be any naturally occurring amino acid
  misc_feature (91)..(91): Xaa can be any naturally occurring amino acid
  misc_feature (117)..(117): Xaa can be any naturally occurring amino acid
  misc_feature (137)..(137): Xaa can be any naturally occurring amino acid
  unsure (1)..(143): unsure at all Xaa locations
RRHKNLAFASIASMPSKLLPVLVCYVFLFPFASXSDYSGVSLPSSSPKVSVGLYYEXLCPYCSSFIVNRRVAXLFEDDLISIVDLHLSPWXNTKLRSDNVTSVFQHGAFECFLDTFXSFSIYSFPKLSYSFPLFIYXVEKLVT

SEQ ID NO: 22231 - protein, 368 aa, Clostridium perfringens SM101
MNNCIGIINLDENESKIGELVKNRPLAAVPIAGRYRIIDFILSNMTNAGIESLGILSKNKSRSLVDHLTNGRPWDLHRKRDGLRVFNFGERDPYYDDITNLYENLEFLTKSRREYVIMSPSYMICNIDLKEALEYHKKNDNDITVIYKKVKDADSNFIDCDVLNFDECGFIKSIGKNLGREEESSISLEMYILRTDLLIEIIYECIRRGSHRKFKSYLKEFLDEIKVGGFEFKGYLSCVNSLKSYYKANMDLLEEKVYKELFIDNNPIYTKSRDEGPTHYTKNSEVTNSIIANGSYIEGKVENSIIGRRVYVGPEAVIKNCIIMQETVIGENAHLDKIITDKAAVIRDDDKIVGLEYCPMVLSKPNVI

SEQ ID NO: 22232 - protein, 419 aa, Porphyromonas gingivalis W83
MAFIIDLLLLCCSAFMSSCEVAYFSLKPIDLQNIRERNHSSDIALSNLLDNSNQLLATILIGNNVINVAIVILSNYAIEQTFVFSSPIIGFLIQTILLTTVLLLFGEILPKVYARKNPLQYSRFSAAAMSVIYKILSPFSKLLVKSTGIVTRGISKKKYDMSVDELSKAVALTTTEGEPEEKEMINEIIKFYNKTACEIMVPRIDIVDVDLSWPFRKMLDFVVSSGYSRLPVSEGSEDNIKGVIYIKDLIPHMDKGDEFDWHPLIRKAYFVPENKRIDDLLEEFRANKVHVSIVVDEFGGTCGLITMEDILEEIVGEITDEYDEEELPFKVLGDGSYLFEGKTSLSDVRHYLDLPENAFGELGDEVDTLSGLFLEIKQELPHVGDTAVYEPFRFQVTQMDKRRIIEIKIFPFERTWEVE

SEQ ID NO: 22233 - protein, 531 aa, Oryza sativa (japonica cultivar-group)
MEAVGVAPAPAGVPEKKLLEVKESRKAAPAAPSTSMAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPVKDSSKCNGTAAPV

SEQ ID NO: 22234 - protein, 102 aa, Oryza sativa
  misc_feature (39)..(39): Xaa can be any naturally occurring amino acid
  unsure (1)..(102): unsure at all Xaa locations
MSSDEGPVLGGVEPVGNENDLHLVDLARFAVTEHNKKAXALLEFEKLVSVKQQVVAGTVDYFTIEVKEGDAKKLYEAKVWEKPWMDFKELQEFKPVDASANA

SEQ ID NO: 22235 - protein, 54 aa, Oryza sativa
  misc_feature (48)..(48): Xaa can be any naturally occurring amino acid
  unsure (1)..(54): unsure at all Xaa locations
HASAHASAVFLWCEDQVTEHRAKYKDGDEIPPLVIGVSAPQGSGKTTXCFALDY

SEQ ID NO: 22236 - protein, 219 aa, Haemophilus influenzae
MNQLEMKKLAAQAALQYVKADRIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 22237 - protein, 199 aa, Zea mays
  misc_feature (49)..(49): Xaa can be any naturally occurring amino acid
  unsure (1)..(199): unsure at all Xaa locations
TPEDLDAMKDGMPQAYKELFQNCRILESHYKEMQDIEFTVQESRLWMLXCRTGKRTGKSALKIAVDMVNEGLVERRAAIKMVEPGHLHQLLHPHFENPSAYKDQLIATGLPVSPGAAVGQVVFTAEDAETWHSQWKSVILVRAETSPEDVGGMHAAAGILTERGGMTSHAAVVARWWGKCCVSGCSGIRVNDAEKVVNI

SEQ ID NO: 22238 - protein, 292 aa, Clostridium perfringens SM101
MSNEKLFPTTFPVQNQSIHPGVEDEMNPLPIYDLPQYINDGKRLKNKVAIITGGDSGIGRAVALGYAREGAKVCIIYLSDEEDKDANKTKELIESAGSEALVIKGDISDIDFCNSSVKKVIEKWGKLDILVNNAAVQHDSKTLDDIGPEQIENTFKINVFGTFYMTKAAVKYMECGSSIINTTSITAYRGNEILFDYSCTKGALTTMTRTLATMLVKNGIRVNAVAPGPIWTPLIPSSMNKKKVSEFGVNSPMGRAGQPVELAGAYVFLACNEASYISGITIHVNGGEIING

SEQ ID NO: 22239 - protein, 536 aa, Brassica napus
MDLSLLRPQPFLSPFSNPFPRSRPYKPLNLRCSVSGGSVVGSSTIEGGGGGKTVTADCVIVGGGISGLCIAQALVTKHPDAAKNVMVTEAKDRVGGNIITREEQGFLWEEGPNSFQPSDPMLTMVVDSGLKDDLVLGDPTAPRFVLWNGKLRPVPSKLTDLPFFDLMSIGGKIRAGFGAIGIRPSPPGREESVEEFVRRNLGDEVFERLIEPFCSGVYAGDPAKLSMKAAFGKVWKLEENGGSIIGGAFKAIQAKNKAPKTTRDPRLPKPKGQTVGSFRKGLTMLPEAISARLGDKVKVSWKLSSITKLASGEYSLTYETPEGIVTVQSKSVVMTVPSHVASSLLRPLSDSAAEALSKLYYPPVAAVSISYAKEAIRSECLIDGELKGFGQLHPRTQKVETLGTIYSSSLFPNRAPPGRVLLLNYIGGATNTGILSKSEGELVEAVDRDLRKMLIKPSSTDPLVLGVKLWPQAIPQFLIGHIDLVDAAKASLSSSGHEGLFLGGNYVAGVALGRCVEGAYETATQVNDFMSRYAYK

SEQ ID NO: 22240 - protein, 500 aa, Amaranthus hypochondriacus
MAIRVPSRQLFIDGEWREPIKKNRIPIINPSTEEIIGVIPAATAEDVELAVAAARRALKRNKGEDWASASGAHRAKYLRAIAAKITEKKDYFAKLEAMDCGKPLDEAAWDIDDVAGCFEYYADQAEALDAKQKAPIALPMDTFKCHVLKQPIGVVGLISPWNYPLLMATWKVAPALAAGCSAVLKPSELASVTCLELAEVCREVGLPPGVLNILTGLGPEAGGPLACHPDVDKVAFTGSTATGSKVMSSAAQLVKPVTLELGGKSPIVIFEDVDLDKAAEWTAFGCFWTNGQICSATSRLLVHESIAAEFLDRLVKWCKNIKISDPFEEGCRLGPVVSKSQYEKVLKFISTAKSEGATILCGGSRPEHLKKGYYVEPTIISDVSTSMQIWREEVFGPVLCVKTFGSEDEAIELANDTQYGLGAAVLSKDLDRCERITKALQAGIVWVNCSQPCFCQAPWGGTKRSGFGRELGEWGIENYLNIKQVTEYISDEPWGWYKSP

SEQ ID NO: 22241 - protein, 220 aa, Zea mays
  misc_feature (162)..(162): Xaa can be any naturally occurring amino acid
  unsure (1)..(220): unsure at all Xaa locations
MATSSRLLPQALHMLPRIPTKNLRVSSFIPSLNSQISFSTVSLTHSGSNFGFAIDSRKRREFIAKAEESTEGEDTEEAVTEDVAETEGATEVEEAKTPWKPRTKLGDVMGILNQKAIEVSEKVRPVPEIRTGDIVEIKLEVPENRRRLSIYKGIVMSRQNAXGIHTTIRIRRIIAGIGVEIVFPIYSPNIKEIKVVSHRKVRRARLYYLRDKLPRLSTFK

SEQ ID NO: 22242 - protein, 255 aa, Mycobacterium sp. JLS
MTQKNPFDLTGRTALVTGGNQGLGRAFAFGLAQAGATVAISGRSAERNAKVVEEAAAEGFALHPITADITRQDDVDRMTAEAISALGHLDILVNNAGTCYHAESWDVTEEQWDSVFDLNVKALWACSLAAGAHMRERGSGSIVNIGSMSGLIVNRPQMQPAYNASKAAVHHLTKSLAAEWGPLGIRVNALAPGYCKTEMAPVDKPEFKQHWIDDTPMLRYAMPEEIAPSVVFLASDAASFITGSVLVADGGYTAW

SEQ ID NO: 22243 - protein, 341 aa, Mycobacterium sp. JLS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCKQCKAGRYNLCPEMKFYATPPIDGAFCRYVVIDDDFAHPVPESMSDDAAALLEPLSVAIATMRKAGVVPGSTILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWPAAIHLVNSGAVDLDAMVTGRYDLEHVADALDSDTDPASLKSIVNP

SEQ ID NO: 22244 - protein, 563 aa, Burkholderia sp. 383
MLKTKQPFRTPGRRYRATLFAAAAFACCCSYAVAQDATPDAAADAVAHADAIMTLVDDASPCAANPAACAVHVFAGGRVGGNGVGPGSNGSGGSPGSGNGNGSGSGNNGNGTVGPAGVGGTTSGTSGGTSGSGGSGRGGNASGSGGSGGGSSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGGGTSGTGGHGGHGGHGGGDGDGGGHGNGGHGDGDGDGGGHGHGGGHGDGDGGGHGHGGGHGDGDGGGHGNGGHGNGDGGGHGNGGGHGDGDGGGHGNGGHGNGDGGGHGNGGGHGDGDGGGHGNGGHGNGDGGGHGNGGGHGDGDGGGHGNGGHGNGDGGGHGNGGGHGDGDGGGHGNGGHGNGDGSGHGNGGGHGEGDGGGHGNGGHGNGDGGGHGNGGHGHGHGHGNGDGGSSNGGGNGGHGNGGGNGNGNGSGGAGNGGANGVGNGHGTGNGNGGGHGNGGSSGANH

SEQ ID NO: 22245 - protein, 433 aa, Robiginitalea biformata HTCC2501
MENKPQVVIVGAGFGGIELARSLRRLPVDVLLIDRNNYHNFQPLMYQVATGGLEPDSIAYPVRRIFRRFRNVRCRMAEVSLVDWERSRLFTSIGTVPYDYLVIATGSRTNYFNFESLQDRMLTLKSLPDALNLRSFVYQNLEKAIANYSGEPLEEIMNIAIVGGGPAGIELAGALAEMKKHVIPRDFPDLDTSLMSINLYQSGDRVLKAMSEIASEKAREYLEDLGVNVLLNSRVADYRDDQVHLSDGTRFPTDTVIWTAGVRAAPLNGLPESCLLKGNRIAVDPCNRVAGLDNVFAIGDVAACIAEATPRGLPMLAPVAQQQGRHLAGNLGRLLRRRDLVPFVYRDRGAMATVGRARAVADLPNWKFQGTFAWVVWMAVHIYSLVGFRNKLSALYHWAFNYLSYDRPLGLIIRPYRREAQDAASDRRPGPGD

SEQ ID NO: 22246 - protein, 214 aa, Mycobacterium sp. JLS
MRVGPEDAGLTALAGEVLAREADAVSALAGTVEGGVVAVARRLLDVTGKVVTTGSGTSGIMAERLAHLLSVCGTPAVYLPAMDALHGGMGAVTAHDLVLAISKTGRSAELTRLTERLVDRGVDVVAITEDAKSPFALAATQVQALPRTPGDADPGGMIALASTLVVGAWGDALAVVSMTLRGRTLHDVVHSHPAGGVGARGHRPGDESAPVVRT

SEQ ID NO: 22247 - protein, 968 aa, Azoarcus sp. EbN1
MLIKKNAAPGNAFRQLASPMARHLGATMDRRAFLRRSGLGAGAGVLAAQLPYNLIGSADAASAGGQSATGGEEVRRTVCTHCSVGCAIDAIVKNGVWVRQEPVFDSPINLGAHCAKGASVREHGHGEHRLKYPMKLVDGKYQKISWEQAINEVGDRLLKIREESGPDAVYWIGSSKHSNEQSYLMRKFVSFFGTNNMDHQARICHSTTVAGVANTWGYGAMTNSYNDMQNARAMLFIGSNAAEAHPVSLLHILHAKETGAKMIVVDPRFTRTAAKADYYARIRSGTDIPFIWGMLYHIFENGWEDREYIRQRVYGLDKVREEVMKWTPDKVQEVTGVPEEQVYTIAETLAKNKPSTVVWCMGQTQHTVGNGNVRAMCILQLVLGNVGVSGGGTNIFRGHDNVQGATDVGPNPDSLPGYYGLAAGSWQHWCRVWGVDYEWVKGRYASEELMTKSGITVSRWIDGVLENPADIDQPGGNLRAVVYWGHAPNSQTRGAEMVEAMKKLDTLVVIDPYPSATAAMAAMVRKDGVYLLPAATQFETSGTATASNRSLQWREKVIEPLFESKPDQTIMYAFAKKFGFADELVKNIKLVKDKQGWDEPEPEDILREINRGTWTIGYTGQSPERLKLHMQNMHTFDVKTLRANGGPCDGDYFGLPWPCYGNPELKHPGTPNLYDTSKHVMEGGGNFRANFGVEKDGVSLLAEDGSASKGAELQMGYPEFDDVLLKKLGWWDELSDAEKAAAEGRNWKTDLSGGIMRVAMQNHGMHPFGNAKARALVWNFPDPVPLHREPIYSPRPDLVEKYPTHDDKMKFWRLPTLYKTLQDKVRDISKEYPLIMTSGRLVEYEGGGEETRSNPWLAELQQEMFAEVNPKDANDAGFRNGDYIWVESPTKAKLKVRAQVTQRVAPGTVFLPFHFSGWWQGRDMLEYYPEGAAPIVRGEAVNTATTYGYDSVTMMQETKTTLCRVAKA

SEQ ID NO: 22248 - protein, 248 aa, Glycine max
  misc_feature (133)..(133): Xaa can be any naturally occurring amino acid
  unsure (1)..(248): unsure at all Xaa locations
MNLTHWLDLSSYNKKMETSFNYIKKNYYVNLFVNEFVAFVTLNYEHDKKNLNMLVRCSRSCENLTTLLFGMGWSWPLFRPWLSVQNQWTCEGLLRECHGRWLGGFSKRIGRSNAFIAELWEVLRGKQMAQDKXVCKLIIQVDSLSVVNAIRGERIGCASGWRLVQNIRAIKQKFSHFNIHHVYWEANSSADELAEYACSMEGDLVIFEQQPLFLSSLLRADVMGVQTPRLISVYFHIFFHIILENKIL

SEQ ID NO: 22249 - protein, 784 aa, Haloquadratum walsbyi
MKVADVVPEFADAFSFDEFNQMQQEAAPGILQTDSNVVVAAPTASGKTALAELAICRALRHNGTALFIAPLRALTNEKESEWDRFESLGYSVYVVTGERELNTRRAERADILVMTPEKTDSATRKHDSARYSFITDVDCCVIDEVHLLDSDRRGGVLEVTVSRLRRLCDPRIVALSATMSNVDDVAGWLDASSETTFQFGEDYRPVELHTGIQLYTHGDNTFADKYRRLYRALDCAEEHLRDGGQALVFVSSRQDAVRAAGKARDEIAQRDIPMGARGEYEFHTSAKKLENDALSKAAPDGVGFHHAGLAKDDRDRVESWFKSGEIQLLFSTSTLAWGVNLPARCVVIRDTKYHDPLEGEVDISPLDVLQMLGRAGRPSYDDVGYGWVVCDRSEAEKYRRLLAEGKEIESRLAEDLDSHLNAEIAMGTIKDLDDVLTWLETTFYYRRAESNPDAYDFDTLKERMRSTLDSLVNRGFVEMDDDLSVSGTTLGRLTSKYYLRLSTAERFDSLCDRGTLTATGILETVAGAGEFHAVSARQSESDAINKVLSDASISTELEDGSKKVLAILYAGMNGATPADLRSDAWIIRQNARRLLSALREFLDSFAGPRAANLARRVAARVEHGVSRDAVALTAIDGIGATRANKLATGGLHSPADIIDAGVTELQRAGLTEGVAKQIVTNAREFPDIDVRWESLPDEITRGANEICEVTIRNVGGSGYVGIRITVNDIEMTATETYLDNTTTVPVGVFGADTERLKFTIEITFPAEPLHPVRAQRAVSVVDNE

SEQ ID NO: 22250 - protein, 124 aa, Glycine max
MEASEQNNSKVVLIDSLQSWEFHVNQAYNQNTPVVVHFTASWCMPSVAMTPVFEELASSYPEVLFLTVDVDEVKEVATKMDVKAMPTFLLLKDGAAVDKVVGANPEEIKKRIDGVAESTRVSLA

SEQ ID NO: 22251 - protein, 1511 aa, Saccharomyces cerevisiae
MPEAKLNNNVNDVTSYSSASSSTENAADLHNYNGFDEHTEARIQKLARTLTAQSMQNSTQSAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETNTFQILKPMDGCLNPGELLVVLGRPGSGCTTLLKSISSNTHGFDLGADTKISYSGYSGDDIKKHFRGEVVYNAEADVHLPHLTVFETLVTVARLKTPQNRIKGVDRESYANHLAEVAMATYGLSHTRNTKVGNDIVRGVSGGERKRVSIAEVSICGSKFQCWDNATRGLDSATALEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASREAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFSMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKDKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 22252 - protein, 380 aa, Ostreococcus tauri
MRGAARGRARSKRTHHVCLVIVPLSIVAVFIRSRFARVNRHSIGARGVAVASTVSRSTEGPLVEDWLNFHRLVGVDRFYIFLEGRATTRLPWSKHRREVRLFDDIDVKSHHAVSKLRNKSFLKPYVANASCGASALFVRQTLNLEMAIEAARRDGFRWLIHIDVDELLYPSSSPRFNIKDVLHDDVPSDCELVVFPNHEAVPEVATNSSKSPFSAITLFRRNHQMVDRRPYRTFLRLARRQNILPNYFLAYANGKSAARLSSRSLRPNGAHRFKASRGARECTVRSSILHFPFDGNEARARRRAERCDCSAEDVEKCSMLSFDRELAAEARSRVGFEDWYERRVIESDDARKNTLLAAGLYFRAHEPFLLLTKLEGLMDD

SEQ ID NO: 22253 - protein, 1023 aa, Ostreococcus tauri
  misc_feature (599)..(605): Xaa can be any naturally occurring amino acid
  unsure (1)..(1023): unsure at all Xaa locations
MGRTKQRGKTLTLGEFFAETSTQRTSGLLGARLARAVDGATDGGDDGDDDSYAEFTVEIGNASVRCAEQEGSYDVRAFAREGRNAGGKVIKSVTFVFGGKMGERRVTEAPFEVQYRCETSVDVEVAVQFHRALNARPVRELHAIELSSEEREFSRSFAVEVKRRALMKVLGKDKGDAEVDVRRAESRSSLLEESQSRGVDAWTVQDVSEWLRSIELEELVERFAKAKINGYELLRLTEKDLRESLHLERNLERVRAIRAINVLRASAGAADAENDDKSATPPLSAPLGAPRGGLSPLELELDVSWIEFVSEKARASVLIGWFMHVLDEVKAKEFDEPGPQLSVYCEATLQASKSCEDALEERVLDILESTPGWDPRTKMFPSTCDLTKLNDQLMELYLEVKAFEEFAALNMDDDRGEHERSRSTPPKMPGESSPAIPRLNRAESLTTPSVSGSPTFTSPRNDMGPSPSPSGLNVGARSFSPTPLSDLTRSSLPELQEDEVADGDRVMELNTEWEIDYNDIEFEGGVPSSKNRIGHGGFGEVFLGRYHGSLVAVKKLFNQDMMGKGLQDFRREVRILSRLRHPSIVLWLGACTQAPNLTXXXXXXXRRHGMVKITDFGLSKVKHSSRLSRQTGMTGTVNYAAPEVIRGGKFSEASDVFSFGVVMWELLTRRIPWEDLNEYQIVFQMTSELDAPLAATAKNLELPSSSPEGFRKIIHGCWATQPERRSGFKDVLVHLREEYRRVVRGRAPASPVPHRNDVHRRRETAQIAFHCNHTLSARDAHAAPTHRRVRRPSVSIARTMPRASSERERRSRSPTRRRERSDSLSKQRRRKNVRDDENRSRRSRSRSDDDEDQVRRFEKFLRRRLERQEATRRAAEKEEREALERGDALVGPPPPPESMNIASEVNHGGRLLAGEGEAMGAFVRDGQRIPRRGEIGLKTDQIEKFERLGYVMSGSRHARMNAVRMRKEAQVYSAEEKAALAALNKEERAAKEKKVLDDMRALVAAQLAAREGGASAGGVGGFT

SEQ ID NO: 22254 - protein, 193 aa, Ostreococcus tauri
MRARTGRENQRYNEQKQRLVAGCICYRRRSTPAMEDSARAWGSKGGRFLEGDVRDEVEVLMLNSKKGARVRGRDLIFPKGGWELDETDFEAAARECFEEGGVTGDVSEGNETYEFYSRSRVRAGAEGDEARCVAHVFTMRVLEEHERWPEDGVRTRYWLDPLDAWRRCKHDWMRQALVDCEHLRLGEKATISS

SEQ ID NO: 22255 - protein, 461 aa, Synechococcus sp. WH 5701
MSSLPSPASADPLTEPQLSWQQRKLDLLSQGVSYALASFVDLHGTSKAKAVPLDHFEAMLAGSELFTGAALDGVPQDVSDDEVAAIPDLATATVLPWRRDVVWLASSLHLHGQPFEACSRNILIRALDEAQRMGFRFNLGIETEFFVLRRGADGALRPASSRDTLEKPCYDLTGLLDNLPWLDELVQAMNDLGWGVYSFDHEDGNGQFETDFAYAEALTMADRLTFFRLMLKEITHRHGLIASFMPKPFSDRTGSGAHFNMSLADPATGRNLFAGDTPGAITPLAEQFIAGILRHAPAICAVIAPTVNSYKRLVAQGSMSGFTWAPVFICYGNNNRTNMLRIPSAGGRVECRAADSACNPYLGAAMILAAGLEGIREELDPGDPNLVNAYRLSAEQRAERGLRVLPRTLGDAIEAFAADPLSRSVFGDAMADAFIDYKRAEWAEYHGCVSDWELTRYLEFL

SEQ ID NO: 22256 - protein, 311 aa, Gibberella zeae PH-1
MTNDNSNNTGASNGEAKSSFTVKAGLAQMLKGGVIMDVVNAEQARIAEEAGACAVMALERVPADIRKDGGVARMSDPAMIKEIQDAVTIPVMAKARIGHFVECQILEALGVDYIDESEVLTPADDESHVEKSPFSVPFVCGCRNLGEALRRIAEGAAMIRTKGEAGTGDVVEAVRHMKTVNRDIAQAKAALAEGGIVRIREMARKLEVDAELLRQTAELGRLPVVNFAAGGVATPADAALMMQLGCDGVFVGSGIFKSGDPAKRAKAIVRATTHFRDAKVLAETSTGLGEAMVGINCDSMKPEEKLAGRGW

SEQ ID NO: 22257 - protein, 621 aa, Magnetospirillum magnetotacticum MS-1
MCGIAGLSAARPEILDEMVRRLAHRGPDGHGTFVCERTGFGLAHARLAVIDLTEGGRQPMHSPCGRWTIAFNGEIYNHAELRLELEGRGHTFRSSSDTEVLLALLAEKGEAALERLVGMFALALLDRADGSVLLARDRVGIKPLVWAGLPGGGLAFASEIKALKAVPGVDLSLDREALSQFLACLYVPAPYSIHAGIRKLAPGHLLRWKPGAAPEIACWWRPAFTAERALSVDDATEELMPALRDAVRSCMVADVPVGCFLSGGIDSSVIAALMAEARREQGASAPASFTMTFDEAAYDERVAARAVSDHVGTLHTELPASARLVDGLERMIAAFGEPFGNPTALLIGDLSAKARQHVTVALVGDGGDEVFGGYPRYQGGLLAAKWRKIPAFLRNGLIEPIVALLPESTSGRHTWRRIREFVAGAGLSDAEMYASWVEYFDPAQRRALLGGGTPPRPVADIYRATGRVHPLDAMQETDLLSFLPGNLMAYGDAMSMMHALELRLPLLDHRLIERVQAISAATRFQAGKKTLLKAAARRLLPAEIVDRPKLGFNPPMGLWLKNELAPMVAERLIPARMADLGLEWKGVEALLAEHRAGRRDLSLPVWALLVLERWQGLEASA

SEQ ID NO: 22258 - protein, 293 aa, Methanocaldococcus jannaschii DSM 2661
MNQNNDFKCHIWFTEYHNNNVALSVRVKDILYREKSGFQEIEIIDTYDFGKALILDNTFQTTERDEFIYHELISHIPLFTHPNPRNVLVIGGGDGGTVREVVKHKSVETVDFVELDEKVIEACKKYMPKLSCEIDNEKVNLIITDGIKYVAETEKKYDVIIVDCPDPVGPAKGLFEKEFYKNVFKCLNDDGIMVQQSESPLYNLDLIQNICRYLKDAGFKIIMPYTYPMPTYPSGFWSFTLASKKYNPLEVDEARIKEALKDMETKYYDEEVHKGIFLAAPKFLKDAVKKALE

SEQ ID NO: 22259 - protein, 349 aa, Oryza sativa (japonica cultivar-group)
MEGINDDSNRDIITEAAAMAFADPHLQIPDRYISAPPPPASATARASSLPVVDMARLLDPEHREAEVALLGSACRSWGFFQLINHGVDEAVIQKMKDNTVQFFELPLEDKNTVAVRPGGIEGFGHHFRSSAGKLDWAENLIVETQPFQQRNLEFWPSKPPTFRDSIDKYAMEMWNLTTRLLRFMASDLGVEQETLLAAFRGKRQTFGLHRYPPCRHPEKVIGISPHSDGFGLTLLLQVNDTLGLQVSKDGRWHPVRPLPGAFIVNVGEILEVLTNGRYKSVFHRVAVDAERGRVTVVVFQDACINGLVKPLPELGETPRYHAIGKSEYFKGHTAEVLGQGERFIDTLKK

SEQ ID NO: 22260 - protein, 400 aa, Glycine max
MQAAATTPLYQLVSFKPKLQTFPSKSQLCPLGTPFCRLGMASVSGFRLRPLRAVGGSSSSSASGDDGFVTLIEYVAKEGMNVKDDLVVLLDHIQYACKKIAALVASPFNYSLGKQTALGSVGSDRDAPKPLDIVSNEIILSSLRKSGRVAVMASEENDAPTWISDDGPYVVVTDPLDGSRNIDASIPTGTIFGIYKRLEELDDLPTEDKAMLNSLQSGSRLIAAAYVLYSSATILCITFGSGTQAFTLDHSTGDFILTNPSIKIPPRGQIYSVNDARYFDWPEGLRQYIDTVRQGKGRYPKKYSARYICSLVADLHRTLLYGGVAMNPRDHLRLVYEANPLSFIVEQAGGRGSDGKNRILSLQPVKLHQRLPLFLGSLEDMEELESYGDIQQKVNPGYEV

SEQ ID NO: 22261 - protein, 273 aa, Prochlorococcus marinus str. MIT 9312
MLIKFLQDAAGKGDLDPWDIDVISVIDSFLEQYSQSFGRKSNNQSSYHKDLSETSEAFFAASVLVNLKAQVLESDVFKENSSDFEDDFDVDDHDWIDQEFDIPKYPEKYLRRRSIAQPILKRTTTLGELVSQLESIAEVIETQDLLLMKRKRNKKYSDKALISQVKSLAHREKLPETTKALGEFIEGWEKALQWTDFECLVEKWKTVVKNDLDKDRLGVFWALLFLLSENKIEIKQINSLYGPIQIKRIIPEGGLAQLPIENLEATNTYHSAV

SEQ ID NO: 22262 - protein, 629 aa, Haloquadratum walsbyi
MPIVDINMDELRSLTAHDEKSDAEFKSDLFELGLEFEGKTDTDLLQFEFGPDRLDRLSVEGVARSLRYHYGDDRGIAVPSTNNPEFQFIVTDTVPTRRPYVTGAIARGVSLDKHALDSLIQLQEKLHATMGRKRAKGAIGIHDLTMLKGRTLDDSGVDITGGGEMVDTATDSRPTADRETNTSATDSPTHSITYTGIEPTGDTFVPLDSNRELTPAAVLDEHPTGETYADIIADYDRYPAIYDELGLFSFPPVINGRRTEVTTDSRNLLIELTGTDQWTIDRMCTIICYALTARGATIESVNIEYPEQTLSRPDLTVDTKHISHDRIETILGVSFDTAEIIDLFERAGLAATTTDTTDTAVTSNVDIDGSNNSPVYVVSIPPYRVDVLHPLDLIDDVGRAYGFDKLEPRYPDIGTVGGRHERSRLEAVTRTTLTGLGFEDLLNFHLTNKAAVYNRMRMSPLSPATFNSTTDDIDLGSAPPAEITDPYSGDYTILRPWILPSLVQVLENNTHRTYPQDLAEVGVVANRDDSVNTHVAERRHVAGAVARHDATYEDAKAALQAVCREFDATLQTPPTTHPSFIDGRTAAIIINDTSVGVIGEIHPEVLVEHDLAVPVAAFEFELAALASEA

SEQ ID NO: 22263 - protein, 494 aa, Salmonella enterica subsp. enterica serovar Typhi str. CT18
MSDVTLLAEVTTFLRQRHGQFIAGERQAGNGTNFSVTNPATGKIIADVVSTTPAQAKEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 22264 - protein, 428 aa, Listeria monocytogenes str. 4b H7858
MNVNAEGHLEIGGVDTLKLTEKYGTPLYVYDVALIRDRARGFKKTFEELGVKAQVAYASKAFSAVAIYQLMAEEGLSLDVVSGGELYTAIKANFPPERIHFHGNNKSAEEIHMALDYGIGCFVIDNYYEISLLEDILIERNEKASVLIRVTPGIEAHTHDYILTGQDDSKFGFGLTNGQAEKAIKQVLHASASFDLIGLHCHIGSQIFETTGFKLAARRIMDKLVEWHQTLGFDSKVLNLGGGFGVRYTAEDEPLEPSEYVRQIMDEVRDVANNNDIDIPEIWIEPGRSLVGEAGTTLYKVGSRKEVPGIRNYIAVDGGMSDNIRPALYDAHYDAVLAANPEKVAEETVAIAGKCCESGDMLIWDLPLPKSNAGEVLAVFCTGAYGYAMASNYNRIPRPSVVFVENGVDKLIVARETYENLVQNDLSL

SEQ ID NO: 22265 - protein, 828 aa, Photobacterium profundum SS9
MKMTRRAFVKANAAASAAAVAGITLPASAANLIVSSDETKIKWDKAPCRFCGTGCSVLVGTQNGRVVATQGDPEAPVNKGLNCIKGYFLSKIMYGKDRLQTPMLRMKNGEYNKEGDFAPVSWDQAFDVMAEKFKKALKEKGPTSVGMFGSGQWTVMEGYAASKMMKAGFRSNNIDPNARHCMASAVGGFMRTFGIDEPMGCYDDFEHADSFVLWGSNMAEMHPVLWTRITDRRLSHPHVKVNVLSTYYHRSFELADNGMIFEPQTDLAIANFIANYIIQNDAVNWDFVTKHTHFKRAETDIGYGLRDDNPLQMKAKHPNSGALHPMDFEQYKASVAEYTVEKASQMSGVSEEKLIEMAKQYADPKVKVMSLWTMGMNQHTRGVWMNSLVYNIHLLTGKISQPGNSPFSLTGQPSACGTAREVGTFSHRLPADMVVANPKHRAIAEKIWKLPDGTIPAKPGYHAVQQDRMLKDGKLNAYWVMCNNNMQAGPNINEERLPGYRNPENFIVCSDPYPTVTAQASDLILPTAMWVEKEGAYGNAERRTQAWYQQVKSQGDSKSDLWQLMEFSKRFKIEEVWGEDLLAQMPEYRGKTMYEVLFRNGQVDKFPLSEAQELNDDAKAQGFYLQKGLFEEYAAFGRGHGHDLAPYDVYHQVRGLRWPVVDGKETLWRFVEGSDPYVPEGEGFRFYGKPDGKANIIFAPFEPAPEEPDQEYDMWLCTGRVLEHWHTGTMTRRVPELYKAVPDALCFIHPDDAQKRGLRRGDEVLLESRRGEVRCRVETRGRNRPPVGLVFVPFFDARVLVNKLILDATDPLSKQTDYKKCPIKITKV

SEQ ID NO: 22266 - protein, 373 aa, Candida albicans SC5314
MSFQEIPIIDLQEAFDPATRSKFLEEVRDAIINVGFLLLKNYESLGPTEEDLQSIKQQAIEFFALPAKEKLQCEMLNSPHFLGYTRLANEITASHTDWREQIDLATELPAPKEGEPLYKNIEGPNLWPNPEVIPKFRPTIERFIEKMTALSNVFKDLVAESIGVDPKALNRYFKENQQCKMKLIAYPDVSELDGTKSAALDDTPETNQGVEPHRDSDLITYIYQATEHQNSLQVQNFQGHWITVPNIPGHLVVNNGQTLQAITGGVAKATIHRVLVPEKGTGTRISIPFFQTIDLDSSKGVVDNLPQEVIDLKNERDKKIKDWGVDTGFQFEPDVSKEPIGHAVFRNRIKSHQDVAKKWYPDVLKSVLQEYTH

SEQ ID NO: 22267 - protein, 414 aa, Aeropyrum pernix K1
MVEGVRVYGGWKDDLGLKIIPSKKVAKDLYEIYIGPQHPGSGHMRITIRVDGDIIVEADPDIGYVHRTMEKLGEIRGWIKPIPLFERMAIHDACNITLPYVLAVEKLMGVEPPLRAKYLRTLLCEINRIGAHLYGFAIFGVFLGHSTMYMWAMGDREVFIELAEALTGARLTHSYPIPGGARRDIPADFPDMARRAVRYMRKRLDEYAKIFLNNPVIRSRLEGVGVIPKKAAAEMGIVGPNARGSGIDYDVRLVHPYDAYPEIDFEVPVFEEGDALARTYVRVEEIKQSLRIIEQAVEWLEKHPREPIVDKYLYGKYPPLHKKVLEAEGRAKLLPTVAAMKVPPGRAIGRAETGRGETVYYVESDGGVNPYRVRIVTASARNVIAFKYVLPGHRVMDIPAIYGSLDYFPPEADR

SEQ ID NO: 22268 - protein, 295 aa, Staphylococcus aureus subsp. aureus Mu50
MSKIIGSDRVKRGMAEMQKGGVIMDVVNAEQARIAEEAGAVAVMALERVPSDIRAAGGVARMANPKIVEEVMNAVSIPVMAKARIGHITEARVLEAMGVDYIDESEVLTPADEEYHLRKDQFTVPFVCGCRNLGEAARRIGEGAAMLRTKGEPGTGNIVEAVRHMRQVNSEVSRLTVMNDDEIMTFAKDIGAPYEILKQIKDNGRLPVVNFAAGGVATPQDAALMMELGADGVFVGSGIFKSEDPEKFAKAIVQATTHYQDYELIGRLASELGTAMKGLDINQLSLEERMQERGW

SEQ ID NO: 22269 - protein, 242 aa, Prochlorococcus marinus str. MIT 9211
MYTWRLIERTWCSWPPKPIGLIEMIGGSYLATTPHISYKLLLEGLTRRNIAVHAWRYIPGLDHQSQANEAWRNFRLCKTKLDLRVGVMPSSLRIGHSLGCKLHLLAPDLGRNSKAFIGLCFNNFTADQSIPLVEKVSKRLNIRTEFSPSPQETLKLITKKYSQPRNLLIKFTQDNLDQTDLLLESLQNRINDQSQAIELEGNHLTPASAGLRKNVLGSWAYDQRKSQRLEILIDTIYKYLLN

SEQ ID NO: 22270 - protein, 326 aa, Aspergillus fumigatus
MAEFVRAQIFGTTFEITSRYTDLQPVGMGAFGLVCSARDQLTGQPVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIQTICSENKRIRAGEALAHEYLSPYHDPTDEPEAEEKFDWSFNDADLPVDTWKIMMYSEILDFHNIDQGNDAGQVLMEGGVAQAQQNYA

SEQ ID NO: 22271 - protein, 534 aa, Gibberella zeae PH-1
MLGQKSIKVNGADCGVEAILLGVITSIGGFLFGYDTGQISSMLLFSDFKERFAQGPAGDKEWNPYIQSILVSLMSIGSLIGALSGAYTADWWGRRKSMTFGVAVFIIGNIIQISAMESWVHMMMGRFIAGLGVGNLSVGVPMFQSECAPREIRGAVVASYQLMITIGILISNIACFGFKKMDTSSASWRIVIGLGILFSLPLGIGILIVPESPRWLASRGDWEGAQIALGRLRGMKHNLDHPLVQDDLKEMKDILEKERQVGQGSWAECFNPKSGIPKLVWRTFLGFFIHFLQQWTGVNYFFYYGASIFESAGIEDPIQTQLILGAVNVATTFMGLWFVERFGRRWPLFIGALWQAGWLAVFAAIGTAMNPSESKAVGIVLIVCACMFIASFASTWGPMAWVVIGESFPLRTRAKQASIATAGNWLGNFMIAFLTPIATAGISYGYGFVFVGTNLAAAALVWFFLFESRALSLENVDLMYGQEGLKPWNSHKWVPPGYITREQRDEVHFQRGNEKPRNSESHSGEDSRVESVMA

SEQ ID NO: 22272 - protein, 222 aa, Pinus sylvestris
MRRLRMRLASYYPACSSAWSRTRPMVTRGNFTPEEAEEKKHTGLIGKLHRTHSSSSSSSSDEEEEGEKKKEKERKKKEAKDKTNKKLPGDGQHSSDQSGIEEEKKVSLVDKFKEKLPAQPNKGEGEEKVEVEKKAGVKEKLPVQPNKGEREEKAEVEKKVGLLDKIKEKLPGHSNQKGRGREKKKKKQKWRKRRVLIDKIKEKLPGHHTKKEGEEEEKKQNY

SEQ ID NO: 22273 - protein, 276 aa, Bacillus subtilis subsp. subtilis str. 168
MSELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 22274 - protein, 713 aa, Bacillus anthracis str. Ames
MLKVKRPFDAYLDEMNKITILLPHAYGTSRTFRLQEGSNVKDLPIAHTIALPDATKYECFIEEPLDVGKYYTVRDERNEETDLQIGAVIRTEIFDEKYYYEGTDLGAVYQKEATTFKVWAPTARLAKVRIYKSDKEYTDHEMHREENGVWAHTLQGDLAGEKYTFLVCINLIWNEAVDPYAKSVTVNGKYGVVIDLEKTNVTKQEQLPPLQAMTDAILYELHIRDATIHEGSGVSKKGTYKGLMEEGTTGRNGTLTGLSHIKDLGVTHVELLPLYCFGGVDEANPSSAYNWGYNPLYYNAPTGFYATNPSDPYNRILECKQLIETFHEHGIRVIIDVVYNHVYERELSSFEKLVPGYYFRHGENGMPSNGTGVGNDIASERKMMRKFIVESILYWLTEYNVDGFRFDLMGILDVDTINIIEKEVRNIKRDALLLGEGWDLQTPLPLEEKATLNNANKMPHIAQFNDQFRDGIKGSTFHINKRGFAFGGHVDRNHLRYIASGSLLSMKETGLFLEPVQSINYVECHDNMTMWDKLMRSNEESEEILKKRHVLATAMVILSQGIPFLHAGQEFYRTKQGNENSYNANDEINQLDWDRKEKEIETVNYIKGLIAIRKEHGAFRLQNADLIKKHMTFLQTSPEVLAYHLEHVESFGPWKEIVVLFNSSLEAKTVQLPKEETWHVLVNEKQAKIEPISSFRGKELRLSPISTYILTIM

SEQ ID NO: 22275 - protein, 208 aa, Prochlorococcus marinus str. MIT 9312
MKNFLQQINSYIKEAFNAGKYLYNGLSVTFDHLRRRPVTVQYPYEKLIPSERYRGRIHYEFDKCIACEVCVRVCPINLPVVDWVMNKETKKKELRNYSIDFGVCIFCGNCVEYCPTNCLSMTEEYELATFDRHNLNFDNVALGRLPTNVTTDPSIKPLRELAYLPKGVMDPHEIPASDIRVGKLPEEVYDWMRPTSNENKDKISNSNN

SEQ ID NO: 22276 - protein, 381 aa, Prochlorococcus marinus str. MIT 9312
MDSNKLILKPGLEGVPVTNSSICDIDGNKGKLLYRGYSIEELSKKSSFLETAYLLIWGDLPTAIQLRDFEQEVQMHRRLSFRVRDMMKCFPATGHPMDALQSSAASLGLFYSRRAIDDPNYIYNAVIRLIAKIPTMIAAFQLIRKGQDPIQPRDDLTYSSNFLYMLTEKEQDPIAAKVFDRCLILHAEHSLNASTFSARVTASTLTDPYAVIASAVGTLAGPLHGGANEDVIAMLEEIKTPKNAASFLDNAIKNKSKIMGFGHREYKVKDPRAIILQKLAEELFIRFGADEMYEVAKSLEAEAIPRLGPKGIFPNVDFYSGLVYRKLGIPRDLFTPIFAISRVAGWLAHWREQLGANRIFRPSQIYTGSAPREWISLENRD

SEQ ID NO: 22277 - protein, 208 aa, Robiginitalea biformata HTCC2501
MKIRSAEFVVSNTDVSRCPAEPLPEYAFIGRSNVGKSSLINMLTDRKHLAKISGRPGKTQLINHFRINDNWFLVDLPGYGYARTSKKDKAAFQKLIHRYFRERRQLLSAFLLVDIRHEPQPIDLEFMEWLTGEGIPFALIFTKADKLKPGAVSRQTDGYLQAMRNAGWEADPPFFVTSSLKGIGKDEVLAYIGEINQNFREASGGPPQ

SEQ ID NO: 22278 - protein, 741 aa, Trichodesmium erythraeum IMS101
MLPKPNKIWNPKIWASWKPFGIGEQYPNNYWELIRAGIENIDQLPYAWNILNKGVCDGCSLGTTGMKDWTLDGFHLCNVRLRLLRLNTMPAFNPEILANISQLQNKSSGDLLQMGRLPYPMRRDKGDKGFRRISWDEAMAVISDRLKTTHPDRIGFYLTSRGTVNETYYATQKAARAIGTNNIDNAARICHSPSTGALKTTIGAAATTCSYKDWIGTDLLVFIGSNVANNQPVTVKYLHWAKKAGTKIVVINTYREPGMERYWVPSIPESALFGTKFAEDFFLVNVNGDMAFINGTIKHLIANDWIDKHFIDNYTNQFEELKASLDAQSWSELERFSGSTQDEMYAFAKMVGKAKKAVFVWSMGITQHECGEDNVRAIINLALTKGFVGREGCGLMPIRGHSGVQGGAEMGCYSTVFPGGRKINPENAEVMSKFWGFSVPNNPGLTTSEMIDNASEGKLDVLFSVGGNFLEVLPDPDYVKAAMKRVPLRVHQDIICSNQMLVEPGETVILLPTTTRYEIPGGVTETTTERRVIFSPEVPGQRIGEARPEWQVFMDLAKLVRPELADKLEFKNTGEIRQEIALVISQYSGIQHLKEPGDNFQYGGAHLCFGWNFPTPDKKAKFSILSPPKEELSKGYFLVATRRGKQFNSMVQSQKDAITGALREAILINPFDAQELGLKDGDNVRLKNDFGLFSGKVFLAPMKPGNLQVHWPEGNVLLDKGKRSVEGVPDYNALVCLEKLG

SEQ ID NO: 22279 - protein, 228 aa, Arabidopsis thaliana
MSVRARRIVSGRSETVAANYAFDPLHDDKIIRNRLLTRTTTTRGEPPLKKLQKKFTSFVIELDKEEDNYSECGRLAKAFLQELSAFEIPLLKSQVVVAANLREKENFNELKDETNRQIMQAQADIEDLKKQLEESKIERQQKEECEAIRKLISAQPPRSETQKVIHELKKEIAELEAENTASWRLLELRKKQFALLLHVETMEDEQKSMVEEMQRNITADGAEAMSID

SEQ ID NO: 22280 - protein, 575 aa, Photobacterium profundum SS9
MISGILASPGIAFGKALLLQEEEIVLSKTPISADQIDNEIQCFFDARKKSAEQLEVIKEKARITFGEEKEAIFEGHIMLLEDEELEEEIIAFIKDKKATAALAIHSIIEEQAMTLESLDDEYLKERATDIRDICNRFVKNALGISIVNLSAINEEVILVANDLTPSETAQINLDYVLGFITDIGGRTSHTSIMARSLELPAIVGTNDITTRVQDGDMLVLDAINNQVVINPTEGELAKFKAIRDQHQAEVEELAKLKDLPAITLDGKQVEVCGNIGTVKDCDGINRNGGEGVGLYRTEFLFMDRDSLPTEEEQYKAYKDVAEAMHGETVIIRTMDIGGDKDLPYLDLPKEMNPFLGWRAIRISLDRREILRDQLRGILRASAHGKIRIMFPMIISIEEIRELKAAIEEYKAELRTEGLAFDEQIEIGVMVETPAAAAIAHHLAKEVSFFSIGTNDLTQYTLAVDRGNELISHLYNPLSPAVLLVIKQVIDASHKEGKWTGMCGELAGDERATLLLLGMGLDEFSMSGISIPRIKKVIRNANFADVKAMAEQALAMPTAAEIEAHVEKFIAEKTIC

SEQ ID NO: 22281 - protein, 228 aa, Trichodesmium erythraeum IMS101
MLKAILFDFDGTIANTEPLHYKTWKETLKDYGVETDPKFYKQHISGRTNPAIIQNLLPQLSPTEAEKVANEKEAKFREMAVSLQPLTGLLDFIKWIKYNKLQKAIVTNSPPENAKFLLGFLSLKDTFPLLISGAVMPVGKPDPAPYKLCLEKLKISPEEAIVFEDSPSGIQSAVGAGICTIGVASTHERGALVEAGAKISIKDFSDEQLNKIFPSWKISDMNYLKYSA

SEQ ID NO: 22282 - protein, 475 aa, Escherichia coli
MSIRLEGYMQTTQQNAPLKRTMKTRHLIMLSLGGVIGTGLFFNTGYIISTTGAAGTLLAYLIGALVVWLVMQCLGELSVAMPETGAFHVYAARYLGPATGYTVAWLYWLTWTVALGSSFTAAGFCMQYWFPQVPVWVWCVVFCAIIFGLNVISTRFFAEGEFWFSLVKVVTIIAFIILGGAAIFGFIPMQDGSPAPGLSNITAEGWFPHGGLPILMTMVAVNFAFSGTELIGIAAGETENPRKVIPVAIRTTIARLIIFFIGTVFVLAALIPMQQVGVEKSPFVLVFEKVGIPYAADIFNFVILTAILSAANSGLYASGRMLWSLSNERTLPACFARVTKNGVPLTALSVSMLGGVLALFSSVVAPDTVFVALSAISGFAVVAVWLSICASHFVFRRRHLQQGKALSELHYRAPWYPLVPVLGFVLCLVACVGLAFDPAQRIALWCGLPFVALCYGAYFLTQPRNAKQEPEHVAE

SEQ ID NO: 22283 - protein, 389 aa, Bacillus sp. B-0618
STHFDVIVVGAGSMGMAAGYQLAKQGVKTLLVDAFDPPHTNGSHHGDTRIIRHAYGEGREYVPLALRSQELWYELEKETHHKIFTKTGVLVFGPKGESAFVAETMEAAKEHSLTVDLLEGDEINKRWPGITVPENYNAIFEPNSGVLFSENCIRAYRELAEARGAKVLTHTRVEDFDISPDSVKIETANGSYTADKLIVSMGAWNSKLLSKLNLDIPLQPYRQVVGFFESDESKYSNDIDFPGFMVEVPNGIYYGFPSFGGCGLKLGYHTFGQKIDPDTINREFGVYPEDESNLRAFLEEYMPGANGELKRGAVCMYTKTLDEHFIIDLHPEHSNVVIAAGFSGHGFKFSSGVGEVLSQLALTGKTEHDISIFSINRPALKESLQKTTI

SEQ ID NO: 22284 - protein, 692 aa, Sinorhizobium meliloti 1021
MAQAALKKDRRNAPDESIDWKKVVQLLLLSRALDEMEEQRLVPEKKILYQFSARGHDMAQILLGLHLTGRHDAACGYYRSRPLLLALGVDPADALGSAMGRAGGYSDGRDIGVVFNYPNPHGASALPMCGGVGTQYTPTAGWAQAITYFSEVLGKEEYQKDIAVVLGGDGSVASNGFWSALTIATTQGLPLLFYIEDNGFGISVPSSFQTPEGNIAGNLAGWKNLTVLDGDGSDPEEAARLTKGAVELVREGRMPVLLRLEVPRLEGHSFQDTQTYKSEELVRSEWAHDPLPRLRDYIVPAMLSAEEWNEAARDAKAAAERARVEAESRPVADPETVTSHVFFEGRMQVMGGQHPAGYRPPKTTETATGDGQRINMVTAIRRTLDHEMTVNQRVVLFGEDIGPKGGVHAVTLGLQEKFGTARVFDTSLSEEGIIGRAVGMALAGLVPVPEIQFRKYAEPAIEQLNDCGTIRWRTSNRFAAPIVVRMAGGFLKCGDPWHSQTNEVAFVHQPGWKIAVPSNAEDAVGLLRTALRGNDPVIFFEHRAMLDHPWARRPYPGDAFALPFGKAKFTREGRDITIVTWGAMVPRCEEAAEGISADVIDLRTLMPWDRKAVIASVRRTRRCLIVHEDLATAGFGAEIAAAVADEAFIDLDAPISRLTMPDIPSPHNPALLDWAVPSTERIRRKIIDLLEF

SEQ ID NO: 22285 - protein, 575 aa, Hevea brasiliensis
MDTTGRLHHRKHATPVEDRSPTTPKASDALPLPLYLTNAVFFTLFFSVAYYLLHRWRDKIRNSTPLHIVTLSEIVAIVSLIASFIYLLGFFGIDFVQSFIARASHDVWDLEDTDPNYLIDEDHRLVTCPPANISTKTTIIAAPTKLPTSEPLIAPLVSEEDEMIVNSVVDGKIPSYSLESKLGDCKRAAAIRREALQRMTRRSLEGLPVEGFDYESILGQCCEMPVGYVQIPVGIAGPLLLNGREYSVPMATTEGCLVASTNRGCKAIYLSGGATSVLLKDGMTRAPVVRFASATRAAELKFFLEDPDNFDTLAVVFNKSSRFARLQGIKCSIAGKNLYIRFSYSTGDAMGMNMVSKGVQNVLEFLQSDFSDMDVIGISGNFCSDKKPAAVNWIEGRGKSVVCEAIIKEEVVKKVLKTNVASLVELNMLKNLAGSAVAGALGGFNAHAGNIVSAIFIATGQDPAQNVESSHCITMMEAVNDGKDLHISVTMPSIEVGTVGGGTQLASQSACLNLLGVKGANKESPGSNSRLLAAIVAGSVLAGELSLMSAIAAGQLVKSHMKYNRSSKDMSKAAS

SEQ ID NO: 22286 - protein, 382 aa, Oryza sativa (indica cultivar-group)
MGKGGKGAEAAAAAVAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPVHGSLANQASKQFSSISISLQEEDAILINVVLPENVSLEEGAMCEPLSVGVHACRRADVGPETGVLIMGAGPIGLVTLLAARAFGATRVVIVDVDEHRLSVARSLGADAAVRVSARAEDVGEEVERIRAAMGGDIDVSLDCAGFSKTVATALEATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 22287 - protein, 145 aa, Actinidia deliciosa
MEQDFHAERIKEFLREVAIMKRLRHPNIVLFMGAVTQPPNLSIVTEYLSRGSLYRLLHKPGAREVLDERRRLSMAYDVAKGVNYLHNRNPPIVHRDLKSPNLLVDKKYTVKVCDFGLSRLKANTFLSSKSAAGTPEWMAPEVQRD

SEQ ID NO: 22288 - protein, 327 aa, Prochlorococcus marinus str. MIT 9211
MAGTLLFNALREAIDEEMAKDPHVCVMGEDVGEYGGSYKVTKDLYEKYGELRVLDTPIAENSFTGMAVGAAMTGLRPIVEGMNMGFLLLAFNQISNNMGMLRYTSGGNFTIPTVVRGPGGVGRQLGAEHSQRLEAYFHAVPGIKIVACSTPTNAKGLMKAAIRDNNPVLFFEHVLLYNLSEELPDGDYVCALDQADVVKEGKDLTLLTYSRMRHHCLKALPQLEEKGIDAELIDLISLKPFDMETICKSIKKTHRVIIVEECMKTGGIGAELIALINENCFDDLDSRPIRLSSQDIPTPYNGQLENLTIIQPHQIVESAEEIIKKGL

SEQ ID NO: 22289 - protein, 486 aa, Bradyrhizobium japonicum USDA 110
MLPRSAGAGRNKVAVARCPFGQPTGALVMSMQNVAAPALQFTAPRRNELTHIPGDEGWPVIGKTFQVLADPKGHIEANGAKYGPVYRTHVFGETNVVLLGPEANELVMFDQQKLFSSTHGWNKVLGLLFPRGLMLLDFDEHRLHRKALSVAFKSGPMKSYLSDLDRGISARVAQWKAKPGEMQLYPAMKQLTLDLAAASFLGADIGPEVDEINRAFVDMVAAAVAPIRRPLPGTQMARGVAGRKRIVAYFRQQIPLRRGNHGGDDLFSQLCRATHEDGALLSEQDIIDHMSFLMMAAHDTLTSSLTSFIGELAANPDWQDRLRAEVLALGLAPGAPSSFDDLEKMPLSEMAFKEALRIKPPVPSMPRRAMRDFTFKGFRIPAGTAVGVNPLYTHHMKDIWPEPDRFDPLRFTEEAQRNRHRFAWVPFGGGAHMCLGLHFAYMQAKCFARHFLQNIEVSLAPGYKPDWQMWPIPKPRDGLKVRVKAV

SEQ ID NO: 22290 - protein, 322 aa, Gibberella zeae PH-1
MPSTLLETPTMGSPKASQLRLGDGVYVPTLAFFTPEDEVDGPALEKHIVKLLEAGVAGIVVHGSNGECAHLSPSERTTIIRVARDTIIHEASGTRVPLIAGCGAQSTRETTELCEDAGKAGATHALVLPPSYYGGLLPDDLIIQHFYAVADKSPIPILVYNFPGAAAGRDLSSDTILSIAKHPNVVGVKLTCGNTGKLTRIVADCPEGFFVGGGSADFILQGHAVGGNGTISGLANLCPRACVRITELANEGNWMEARQLQAKVAKADWMAIKTGFVGVKAALGHFGGYGGEPRRPCVAPSQKELDTIALGFQEVMDLETTL

SEQ ID NO: 22291 - protein, 435 aa, Fulvimarina pelagi HTCC2506
MTLSLSAFAQERGVKYFMISFTDLFGAQRAKLVPAEAIDDMQKDGAGFAGFATWLDLTPAHPDLFAMPDGDAAIQLPWKPEVAWVPADCVMEDKPVAQAPRVVLKRLVDQAADEGLRVKTGVEAEFFLITPNGERISDEFDTAVKPCYDQQAVMRRYDVIAEICDHMLSLGWKPYQNDHEDANGQFEMNWEYDDALATADKHSFFKFMVRSVAEKHGLRATFMPKPFTDLTGNGCHCHISVWNKDSSVNAFADKDAPFGLSAKGKTFLGGIMRHGPALAAITNPTVNSYKRINAPRTTSGATWAPNAITWTGNNRTHMVRVPGPGRFELRLPDGAANPYLLQAVIIAAGLSGMKANADPGPHSDLNMYEEGHRAKNTPRLPLNLLDALRALERDEPFCEALGGEFVSSYLKKKREEWTSYASAITQWEHDNTLDI

SEQ ID NO: 22292 - protein, 480 aa, Capsicum annuum [sequence omitted]

SEQ ID NO: 22293 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCSYYTKSFRGSVDPFHVDAVDTTGAGDSFVGALLCKIVDDRAVLEDEARLREVLRLANACGAITTTKKGAIPALPTESEVQSLLKGN

SEQ ID NO: 22294 - protein, 252 aa, Brassica napus
  misc_feature (162)..(162): Xaa can be any naturally occurring amino acid
  unsure (1)..(252): unsure at all Xaa locations
TSNRIRLAPTQSVLVRSSSKAEGSVDVPYISDENADEDPEVRVSVKDEGAVGKTLKEAMVKKGKGVVLEKVRVFVEAMARGGPCRDELENKKVAPKSAPAAATVEKTSTLPAVVVKEKKKVKTKEGFKTITMTEKFSCRAKDLYEILMDEDRWKGFTQSNAXKISKDVNGPISVFDGSVTGMNVELGEGKLIVQKWRFGSWPDGLDSTVKIAFEEPEPGVTIVNLTHTDVPEEDRYGNATVVENTERGWRDL

SEQ ID NO: 22295 - protein, 391 aa, Triticum aestivum
  misc_feature (223)..(223): Xaa can be any naturally occurring amino acid
  misc_feature (226)..(227): Xaa can be any naturally occurring amino acid
  misc_feature (230)..(230): Xaa can be any naturally occurring amino acid
  misc_feature (241)..(241): Xaa can be any naturally occurring amino acid
  misc_feature (244)..(244): Xaa can be any naturally occurring amino acid
  unsure (1)..(391): unsure at all Xaa locations
MLRLRCCLLTQLLWPPSSASPTSHLSRLISAAAPAVFPNPSFAVEEYLVATCGLTPVQAFKASAKLSHLKSPSKPDAVLAFLADLGLSGADVAALVAKDPQFLCAKVDKTLAPVVLGLTGLGLSRSQIARLVSLSRGHFRSRSIVSNLHYCLRLFGSSEDLFRVLKCGAGLLSADIERVVKPNAAFLRECGLSDCDIVKLCIVQPWLLPSSMERIRAMAAPPXERXXGVXSWPVKMFQDTXLAXLLRASGKEKDRPPKVEHLKKTFMWSDAEVGVVVSKHPSVLIRSNQMLQSKSEFLISEVGLEPTYIAHRPALLTYSLEVRLRPRHYVVKFLKESGLLDRGRDYYRAVMISEKEFVEKFICPHKEAAPHLAEDYAAACRGEVPSSFRFT

SEQ ID NO: 22296 - protein, 325 aa, Robiginitalea biformata HTCC2501
MKTSARIREPIDKEMELFEKKFHQSMSSKVPLLNRITYYIVNRKGKQMRPMFVFLTAKLLNEGQVNERTYRGASVIELIHTASLVHDDVVDESFKRRGFFSINALWKNKIAVLVGDFLLARGMLLSVDNGDFDLLRIISAAMREISEGELLQLEKARRLDITEEVYYEIIRQKTATLIAACCSLGAASVRPDSEYVEMFRKFGERCGMAFQIKDDLFDYGENRIGKPTGIDIKEQKMTLPLIYALNSASERDRKWLINSVKNYNTDKKRVREVIDFVKSSGGLEYAEGRMQEFKQEALEMLKPFPQSSYREALELMVNYVVDRRQ

SEQ ID NO: 22297 - protein, 494 aa, Bacillus cereus ATCC 14579
MSQLAVNLHEKVEKFLQGTKKLYVNGSFIESASGKTFKTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGVGLNPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 22298 - protein, 389 aa, Bacillus sp. B-0618
  misc_feature (14)..(14): Xaa can be any naturally occurring amino acid
  misc_feature (16)..(16): Xaa can be any naturally occurring amino acid
  misc_feature (105)..(105): Xaa can be any naturally occurring amino acid
  misc_feature (201)..(201): Xaa can be any naturally occurring amino acid
  misc_feature (245)..(245): Xaa can be any naturally occurring amino acid
  misc_feature (302)..(302): Xaa can be any naturally occurring amino acid
  misc_feature (316)..(316): Xaa can be any naturally occurring amino acid
  unsure (1)..(389): unsure at all Xaa locations
STHFDVIVVGAGSXGXAAGYQLAKQGVKTLLVDAFDPPHTNGSHHGDTRIIRHAYGEGREYVPLALRSQELWYELEKETHHKIFTKTGVLVFGPKGESAFVAETXEAAKEHSLTVDLLEGDEINKRWPGITVPENYNAIFEPNSGVLFSENCIRAYRELAEARGAKVLTHTRVEDFDISPDSVKIETANGSYTADKLIVSXGAWNSKLLSKLNLDIPLQPYRQVVGFFESDESKYSNDIDFPGFXVEVPNGIYYGFPSFGGCGLKLGYHTFGQKIDPDTINREFGVYPEDESNLRAFLEEYXPGANGELKRGAVCXYTKTLDEHFIIDLHPEHSNVVIAAGFSGHGFKFSSGVGEVLSQLALTGKTEHDISIFSINRPALKESLQKTTI

SEQ ID NO: 22299 - protein, 673 aa, Kineococcus radiotolerans SRS30216
MVDNSTPYPLGVTVREDGLNVAVYSETAEAVDVAVFDDGSETTHRLDQRTGHVFHGIVPGGVGTRYGFRVHGEWEPAEGLRHNAAKLLLDPYARAVEGQWGAGEETFGHLFADPEQRNDADSAPSVPRAVVVDPAFDWAGDRAPRTPLADTVVYEVHVKGFTQQHPDVPEEIRGTYAGLAHPAAIQHLLDLGVTAVELLPVHQFVQDSHLAEKGLRNYWGYNSIGFFAPHNEYSAAGDDGSQVREFKEMVKALHAAGLEVILDVVYNHTAEGNHMGPTLSLKGIDNGSYYRVVEEEPENYFDTTGTGNSLNVSHPAALQLILDSLRYWVSEMHVDGFRFDLATTLTRQWGDAHVHSAFLDIVHQDPVLAPVKLIAEPWDTQGYQVGGFPARWSEWNGKYRDDVRDFWRGQGSLGALTQRLTGSPDVYEADRRSPLCSVNFLTAHDGFTLADLTAYDEKHNEANGENSQDGESDNRSWNCGAEGPTDDEAVNALRDRQRRNLLTTLLLSAGVPMLLGGDEFGRTQGGNNNAYCQDDEISWFDWAGADRELLGFTRELLRLRRETSALRGAWYRGDGLDGSPDAVLSLRADGEPMTQAEWDDGNARAYGVQFSAEGSATVLLLVNGATNPVEFTVPKAPAGPWKLVVSSDPQQEVGREVADLLVGEWSTTVLRSA

SEQ ID NO: 22300 - protein, 185 aa, Thiomicrospira crunogena XCL-2
MSQKKVLIPLAQGCEEIEAVTLIDLLVRAEIEVVTASLDDNRTITASRGVQLIAQTTLESVLKTPFDLVVLPGGLPGADHLNKDLRLHQLLKDVLVAGGYVGAICAAPKVLVSAGLLEGKQATSFPGVIDQHPAEGMTYLNEPVVVDGQIITSRGPGTAIAFALTLIEMLVGASKRAEVQASLQI

SEQ ID NO: 22301 - protein, 452 aa, Zea mays
MSRPHDGHRSFFPMGNPFRMILPRGARLPPKLTELLTSYEDGLASSLRKVKPEATSEVFTLSWMKLAVECLSELHTNIATLITELELPLSDWDEKWVDIYLNSSVKLLDICIALSSELSRLDQGQLLVRYLLNVLNSGSDMPSQEQLRRAEVSLKEWIERASERSPRLDSCLAALQELSGNLSLMKVRHSAKGKVLMRALYGIEAVTVLICSVLVAVLSGTFKPLVDFDVPEKFGWSTAFIDLQKAISGELSRQLSRGSVAAVKELEDVDVCAKQLHTLTCTVQLEEENASLAHSFSRSKEVVLADTTAQGRGHADNLKLADDSSCQHEVIMLQSITTEGGMDTADIKEDTETIGHTKEVMAPEKIIDRGHQDDNTKQDTGVVTDISCLERREELLNCISRMSKSAERLQLGLDSLSKRVDDFFHIVLTGRDALLCNLRFSNGGKVAAEVRS

SEQ ID NO: 22302 - protein, 512 aa, Zea mays
MSSKALSPVFSRFGRGGRERRESILQYPPPPRPSLSLFKRIEKIRGKSSSARYINPNLVGFAAKAHQLEALRCSSCMLELSRARFDEILHPFCAWTTRLRLFLRGGVPAVSRPRSSPVLSGAGSGFVPGSRVDLTRVSSCHLGEPAFPGNLGGRFVLLRGRKARIHADPVREVDHFDCLPDSLVLLILNKVEDVRSLGRCYAVSKRLCGLVPLVHDVYVKIDRVVAVDGDAEDALNLSSPKPRNIFSHFLKLMLFTIIKPFHNMRNPNGTGRSLFPQLSHHSPAQVLRNFTHIRNLRIELPSGDVGTEEGVLLKWRAEYGSTLQSCVILGGTRVDRKPVGGEHEQSLEDNGSMPESFYTNGGLKLRVVWTISSLIAASTRHYLLRSIINDHPTLLSLVLTDADGQGTLCMGAEQLKEFRENQLSASACSNRTQVPACNMKLKYAPYLELPGGMALQGATLVAIKPSPDGSNGSHPNRKEADAFVFGAFDGPFKAAVKALMKRRTYLLEMNGF

SEQ ID NO: 22303 - protein, 286 aa, Sinorhizobium meliloti 1021
MTETLVRSLKAGLIGTGIQASLTPAMHMAEGAAQGIRYDYELIDLNLLGASEKDLPRLLADAERRGFAGLNITHPCKQAVIPYLDELASEARQLGAVNTVVLRSGRRYGHNTDWWGFAEGFRRGLPDADLFSAVQLGAGGAGVATAYAALSLGLQRLVVFDREAGRAQALARMLSPLFPRAEVAAGNDLPSEMRNAAGLIHATPTGMAKYPGLPLDAELLSRSLWVAEIVYFPLETALLREARRRGCKTLDGGGMAVFQAVGAFRLFTGLEPDAARMLGHFRAMTG

SEQ ID NO: 22304 - protein, 399 aa, Bacillus subtilis subsp. subtilis str. 168
MEITPSDVIKTLPRQEFSLVFQKVKEMEKTGAHIINLGQGNPDLPTPPHIVEALREASLNPSFHGYGPFRGYPFLKEAIAAFYKREYGVTINPETEVALFGGGKAGLYVLTQCLLNPGDIALVPNPGYPEYLSGITMARAELYEMPLYEENGYLPDFEKIDPAVLEKAKLMFLNYPNNPTGAVADAAFYAKAAAFAKEHNIHLIHDFAYGAFEFDQKPASFLEAEDAKTVGAELYSFSKTFNMAGWRMAFAVGNEKIIQAVNEFQDHVFVGMFGGLQQAASAALSGDPEHTESLKRIYKERIDFFTALCEKELGWKMEKPKGTFYVWAEIPNTFETSHQFSDYLLEHAHVVVTPGEIFGSNGKRHVRISMVSKQEDLREFVTRIQKLNLPFGSLQETSR

SEQ ID NO: 22305 - protein, 548 aa, Bradyrhizobium sp. BTAi1
MLADPENQRDNHARAAVLDEAHIGDIKGAFGSIQRGDELPRASLKARLTTLLAIIGPGLIVMVGDNDAGAFGTYTQAGQVYGTRLLWVLLVLVPVLYVNQEMVLRLGVVTGVGHARLILERFGKFWGAFSVIDLFILNALTIVTEFIGISLGMDYLGIPKMFGVPISAVLIVAAASTGSFKRFEQVCMALVAGSLLLVPIFVMAHPSGGQMLHDFVVPGLPKGSDLSAVVLLIIAIIGTTIAPWQLFFQQSYLIDKRITPRFMNYERTDLWIGIAIVIIGAAAIIAFTAATFAGHPEFGNFTDAEGVAQGLQKYVGHVAGVLFALALIDASIIGAAAVGLATSYALGDVLGLKHSLHRKISDAKGFYAVFAGILFVSAIVVLVPGSPLGLLTVGVQVLAGVLLPSATVFLLLLCNDTEVVGPWVNGLFANLFTSAVIAVLVVLSLVLTASVLFPDISAQTIILILEIGAAVSAVSAAAFFTYRRLHPAAPKVAVDTSLRATWRMAPLALLKAPQLSAEVRIGLTVLRTYLLIAMILVIVRVVEVALGH

SEQ ID NO: 22306 - protein, 395 aa, Prochlorococcus marinus str. MIT 9312
MAQLETRTEPMVVNFGPHHPSMHGVLRLVVTLDGENVIDCEPVIGYLHRGMEKIAENRTNVMYVPYVSRMDYAAGMFYEAIVVNAPERLANIPVPKRASYIRVLMLELNRIANHLLWLGPFLADVGAQTPFFYIFREREMIYDLWEAATGQRLINNNFFRIGGVACDLPYGWLEKCIDFCDWFGPKIDEYEKLITNNPIFRKRIEGLGTIERDQAINWSLSGPMLRASGVSWDLRKVDSYECYDDFDWQIASEKEGDCYARYRVRVEEMRQSLSIIRQACKMIPGGPTENLEAQRMATEDKKSEIFGIDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 22307 - protein, 661 aa, Streptococcus agalactiae A909
MTFDTIDQLAVNTVRTLSIDAIQAANSGHPGLPMGAAPMAYVLWNKFLNVNPKTSRNWTNRDRFVLSAGHGSALLYSLLHLAGYDLSIDDLKQFRQWGSKTPGHPEVNHTDGVEATTGPLGQGIANAVGMAMAEAHLAAKFNKPGFDLVDHYTYTLHGDGCLMEGVSQEAASLAGHLKLGKLVLLYDSNDISLDGPTSQSFTEDVKGRFESYGWQHILVKDGNDLEAIAAAIEAAKAETDKPTIIEVKTIIGFGAEKQGTSSVHGAPLGAEGITFAKKAYGWEYPDFTVPAEVADRFASDLQARGAKAEEAWNDLFAKYEVEYPELATEYKEAFAGQAETVELKAHDLGSSVASRVSSQQAIQQLSTQLPNLWGGSADLSASNNTMVAAETDFQASNYAGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWQRAVSETDRPTMLVLTRQNLPVLEGTSELAQEGVNKGAYILSEAKGELDGIIIATGSEVKLALDTQDKLESEGIHVRVVSMPAQNIFDEQEASYQEQVLPSAVTKRLAIEAGSSFGWGKYVGLNGLTLTIDTWGASAPGNRIFEEYGFTVENAVSLYKEL

SEQ ID NO: 22308 - protein, 470 aa, Bacillus subtilis subsp. subtilis str. 168
MQNHKNELQRSMKSRHLFMIALGGVIGTGLFLGSGFTISQAGPLGAIAAYIIGGFLMYLVMLCLGELAVAMPVAGSFQAYATKFLGQSTGFMIGWLYWFSWANTVGLELTSAGILMQRWLPSVPIWIWCLVFGIVIFLINALSVRSFAEMEFWFSSIKVAAIILFIVIGGAAVFGLIDFKGGQETPFLSNFMTDRGLFPNGVLAVMFTLVMVNFSFQGTELVGIAAGESESPEKTLPKSIRNVIWRTLFFFVLAMFVLVAILPYKTAGVIESPFVAVLDQIGIPFSADIMNFVILTAILSVANSGLYAASRMMWSLSSNQMGPSFLTRLTKKGVPMNALLITLGISGCSLLTSVMAAETVYLWCISISGMVTVVAWMSICASQFFFRRRFLAEGGNVNDLEFRTPLYPLVPILGFCLYGCVLISLIFIPDQRIGLYCGVPIIIFCYAYYHLSIKKRINHETIEKKQTEAQ

SEQ ID NO: 22309 - protein, 347 aa, Robiginitalea biformata HTCC2501
MKSEAKKDIRALSREQLRDFFESRGMEAFRGNQVYEWLWKKGAHDFDAMTNLSLDLREQLAAEFTINHIEVDRMQRSADGTVKNAVRLHDGLVVESVLIPTENRTTACVSSQVGCSLDCKFCATARLKRMRNLNPDEIYDQVVVIDRQSRLYFGRPLSNIVFMGMGEPLMNYPNMMKAIDKITSEEGLGMSPRRITVSTSGVPKMIRRMAEEGPRFNLAVSLHSAIDSTRSTIMPFNETFPLDDLRDAIVYWYEKTGNRVTYEYVVWEGINDGPEDVAALLAFCRAAPCKVNLIEYNPIGDDAFRQASEPALQAYINALEGAGITVTVRRSRGKDIDAACGQLANKG

SEQ ID NO: 22310 - protein, 294 aa, Salmonella enterica subsp. enterica serovar Typhi str. CT18
MSHLYDPTTQYYTGEYPKQKQPAPGVQAKMTPVPDCGEKSYVGSGRLKDRKALVTGGDSGIGRAAAIAYAREGTDVAINYLPAEEEDAQQVKALIEECGRKAVLLPGDLSDESFARSLVHKAREALGGLDILALVAGKQTAIPEIKDLTSEQFQQTFAVNVFALFWITQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 22311 - protein, 141 aa, Bacillus cereus ATCC 14579
MVTILHNDPLMAAVISWFLAQSTKVVFQLVKTGEFDFAKFFASGGMPSSHASTVTALATGVGVVEGVESSMFAVATIFAIIVMYDASGVRLAVSKQAKILNDFFHGRETEYKKLNELVGHTPYEVVVGALLGIIVGVGYCL

SEQ ID NO: 22312 - protein, 357 aa, Oryza sativa (japonica cultivar-group)
MGIAAGAALPGGPAGPAGGLFACRSAAASMRQTYLDLAAAAVAARSASCTSWADAMRASSPTRSSRSASDVDEFTAWVRKHPSALSKFEEIAAKSRGKKIVMFMDYDGTLSPIVADPDTAYMSDAMRAAVREVAKTFPTAIVSGRCRDKVRNFVGLSDLYYAGSHGMDIKGPSSNPESALCQPASEFLPMIDEVYKTLVEKTKSTPGAKVENNKFCLSVHFRCVDEKRWNALGEQVKAVIKEYPKLKLTQGRKVLEIRPSIEWDKGKALEFLLESLGFANCGDVMPVYIGDDRTDEDAFKVLRKRGQGLGILVSKCPKDTNASYSLQDPTEVMEFLLRLVEWKRKSSSSSLMIRPRV

SEQ ID NO: 22313 - protein, 130 aa, Oryza sativa
  misc_feature (85)..(85): Xaa can be any naturally occurring amino acid
  misc_feature (98)..(98): Xaa can be any naturally occurring amino acid
  unsure (1)..(130): unsure at all Xaa locations
DTTVATLQGLKSTAVMPVARRSGNSSLGNVSNGGRIRCMQVWPIEGMKKVETFCYLSPMTVEDLLKHIEYLLRYKWVPCLEFRQXVGSRYRENHRTRXYYDGRYWTMWKLPMFRGTDATQVLKELEEAKK

SEQ ID NO: 22314 - protein, 408 aa, Oryza sativa (japonica cultivar-group)
MGASGKWIKSLVSLKAAPEGTTKGRRWTRLWRSSSSASASASTAGDASESASSEADAFSSVVAAVVRAPPRDFRVIRQEWAAVRVQAAFRAFLARRALKALRGIVRLQALVRGRLVRRQLAVTLKCMNALLRVQERARERRARCSADGRDSQDAVGERDGRADPIKQAEEQWCDSQGSVSEVRSKIHMRHDAVAKRERAIAYALSHQPRSSKQSARPSSPARSLRNHESNRCNHDWSYIEGWMATKPWESRLMEQSHAELKCSKNSGELNLAGAQLSNASSVKMRGNRVAAKPPSVLSASSSDFPCDVSSASTSSATPARSDGGHGEGPSYMSLTKSAKARQSCNSPFQIQRQRSGGMSSYKRVALSPLDVQSNACSEFSVTSRKLNSLSLKGRSMTRSLDKENDNLF

SEQ ID NO: 22315 - protein, 225 aa, Zea mays
MLFLRCQPRVPSASASAPPFRPRVRVAAPLGVRVTGGRRGQAVVAMASADARLAGIASSIRVIPDFPKPGIMFQDITTLLLDPKAFRDTIDLFVERYKDQGITVVAGVEARGFIFGPPIALAIGAKFVPLRKPKKLPGEVISEEYSLEYGTDKIEMHVGAVQANDRALVVDDLIATGGTLCAAVKLIERVGAKVVECACVIELAELKGRDKLGDRAVFVLVEADA

SEQ ID NO: 22316 - protein, 515 aa, Bacillus subtilis subsp. subtilis str. 168
MTVTYAHEPFTDFTEAKNKTAFGESLAFVNTQLGKHYPLVINGEKIETDRKIISINPANKEEIIGYASTADQELAEKAMQAALQAFDSWKKQRPEHRANILFKAAAILRRRKHEFSSYLVKEAGKPWKEADADTAEAIDFLEFYARQMLKLKEGAPVKSRAGEVNQYHYEALGVGIVISPFNFPLAIMAGTAVAAIVTGNTILLKPADAAPVVAAKFVEVMEEAGLPNGVLNYIPGDGAEIGDFLVEHPKTRFVSFTGSRAVGCRIYERAAKVQPGQKWLKRVIAEMGGKDTVLVDKDADLDLAASSIVYSAFGYSGQKCSAGSRAVIHQDVYDEVVEKAVALTKTLTVGNPEDPDTYMGPVIHEASYNKVMKYIEIGKSEGKLLAGGEGDDSKGYFIQPTIFADVDENARLMQEEIFGPVVAICKARDFDHMLEIANNTEYGLTGALLTKNRAHIERAREDFHVGNLYFNRGCTGAIVGYQPFGGFNMSGTDSKAGGPDYLILHMQAKTTSEAF

SEQ ID NO: 22317 - protein, 424 aa, Bacillus subtilis subsp. subtilis str. 168
MSAKQVSKDEEKEALNLFLSTQTIIKEALRKLGYPGDMYELMKEPQRMLTVRIPVKMDNGSVKVFTGYRSQHNDAVGPTKGGVRFHPEVNEEEVKALSIWMTLKCGIANLPYGGGKGGIICDPRTMSFGELERLSRGYVRAISQIVGPTKDIPAPDVYTNSQIMAWMMDEYSRLREFDSPGFITGKPLVLGGSQGRETATAQGVTICIEEAVKKKGIKLQNARIIIQGFGNAGSFLAKFMHDAGAKVIGISDANGGLYNPDGLDIPYLLDKRDSFGMVTNLFTDVITNEELLEKDCDILVPAAISNQITAKNAHNIQASIVVERANGPTTIDATKILNERGVLLVPDILASAGGVTVSYFEWVQNNQGYYWSEEEVAEKLRSVMVSSFETIYQTAATHKVDMRLAAYMTGIRKSAEASRFRGWV

SEQ ID NO: 22318 - protein, 451 aa, Thiomicrospira crunogena XCL-2
MNHDIESKKQALKDMGVKYCLGAYVDIHGIPKGKFVPIDHLGHMLEGSELYTGYALDGLGQMPNEDEIASVPDLDSLIQLPWQPEVAWMAADNTLHGEPYEINTRVALKKVLAEAEEMGFGFNLGIECELFVLKEEEDGSLSVPDRDDKLIKPCYDVRSFMNRFTWLDKMSTTINDLGWDLYSLDHEDANGQYEFDFQYSDALTMCDRFIFFRYMAKHYAQEEGLLATLMPKPFADKTGNGAHFNMSLFDKETGKNVFACDPKDDPRGLGLTELGYQFIAGVLKHGPALCAVFSPTVNSYKRLIRQGAMSTFSWAPVFNSFGSNNRTNSVRVPLGGGRFESRNADGSVNPYLASALVLAAGLEGIKEKLDPGLPQEENLYELSESERMEKGIEFLPQNLGEAVRAFADDPFVEKVLGKGLSDEFIKYKSQEWEEYHRTVSAWEIERYSHLF

SEQ ID NO: 22319 - protein, 578 aa, Avena sativa
MALLCSALSNSTHPSFRSHIAGANSENLWHLSAHPAQKSKRRCNLTLSSRAAARISSALESGKLKPWQIPKRDWFPPEFTFGAASAAYQIEGAWNEGGKGPSSWDNFCHNYPERIMDGSNWDVAANSYYMYKEDVRMLKEIGMDSYRFSISWPRILPEGTLEGGINHEGIQYYNDLLDCLIENGIKPYITLFHWDTPQALADKYNDFLDRRIVKDYTDYATVCFEHFGDKVKNWITFNEPHSFCGLAYGTGLHAPGLCSPGMDCAIPQGDALRQPYIVGHNLLLAHAETVDVYKKFYKGDDGQIGMVMDVMAYEPYGNNFVDQQAQERSIDFHIGWFLEPMVRGDYPFSMRSLVGDRLPFFTKSEQEKLVSSYDFVGINYYTARFSEHIDISPEIIPKLNTDDAYSTPEFNDSNGIPIGPDLGMYWILSYPKGLKDILLLMKEKYGNPPIYITENGTADMDGWGNPPMTDPLDDPLRIEYLQQHMTAIKEAIDLGADVRGHFTWSLIDNFEWSMGYLSRFGIVYIDRNDGFKRIMKKSAKWLKEFNGATKEVNNKILGASSCCSGELMWFLVQNPYGK

SEQ ID NO: 22320 - protein, 1444 aa, Saccharomyces cerevisiae
MAPNKSDAQSIFSSGVEGVNPIFSDPEAPGYDPKLDPNSENFSSAAWVKNMAHLSAADPDFYKPYSLGCAWKNLSASGASADVAYQSTVVNIPYKILKSGLRKFQRSKETLTFQILKPMDGCLNPGELLIVLGRPGSGCTTLLKSISSNTHGFTLGADTKISYSGYSGDDIKKHFRGEVVYNAEADVHLPHLTVFETLVTVARLKTPQNRIKGVDRESYANHLAEVAMATYGLSHTRNTKVGNDIVRVVSGGERKRVSIAEVSICGSKFQCWDNATRGLEFIRALKTQADISNTSATVAIYQCSQDAYDLFNKVCVLDDGYQIYYGPADKAKKYFEDMGYVCPSRQTTADFLTSVTSPSERTLNKDMLKKGIHIPQTPKEMNDYWVKSPNYKELMKEVDQRLLNDDEASHEAIKEAHIAKQSKRARPSSPYTVSYMMQVKYLLIRNMWRLRNNIGFTLFMILGNCSMALILGSMFFKIMKKGDTSTFYFRGSAMFFAILFNAFSSLLEIFSLYEARPITEKHRTYSLYHPSADAFASVLSEIPSKLIIAVCFNIIFYFLVDFRRNGGVFFFYLLINIVAVFMSHLFRCVGSLTKTLSEAMVPASMLLLALSMYTGFAIPKKKILRWSKWIWYINPLAYLFESLLINEFHGIKFPCAEYVPRGPAYANISSTESVCTVVGAVPGQDYVLGDDFIRGTYQYYHKHKWRGFGIGMAYVVFFFFVYLFLCEYNEGAKQKGEILVFPRSIVKRMKKRGVLTEKNANDPENVGERSDLSSDRKMLQESSEEESDTYGEIGLSKSEAIFHWRNLCYEVQIKAETRRILNNVDGWVKPGTLTALMGASGAGKTTLLDCLAERVTMGVITGDILVNGIPRDKSFPRSIGYCQQQDLHLKTATVRESLRFSAYLRQPAEVSIEEKNRYVEEVIKILEMEKYADAVVGVAGEGLNVEQRKRLTIGVELTAKPKLLVFLDEPTSGLDSQTAWSICQLMKKLANHGQAILCTIHQPSAILMQEFDRLLFMQRGGKTVYFGDLGEGCKTMIDYFESHGAHKCPADANPAEWMLEVVGAAPGSHANQDYYEVWRNSEEYRAVQSELDWMERELPKKGSITAAEDKHEFSQSIIYQTKLVSIRLFQQYWRSPDYLWSKFILTIFNQLFIGFTFFKAGTSLQGLQNQMLAVFMFTVIFNPILQQYLPSFVQQRDLYEARERPSRTFSWISFIFAQIFVEVPWNILAGTIAYFIYYYPIGFYSNASAAGQLHERGALFWLFSCAFYVYVGSMGLLVISFNQVAESAANLASLLFTMSLSFCGVMTTPSAMPRFWIFMYRVSPLTYFIQALLAVGVANVDVKCADYELLEFTPPSGMTCGQYMEPYLQLAKTGYLTDENATDTCSFCQISTTNDYLANVNSFYSERWRNYGIFICYIAFNYIAGVFFYWLARVPKKNGKLSKK

SEQ ID NO: 22321 - protein, 201 aa, Porphyromonas gingivalis W83
MEIKKAAFVISNTDVRKCPDTRLPEYAFIGRSNVGKSSLINMLTGQKGLAMTSQKPGKTQLINHFIIDDSWYLVDLPGYGYARLGASNRESLRRIIETYILCREQLSSLFVLIDCRHEPQKIDLEFLQWLGENGIPFSIVFTKADKLSFSRLKENTEAYKQKLLETWEELPPVFITSSEKKTGKEELLDYIDSINQELATK

SEQ ID NO: 22322 - protein, 735 aa, Saccharomyces cerevisiae
MSRRNPPGSRNGGGPTNASPFIKRDRMRRNFLRMRMGQNGSNSSSPGVPNGDNSRGSLVKKDDPEYAEEREKMLLQIGVEADAGRSNVKVKDEDPNEYNEFPLRAIPKEDLENMRTHLLKFQSKKKINPVTDFHLPVRLHRKDTRNLQFQLTRAEIVQRQKEISEYKKKAEQERSTPNSGGMNKSGTVSLNNTVKDGSQTPTVDSVTKDNTANGVNSSIPTVTGSSVPPASPTTVSAIESNGLSNGSTSAANGLDGNASTANLANGRPLVTKLEDAGPAEDPTKVGMVKYDGKEVTNEPEFEEGTMDPLADVAPDGGGRAKRGNLRRKTRQLKVLDENAKKLRFEEFYPWVMEDFDGYNTWVGSYEAGNSDSYVLLSVEDDGSFTMIPADKVYKFTARNKYATLTIDEAEKRMDKKSGEVPRWLMKHLDNIGTTTTRYDRTRRKLKAVADQQAMDEDDRDDNSEVELDYDEEFADDEEAPIIDGNEQENKESEQRIKKEMLQANAMGLRDEEAPSENEEDELFGEKKIDEDGERIKKALQKTELAALYSSDENEINPYLSESDIENKENESPVKKEEDSDTLSKSKRSSPKKQQKKATNAHVHKEPTLRVKSIKNCVIILKGDKKILKSFPEGEWNPQTTKAVDSSNNASNTVPSPIKQEEGLNSTVAEREETPAPTITEKDIIEAIGDGKVNIKEFGKFIRRKYPGAENKKLMFAIVKKLCRKVGNDHMELKKE

SEQ ID NO: 22323 - protein, 390 aa, Robiginitalea biformata HTCC2501
MIEEARRLSAVKEYYFSSKLREVRGLMAEGRPVINMGIGSPDLAPSQAVLESLTASVREAGAHQYQSYQGLPELRQTISEFYNRKFGVSLDPDSEILPLMGSKEGIMHISMAFLNPGDKVLIPDPGYPTYAAVTRLVGAEPIHYRLSGESGWFPDLEALSQSDLSGVKIMWASYPHMPTGAKASREQLSELVAFAHRHQILLVNDNPYSFVLAREPISILDIPEASGHVLELNSLSKTFNMAGWRVGMALGDKRLIAAVLKVKSNMDSGMFYGIQKGAIAALKSDPEWFKGLDAIYSRRRAAVHELADLLGCSYDKEAVGMFVWARLPKGSPDAETYIDGLLYNHNIFVAPGTIFGSRGAGYIRFSLCVPEEKIREALGRIQTAVTKKEV

SEQ ID NO: 22324 - protein, 245 aa, Methanococcoides burtonii DSM 6242
MKALFSLLENSEYCVVLTGAGVSTFSGIPDFRGRSGVYNKFDADLIFSIDHFNKDPAYFYAHSKSFIYDLEHRQPSIVHSVLSKLEEKGIIKAIITQNIDMLHQKAGSKNVIEVHGSPQEHVCLACGKKYSYEYIAELLKAEGFPLCNECGGLVKPDIVFYGEMLRQDTIEKAIQESSKADLMLVLGSTLVVQPAASLPLYTIENGGELVIVNDMKTPLDGYAKRLYDDLGDVFISVAEYFDIDP

SEQ ID NO: 22325 - protein, 420 aa, Methanococcoides burtonii DSM 6242
MVSKTLPFTKEQILEIKKQFPTPFHIYDEKAIRTNARKLKDAFSIVEGFQEFFAVKALPNPYILKILKSEGFGADCSSLPELLLAEKTGIVGENIMFSSNDTPAEEFVKAKELGAIINLDDISHIEFLEKEAELPELVCFRFNPGPLKEGNAIIGNPEEAKYGFTKKQLFEGYRMLKEKGVKRFGLHTMVASNELEPSYFVETAKLLFEVIVEISNELDIRFDFVNLGGGIGIPYRLDQEAVPYDVIAEGVRDEYEKSIKANGLDPLKIYLECGRTITGPYGYLVTEVRHLKHIYKDYVGTDACMANLMRPGLYGAYHHITVLGKENKPEDHLYDVTGSLCENNDKFAIDRMLPEVERGDILAIHDSGAHGHAMGFNYNGKLRSAELLLREDSSVVQIRRAETIEDHFVTLDLDGLVDFS

SEQ ID NO: 22326 - protein, 133 aa, Zea mays
  misc_feature (31)..(31): Xaa can be any naturally occurring amino acid
  misc_feature (108)..(108): Xaa can be any naturally occurring amino acid
  unsure (1)..(133): unsure at all Xaa locations
GSSYTIRGYGHGLITNKGFKGSFGGVGFSFXTSAILSVVQSLEICLLQMLLCQDNIVYSCINCYCTSLSLDFSVAPQALIQNCTTFSSFSCIMDGLNKHHSSMARTLXATVSMAVHEKCVVLSPFTLPPIFDA

SEQ ID NO: 22327 - protein, 979 aa, Bacillus cereus ATCC 14579
MNNNMVHITIDGKKYTAEPGSTILGVINENGIEHPQICYVPEVDPIQTCDTCIVEVDGKLMRSCSTIATEGMNIERASVRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKRKFGWDFVNSKERITKPLIRKNGTFVESTWEEALNVVANKLGAIKEEYGKGSIGFISSSKITNEDNYVIQKLARQVFGTNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQEFINENVNFFEDFKESLEEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLHAIDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARPGYVHLTDK

SEQ ID NO: 22328 - protein, 444 aa, Bacillus cereus ATCC 14579
MNQTLGAIDLTLLGIGAIIGTGIFVLTGIVAAKHAGPAIVLSFVLAAIICACVAFCYAEFASTVPVSGSVYSYTYMTLGEIFAFIVGWCVMLEYLLVTSAVAAGWSAYFQSLLLGFNIHIPTIFASAPGMGKGGIIDLPAVLIILVVTFLLSRGAKESARINNIMVIIKLAVIVGFIVVGTQYVRPENWQPFLPFGFHGVVGGAATVFFAFLGFDAVATAAEEVKRPQRNVPIGLLVSLFICTVLYVGVSFVLTGMVPFTELNVADPVAYALRTVGEDRIAGLLSVGAIAGLTTVLLVAMFAFVRVSYSMSRDGLLPKRLSSVHKRLQTPFFNTWVTGILAALLAGLVDLNLLANLVNMGTITAFVFVSIAVIVLRKTHPNMKRPFRAPLVPFLPIVSIVSCIYLALNLSKLTLISFVAWIIVGVFIYFVYAKKHSNVRNRNKV

SEQ ID NO: 22329 - protein, 539 aa, Polaromonas sp. JS666
MQHQKILILDFGSQVTQLIARRVRDAHVFCEVHPCDVTDDWVRDYARDGTLKGVILSGSHASIYEETTDKAPQAVFELGLPVLGICYGMQAMAHQLGGKVEGGHKREFGSADVRARGHTALLKDIADYTTPEGQGMLDVWMSHGDKVTEMPPGFKLMASTESCPIAGMADEDRRFYAVQFHPEVTHTKQGNAILKRFVLDICGTRQDWVMGDYISEAVEKIRQQVGDEEVILGLSGGVDSSVAAALIHRAIGDQLTCVFVDHGLLRLNEGDMVMDMFVGKLHARVVRVDASEQFLGHLAGVSEPEAKRKIIGREFVEVFKAEAARLKAGDGGHKGAKWLAQGTIYPDVIESGGAKSKKAVTIKSHHNVGGLPEQLGLKLLEPLRELFKDEVRELGVALGLPHDMVYRHPFPGPGLGVRILGEVKKEYADLLRRADAIFIEELRNFRDAETGKTWYDLTSQAFTVFLPVKSVGVMGDGRTYDYVVALRAVQTSDFMTADWAELPYALLKKVSSRIINEVRGINRVTYDVSSKPPATIEWE

SEQ ID NO: 22330 - protein, 220 aa, Saccharomyces cerevisiae [sequence omitted]

SEQ ID NO: 22331 - protein, 142 aa, Synechococcus sp. WH 5701
MTATSKSAESLFDQAIGRYQQGAAAADVIDDFLTITAQAPRLSAAWTCLAWLQLLEDQPEPALRSARMAVKLNPQDPQSRVNLCLAMLESGAKGVREHIDLVLRITAVSPELAKELNESIADGLRRRPGWESLEKVKAWLQG

SEQ ID NO: 22332 - protein, 358 aa, Staphylococcus aureus subsp. aureus Mu50
MSQAVKVERRETLKQKPNTSQLGFGKYFTDYMLSYDYDADKGWHDLKIVPYGPIEISPAAQGVHYGQSVFEGLKAYKRDGEVALFRPEENFKRLNNSLARLEMPQVDEAELLEGLKQLVDIERDWIPEGEGQSLYIRPFVFATEGALGVGASHQYKLLIILSPSGAYYGGETLKPTKIYVEDEYVRAVRGGVGFAKVAGNYAASLLAQTNANKLGYDQVLWLDGVEQKYIEEVGSMNIFFVENGKVITPELNGSILPGITRKSIIELAKNLGYEVEERRVSIDELFESYDKGELTEVFGSGTAAVISPVGTLRYEDREIVINNNETGEITQKLYDVYTGIQNGTLEDKNGWRVVVPKY

SEQ ID NO: 22333 - protein, 183 aa, Gibberella zeae PH-1
MAIVTALLAPIHLFSFSALLGSQLYQTFIVTKVTFQRLPRAPFINLQKYLFPIYFQSQTVLLFLSAATLPPYGPYSLIQNKSDWIPFLVSTVVSGLNLVVFGPRTRKLMLYRAEQGIANAKMASPEDSGPVMQILKKRFGTAHAMSIHLNLIGLGAHLWYTWRLASRLDTSFMSNTWIQYQGR

SEQ ID NO: 22334 - protein, 604 aa, Saccharomyces cerevisiae
MAELSEQVQNLSINDNNENGYVPPHLRGKPRSARNNSSNYNNNNGGYNGGRGGGSFFSNNRRGGYGNGGFFGGNNGGSRSNGRSGGRWIDGKHVPAPRNEKAEIAIFGVPEDPNFQSSGINFDNYDDIPVDASGKDVPEPITEFTSPPLDGLLLENIKLARFTKPTPVQKYSVPIVANGRDLMACAQTGSGKTGGFLFPVLSESFKTGPSPQPESQGSFYQRKAYPTAVIMAPTRELATQIFDEAKKFTYRSWVKACVVYGGSPIGNQLREIERGCDLLVATPGRLNDLLERGKISLANVKYLVLDEADRMLDMGFEPQIRHIVEDCDMTPVGERQTLMFSATFPADIQHLARDFLSDYIFLSVGRVGSTSENITQKVLYVENQDKKSALLDLLSASTDGLTLIFVETKRMADQLTDFLIMQNFRATAIHGDRTQSERERALAAFRSGAATLLVATAVAARGLDIPNVTHVINYDLPSDVDDYVHRIGRTGRAGNTGLATAFFNSENSNIVKGLHEILTEANQEVPSFLKDAMMSAPGSRSNSRRGGFGRNNNRDYRKAGGASAGGWGSSRSRDNSFRGGSGWGSDSKSSGWGNSGGSNNSSWW

SEQ ID NO: 22335 - protein, 575 aa, Gibberella zeae PH-1
MAADLANRIGELNPFSSKNKHLNDEDYGEEIDNNTVAGGGHTGRRIVTDLRVSSALREFIANEKILSKKEAGVKSDDASRALLELVSKPHIRVPPELTDRSHPLPEYYISSSHNTYLMAHQLYGSSCATAYETAIKTGARCVEIDAWDNGDNKDEPKVTHGYTLVSNISFRAVCETIRDSADQEELDSRKLGFRPSPILLSLENHCDAYGQMRLVNIMQEVFGHRLLSKAVREIGHNEQAGSGDHVRLEDLGAKIAVIVEYHFPGEPSDSDSHSDDASDGEEEKAARKEYKEKKNDEVCSVIIPELAELGVYAQSVKPVDNSWYEEGTLTNGPHHHLINVSESGLAKHLPEHTSAISRHNAQHLMRVFPKGTRISSTNLKPVPYWGIGAQICALNLQRFGASNQLNEALFSGTDGYVLKPAALRAGGNGKLSTGRSKRLRLHVAGATDVPLGEDSTKPYLTCTLHHPDDLKNEPPKRKTEPYKQHKLEFLHRGPNPPPTDPLWDETLTWEYEDNELVFLRMLIKSDDSWAVNPIYAVAAVRLLYVVPGWSFIRMLDPKGHETQCSILVNFEIMDA

SEQ ID NO: 22336 - protein, 476 aa, Zea mays
MSLGYAEKLSYREDVGTVGMPEIFETPELVQNKIEELAAMVQKSKHLVVFTGAGISTSSGIPDFRGPMGVWTLQRAGKGIPNASLPFHHAVPSLTHMALVELERAGFLKFVISQNVDSLHLRSGFPREKLAELHGNSFKEICPCCKTEYLRDFEIETIGLKDTPRRCSDKNCGARLKDTVLDWDDALPPEEMNLATEHCRSADLVLCLGTSLQITPACNMPLMSIKNGGRVAIVNLQATPKDKKASLVIHGLVDKVIAGVMSKLSLRIPPYIRTDFVQLTLRHSLKKKCVRWTLRVTSIHGLRAPLPFLQSVKVSFPERPDLKSVVLKEQPFSLQRETSMNKPFFMLLTLNFSDGCSCLSSSIGWPVDFQKRKDSFVRDRALVLRELYSAAQRESCIGQQEILERENLPRAETSIHGIVTNIVRYDTEDEKLAPPKNDLMNHSRSNPAKRHVEGTDCHSSLPKKLKYFLKDKKLNC

SEQ ID NO: 22337 - protein, 248 aa, Glycine max
LKRVDGAVEIPYISDENAGEDPEIRVSVKENGELGIKLMEVMLKKAKVVVLEKVRVWVESMAKGGPVKDELEAKKVAVPHKNNNNNNNNSSNGDNNVKRAGVKKNEGKKGFKVISLIEKFNCRARDLFEILMDENRWRGFTQSNARISKEVGGEFSIFDGSVTGKNLELDEGKLIVQGWRFGSWPDGIESMVRIVFEEPEDGVTVVKLTHSDVPEEDRYGNATVVENTERGWRDLIFQRIRTAFGFGI

SEQ ID NO: 22338 - protein, 250 aa, Porphyromonas gingivalis W83
MDYNNITEALQAFRTEKAYRHAPLRSCFFDMDGVLFDSMPAHARSWVEAAGECGIAAEPLDFYRWEGQKGSDTIKILFERGYGRLPTEKEIADMYGRKSQLFALYNSGNVIDDAPALVSDVCDRGLRIMLVTGSSQTDILQRLQRSYGDNFSPANMVTGADVHRGKPHPEPYLKALECVGMSPSEAFVVENAPLGVRAAVDAGIFTIAVNTGCLPDADLWDAGASLVLPSMAVLRSLLGELLTESLSSSA

SEQ ID NO: 22339 - protein, 402 aa, Prochlorococcus marinus str. MIT 9312
MSKLSLSSLDKTNLEGKKVLVRVDFNVPLNEDGQITDDTRIRAAIPTIEYLINHSAKVILAAHFGRPKGQVNEKMRLTPVAARLSELLGQNVALTNSCIGDEAVAQSNSLSNGDVLLLENVRFFGEEEKNDLEFAKKLASHADMYVNDAFGAAHRAHASTQGVTNYLSPSVAGFLLEKELKYLQGAIDSPKRPLAAIVGGSKVSSKIGVLDSLLDKCDKIMIGGGMIFTFYKARGLDVGKSLVEEDKLELAKDLEAKAKAKGVELLLPTDVVLADEFSPDANSKISQIDSISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKTLPGVAALNDA

SEQ ID NO: 22340 - protein, 539 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFISSQMRSVRGFSSSSDLPPHQEIGMPSLSPTMTEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 22341 - protein, 520 aa, Oryza sativa (japonica cultivar-group)
MESTSKCNGAEAAQPLDTKDDVEPFLQAPAVATCIGATGTRPEFGAQQGPGPGINFAPIVTPRLGPGEPVSERGQGRSCPTRPVATPSDEVVSLDDDRQLHRAAGANARESEEEHLYRLGIFRGKDGGVVVNGLDLENPLCSTLVTGFKLLRIVEAEALGAPFIHLLWREALEARLGIGYRRKGQQLLVRGGRRPGLDRGWCSCRRDQVWGKAGLVLRFGRHERNALVLVLLPLLIQCYSLTGLFNVALMSALMPPGKICNMFTLDLVLSDSPGSTWPGTSLWVMISRCVGNGHWLCRLQWGDGRERTDDEEELILRFTFKFHFKGGRCTMILSVLSSPALVSGLMVVRAKNPQNSGIYTVGDFMTKREELHVVKSTTSVDEALEMLVEHRITGFPVIDDEWNLVGVVSDYDLLALDSISGNGLAEVDIFPEVDSTWKTFNEIQKLLSKTNGKVIGDVMTSAPLVVRETTNLEDAARLLLETKYRRLPVVDSSGKLVGIITRGNVVRAALKIKKKFEGEL

SEQ ID NO: 22342 - protein, 318 aa, Burkholderia sp. 383
MAEIVVAGELLAEFVAAERGQGFDAPGLFEGPFPSGAPAIFADQAARLGARVAYAGCVGRDAFGDAIVARLERDGVDVARIRRVARPTGTAFVAYREDGSRSFVYTLSTSAAACVDAPDVDTAMFDGCRYFHVMGSSLTSESAIAAVQRGVIEAARAGAKVSFDPNVRPEMLSFRPMRAALDVMLDACHLFLPSEADLPFFCGPQPAERAIAGLLATHPLLERVVLKRGAQGSVAFDRANRAEAPAFQVDELDPTGAGDCFGGTLVASLVAGMPIEVALRRANAAGAIAVTRRGPMEGNSSAAEIDRFLTERGIACPA

SEQ ID NO: 22343 - protein, 395 aa, Medicago truncatula
MDPTNNQSNTQNSSDYPFSYQNQFPNSHPQNPNQFPNQYPQNPNQFLNQHPQNPNQFPNQNPQNMSNFGFASNFNHPSFVPNNFNPYFRSMMGYSSQTPPFNGYMPMVNENFQSVGEYPEFSSQINRGGMTRDNEVGPTPEDTTPKSKRNQQPSWNTEQNLVLISGWIKYGTCSVVGRNQTSESYWGKIAEYCNEHCSFDSPRDVVACRNRFNYMNKLINKWVGAYDSAKRMQGSGWSEDDVFKKAQELYGCGKNVQFTLMEEWRALRDQPRYGSQVGGNVDSGSSGSKRSYEDSVGSSARPMGRDAAKKKGKKKSKGETLEKVEKEWVQFKELKEQEIEQLKELTLVKQQKNKLLQEKTQAKKMKMYLKLRDEEHLDDRKNELLGKLERELFEN

SEQ ID NO: 22344 - protein, 697 aa, Robiginitalea biformata HTCC2501
MKSFRTELENPVVEKDIVELERKIRQFREGELNEEKFRSLRLARGVYGQRQPGVQMVRIKLPYGKVTARQLHRIADVSDTYSTGILHITTRQDIQIHYVDLDRTPELWAELERDAVTLREACGNTVRNVTASETAGIDPGEPFDVSPYAQALFEYFLRNPVGQEMGRKFKVSFSASDADTGLSYMHDLGFIARVEAGRRGFKVLVGGGLGAQPRHADVLYEFLPQEQIIPLMERVLRVFDRYGERKSRAKARMKFLIRDIGLDRFRELLAEETPGIPVREYPIDAEAYPQPRPASTPPDIPVPADMEAYQAWKRTNTIRQKQDGYVAVGLRVFLGNFTTRQARQLADLVARYAASEIRLSLRQNILIPFVREAWLPYFHNELEKIGLAQPGYNTAADITACPGTDTCNLGIASSTGIATELERVIAAEYPDFIHNPDVVIKISGCMNACGQHNMAHIGFQGMSVRTRDKRVAPALQVLLGGGNRGGGEGIFADKVIKIPSKRGPQALRIILDDYLENGGGQPYDRYYQEQGQHYFYDKLKPLSDVSDLTPEDFIDWGTDKKYEKAIGIGECAGVVIDLISTLLLEAEEKLEDAQKALEAGKWAASIYYAYSAQIHAAKALLTSEDVAVNSHAAILKDFDTHFIDQPRGFGNDSFRQAVLRMNRHAPDAGFAREYLEQARNFLSEASAFRQKELSHAS

SEQ ID NO: 22345 - protein, 496 aa, Polaromonas sp. JS666
MPLPGLFPAIPQPFKADTTMPTTAYPAHYINGQWVTARSSETLPVYDSSTEALMATVPSGTAAEAEAAVLAARAAFDSWSTLPVETRAAYLDKVAAGVKARTEDLALAIAREVGMPLKMARAVQVGGPIWHWGNFAKVARSFEWEKKVGNSLVVREAVGVVGCITPWNFPLSQITLKIAPAMAAGCTVVLKPSEIAPVNAMILAEIIHKAGLPPGVFNLINGMGPVVGEVLATHSEIDMVSFTGSTRAGKRVSELASQTVKRVALELGGKSASVILDDANLEAAVKGTVSACMLNSGQTCSAHTRMLVPVHRYDEVKALAQAAIARFNIGPSLDETSKLGPLVSAAQRDRVLGFIRTGIEEGAEVIAGGAAAPALDKGYFVQPTILGIKATDTLAQEEIFGPVLVVIPYKDEDEAVAIVNSTIYGLGGAVWSGSDEHAMKVARRIRTGQVDINGGPFNGSAPFGGYKQSGNGRENGVYGFEEFLEFKALQFKPSAS

SEQ ID NO: 22346 - protein, 301 aa, Oryza sativa (indica cultivar-group)
MAGPGVGAGAVSHRAGATWAVTNHGIEASLMDELMSASKEFFRQPLQVKREFSNLNDGEQFRAEGYGNDKVRSKDQILDWSDRIYLKVEPEDERNLALWPKHPSSFRDALHEFTVRCRRVKRDVLRAMARIAGLDDDEHFIDQLGGRATVHARFNCYPPCPRPDLVMGIKPHSDGTVITVLLVARGADGLQVLRDGVWYSVPSSSSTHALLINVGESMEVMSNGMFRSPVHRVVTSAENERISLAMFYAVDPERVIEPAAGLVDEKRPTLYKKMKARDFLVGLSKHFSRGTRFVDTLKISP

SEQ ID NO: 22347 - protein, 269 aa, Streptomyces coelicolor A3(2)
MAEAREHTLTGTRGRIAVREWPAVRPRYVALLVHGYGEHTGRYEEVAGVLTGHGAAVYAPDHTGHGRSDGERVVVEDFEDVVTDVHAVADLARAGHPGLPVVMVGHSMGGLIASRYAQRHPGELTALVLSGPVIGDWELPRRLLALEEIPDTPISPASLSRDPAVGAAYAADPLVWHGPMKRPTLRAFVRTLETVAEGGDVGPLPLLWVHGDDDRLVPLPGSRVGVEPLSGGDLTVRIYPGARHEVFNETNRAEVFADVTRFLDGVLAR

SEQ ID NO: 22348 - protein, 355 aa, Zea mays
MAGRKAAMVVEKNKKVVLRRHVTGRFPTEEDMEITVDTIELGVPAGLTAVLIKNLYLSCDPWMRGRMSKHEDGATVPASDFVIGEAMVNFGVGKVVGSTHPEFTAGDLVWGLSGWEEYTLVTQPESLHKIKHTELPLSYYTGVLGMPGLTAYGGFTHVARPKKGDFVYVSAASGAVGQIVGQLAKIAGCYVVGSAGSDEKVSLLKTKFGFDDAFNYKSESDLGAALKRCLPDGIDIYFDNVGGATLDAALLHMRHGGRVAACGMISQYNLEERDGHGLRNLFYIISNAIRVEGFTALDWFHLYARFEEEMARYIKEGKVVVVEDVAEGIESAPAALIGLFSGKNVGKQLVAIARA

SEQ ID NO: 22349 - protein, 328 aa, Prochlorococcus marinus str. MIT 9211
MSNHCCWSEVGIKGIKFPQQSFERLLEDLDWNFLDWFNYWIANDGETLANTSWPKGVKQDWIWGLALPLLSEIKRISKDQSKSSILGISALPGCGKSSLGSWLETSSNLLNLPINVISLDDFYLPGEELAKAMDGNPWNVPRALPGSHEIKLLEDTIINWKETGDLLAPQFDKALRAGLGDRSGWIKSKPQVLILEGWFLGCKPIYKSQIPVDCLEPSLTSREVYYREKIQDELIKYETIWKHLQRTWHIKALDFSSTCKWKIDQETKMFELRGSSLKGDLLNSFVRMIQASIPQYSLNNLDSDVVIKINESREVLWAGRTVDQEPSD

SEQ ID NO: 22350 - protein, 177 aa, Ostreococcus tauri
MMRVCVDETLRLLRAIQYTKEHGEVCPAGWTPGDPTMVGDPEKSKEYFEAHAGKTPASSSSSSASSSDFAAKLTPIASRTDFDALINGPNPVIVDFMASWCGKCRQIAPEVDKLIDQFPDLVFAKFDTAHADLAPLSKELGIEAMPTFKFYKKGREVDEVIGYKPKLLREAVTAFAQ

SEQ ID NO: 22351 - protein, 397 aa, Magnetospirillum magnetotacticum MS-1
MDSRFRLRSAPLKPANTILSSFGTTIFETMSRLAQAHGAVNLGQGFPEGLEPADVVAKASEALVSGPNQYPSMMGTPDLRQAIARHEARFYGVELDPMAEVMVTSGATEALAACLFGLIEPGDEVVLIEPLYDSYLPIIRRAGGIAKLVRVEPPHWELPRQALAEAFSPKTKLMILNTPMNPSGKVWTADELAFLAGLLERFDAYCVCDEVYEHLVYDGRRHVPLMTLPGLRPRCLKVGSAGKIFSLTGWKVGWVIAAPEVLVPVAKAHQYLTFTTPPNLQAAVAWGLGKEDSYYDGLAAMLAERRDRLATGLRGVGFEVMEAGGSYFLTADFRPLGFDGDDAAFCRHITEKAGVTAIPVSAFYQGGDVGHFARFCFAKTESAIDEAITRLRRYFRG

SEQ ID NO: 22352 - protein, 86 aa, Brassica napus
MADIGKGTSVAGCNDRCGCPSPCPGGESCRCRMSAASGGDQEHNMCPCGEHCGCNPCTCSKTQTSAKGGKAFCTCGEGCTCASCAA

SEQ ID NO: 22353 - protein, 413 aa, Oryza sativa (indica cultivar-group)
MGAIGEWRRGPVIGRGATATVSIATDRRTGGVFAVKSVDVARAGALRREQGMLSALASPFVVPCVGSGVSAAVDGSGGACYDLFLEYAPGGSLADEIKRCGGRCEEPLIRSRVGDVLRGLAYVHAAGIAHCDVKGRNVLVGADGRAMLADFGCARWMAAEDCNAGGVTIRGTPMFLAPEAARGEAQGTAADIWALGCTVIEMATGGAPWPRFADPVAALHHVAHSVDVPESPAWFSAEGKDFLARCLIRDPAKRWTAEQLLEHPFVASAASDSTSKAVQIEQRVSPKSILDQCLWESTSTDSDATVALAPADRLRALSAGASVAPDWTWSMDDWIAVCGGRADDHDTTPSPQPDTTTSFFRGDEASSDLVFPGGGETERGAVAVAATVPLMAKSSEITGVERSIESRVASGSG

SEQ ID NO: 22354 - protein, 129 aa, Zea mays
  misc_feature (30)..(30): Xaa can be any naturally occurring amino acid
  misc_feature (62)..(62): Xaa can be any naturally occurring amino acid
  unsure (1)..(129): unsure at all Xaa locations
MENSSHKRTREAADLAAGGCGEEGSPQADXKRLRPQDLLDMLEDDTDTAAVGDLPSVMRSLXEEIASFDEAAETPAPTSGQQPELGFLLEASDDELGLPPTGAASSSSEEAGRAGAPEPALDGFLSVGR

SEQ ID NO: 22355 - protein, 490 aa, Thiomicrospira crunogena XCL-2
MMQLYTTQSTQAIERFAIDQQSIPGLLLMKRAAYFSYQTLRRCYPDSQNVLVVCGTGNNGGDGLALAQYALIDGCNVSIALLGSQDKIKGDAQTCLQECLALGLSPQPFDSTLLENVDTIVDAVFGTGLNQPVTGEYAEIFERLNETHTPILALDIPSGLQADTGNILGTAIRASHTCTFITHKPGLYTYLGPETAGKIHFSPLFLSQNNYAEQSPIAESHSLKYWLNQLPKTPASSHKGTRGTLLLIGGNHHMMGAIQLASLAALTTGAGLVKIITQPDHLTALTQAQPELMTYTEHEFEQQAATANVIGIGPGLDQDDWAIDRFHDALNHSSPKVLDADALNLLAQSPQQQNHWVLTPHPGEAARLLGTSTETIQSNRIEAIKRLQQKYGGVIVLKGNGTLVYDGKQMELCTAGNAGMAVGGMGDVLTGAITSFIAQGMALYPAACLAVSLHAHSGDTLANQKSQAGVIPSDLALVMSQLLSYASKNS

SEQ ID NO: 22356 - protein, 1054 aa, Arabidopsis thaliana
MSSNTSRSYSTRSRQNSRVSSQVLVDAKLHGNFEESERLFDYSASINLNMPSSSCEIPSSAVSTYLQKIQRGMLIQPFGCLVVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVISECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22357 - protein, 430 aa, Prochlorococcus marinus str. MIT 9312
MKETIDFLIDTIEARQVLDSRGNPTVEAEVFLECGASGRAIVPSGASTGAHEAHELRDGGSKYMGKGVLNAVNKIHETISPALCGLSALDQTTVDKLMIEIDGTFNKSNLGANSILAVSLATARASANALDVPLYRYLGDPLSNLLPVPLMNVINGGAHAPNSLDFQEFMLVPHGVQNFSESLRMGTEIFHSLKSLLDKKGLSTAVGDEGGFAPNLSSSEEAGDLLLEAIQKAGFIPGEQVSLALDAASTEFYSDGIYKYEGKSLNSSEMISYLSRLVSNYPIVSIEDGLAEDDWEGWSELNKELGNKVQLVGDDLFVTNTERLRKGIMEKSANSILIKVNQIGTLTETLEAIELAKTSGFTSVISHRSGETEDTTIADLSVATRSGQIKTGSLSRSERIAKYNRLLKIEEELGNQARFAGALGLGPKNI

SEQ ID NO: 22358 - protein, 317 aa, Burkholderia pseudomallei K96243
MTTALDQLKQYTTVVADTGDFQQLAQYKPQDATTNPSLILKAVQKDAYRPILEKTVRDHAGESVGFIIDRLLIAFGTEILKLIPGRVSTEVDARLSFDTQRSIDKGREIIKLYEAAGVGRERVLIKLASTWEGIRAAEVLQREGIRCNMTLLFSLVQAAACAEAGAQLISPFVGRIYDWYKKQKGADWDEAQDGGANDPGVQSVRRIYTYYKHFGYRTEVMGASFRTTSQITELAGCDLLTISPELLQKLHDSTEAVARKLSPDEARDARLERVAIDESSFRFQLNDDAMATEKLAEGIRLFSADAVKLEKMIEALR

SEQ ID NO: 22359 - protein, 283 aa, Prochlorococcus marinus str. MIT 9515
MKDITTWIDEYQKGSRFGLKGKVLLKKNSKFQEILIIESDYYGKALMLDRCWMTSMRDEKYYHECLVHPALSSIKEKSRILIIGGGDGGTARECLKYSQVEKIDLVEIDEEVIKASKKFLQEIGGTAWIDKRLTIHIDDGVKWVEKAKNNFYDCIFIDCSDPSEFSNLLFTDTFYKECKRILTQKGILATQSESPESFKNIHIHILKSLKKVFKLSETMYSFVPIYPSGIWSWTFASKGELNLSTPCCNEVTTIEKGCDIWNLNFQNAAFKMMPNKIVKELNS

SEQ ID NO: 22360 - protein, 257 aa, Salmonella enterica subsp. enterica serovar Typhi str. CT18
MSVPLILTLLAGAATFIGAFLGVLGQKPSNRVLAFSLGFAAGIMLLISLMEMLPAALDTEGMSPVLGYGMFIIGLLGYFGLDRLLPHAHPQDLVQKRQQPLPGSIKRTAILLTLGISLHNFPEGIATFVTASSNLELGFGIALAVALHNIPEGLAVAGPVYAATGSKRTAIFWAGISGMAEILGGVLAWLILGSLVSPIVMAAIMAAVAGIMVALSVDELMPLAKEIDPNNNPSYGVLCGMSIMGLSLVILQTIGIG

SEQ ID NO: 22361 - protein, 292 aa, marine gamma proteobacterium HTCC2143
MITGSMVALVTPMTNTGDIDWPALKNLVDFHLQEGTHAIVAVGTTGESATLNVAEHCMVIKHVVDQVNGRIPIIAGTGANSSHEAIELTSAARSAGVDACLLVTPYYNKPTQEGLYLFHKLIAESVAIPQILYNVPGRTACDMSNDTVDSLASIDNIIGIKDATGDIERGRDLIERCSDRIAIYSGDDPTATDLMLLGGKGDISVTANVAPKLMAQMCDAAIAGHADLARELNAQLAPLHQNLFLESNPIPVKWALKEMGMIDDGIRLPMTYFSDEYHPTLKQAMQLSGISE

SEQ ID NO: 22362 - protein, 212 aa, uncultured marine gamma proteobacterium EBAC31A08
MSGSKINVAKQAIEYIKNNLHPEMILGIGTGSTVNFFIEELKEHRHKFAGAVSSSDASSKLLNENGIEVFSLNDVVDIAYYIDGADEVSPENCLIKGGGGAHTREKIVASASNEFICIVDQSKMVNLLGAFPLPIEVIPESRSLVARKIISIGGIPTYRTGFITDQGNHILDISNMDISNPTEMEALINNIPGVVDNGIFAANKPKTVLVSK

SEQ ID NO: 22363 - protein, 532 aa, Oryza sativa
MMLVSWATRLVEAPKTDLDFWKVLFPVAVAHTIGHVAATVRFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLQSSEFKKMVMFRAMDEEGIQMKNVSAKPVASTEANFACATYLTLPRTREAKRRAIELAMYAMTPRCHLPPPCRAASTTPATSTALSTPPPSRAGPDELRSTWAHRAWTLAGSAAVLSSLSTSATLAAADADANGAAAAFAAPLAAALAAYSLADLATGVYHWLVDNYGDADTPVLGPQIAAFQGHHRHPSTITRREPCNNLHALARAVALALPPAGAALAAAGAPASAHAFAAVFAACVVLSQQFHAWAHGNPRRLPPGVGAMQRAGVLVSRAQHGAHHRAPYDNNYCIVSGMWNATLDRHRVFEAMEMVVFLRTGVRPRSWDEPDAAWTEDYDDTAAVAGGDTSLDTQ

SEQ ID NO: 22364 - protein, 288 aa, Oryza sativa (japonica cultivar-group)
MSHAAIVLVSVLLLCSAHPSAGARRLMELYKPPPSEQLTYHNGTVLRGDIPVSVVWYGRFTPAQKAVVSDFLLLLTVASPAPTPSVSQWWNTINQLYLSKGGGAGQERRRRRQDHHAGPSPKKGGIALVLTAQDVSVEGFCMSRCGTHASNAKARTAYVWVGNSATQCPGQCAWPFHQPVYGPQTPALVPPSGDVGMDGMVMNIASMVAGVVTNPFGDGFYQGPKEAPLEAATACPGVYGSGAYPGYAGNLAVDPATGASYNANGAHGRKYLLPALFDPATSTCSTLV

SEQ ID NO: 22365 - protein, 312 aa, Robiginitalea biformata HTCC2501
MSEEMRRDESIYLMGEEVAEYNGAYKASKGMLDEFGPKRVIDTPISELGFAGIGVGSAMNGNRPIIEFMTFNFALVGIDQIINNAAKMRQMSAGQFNIPIVFRGPTASAGQLAATHSQAFESWYANCPGLKVVVPSNPKDAKGLLKASIRDDDPVIFMESEQMYGDKGEVPEGEYTIPIGVAEIKREGTDVTIVSFGKIIKEAYAAAEKLDSEGISCEIIDLRTVRPMDHETILESVKKTNRLVILEEAWPFGNVATEITYQVQQKAFDYLDAPIIKLNTADTPAPYSPVLLQEWLPNSEDVIAAVKKVLYK

SEQ ID NO: 22366 - protein, 323 aa, Brassica napus
  misc_feature (249)..(249): Xaa can be any naturally occurring amino acid
  misc_feature (264)..(264): Xaa can be any naturally occurring amino acid
  misc_feature (274)..(274): Xaa can be any naturally occurring amino acid
  unsure (1)..(323): unsure at all Xaa locations
MASSLTAQISCGTQPSAPSFSGLRRTCPKLDAAVSFSHHSFCNRVNSSIRLLSSSNRSPRGVVAMAGSGKFFVGGNWKCNGTKDSIAKLVSDLNSASLEADVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEXVHVAVRDWLKKNVSXEEVASKTRIXYTRGSVNGGNCAELAKEEDIDGFLVGGASLKGPEFATIVNSATSKKVTA

SEQ ID NO: 22367 - protein, 320 aa, Streptomyces coelicolor A3(2)
MAESVPRFDLITMGRIGVDLYPLQTGVPLAEVETFGKFLGGSASNVAVAAARLGRATAVITRTGDDPFGGYLHDALKEFGVDDRWVTPVAAYPTPVTFCEIFPPDDFPLYFYRRPKAPDLEIHPEELDLDAIRAASIFWMTGTGLSEEPSRTATLSALAHRAKSGTTVFDLDWRPMFWADPDQARPYYAEALAHATVAVGNLDECEIATGVREPRACAEALLAAGVELAVVKQGPKGVLAAHRDGRSAEVPPVPVEVVNGLGAGDAFGGSLCHGLLSGWELERIMRYANAAGALVASRLACSSAMPTEAEVDDLLARATP

SEQ ID NO: 22368 - protein, 1054 aa, Arabidopsis thaliana
MSSNTSRSYSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTSYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22369 - protein, 411 aa, Asparagus officinalis
MNALAATSRNFKQAAKLLGLDPKLEKSLLIPFREIKVECTIPKDDGTLASFVGFRVQHDNARGPMKGGIRYHSEVDPDEVNALAQLMTWKTAVANIPYGGAKGGIGCSPGDLSLSELERLTRVFTQKIHDLIGVHTDVPAPDMGTNAQTMAWILDEYSKFHGYSPAIVTGKPVDLGGSLGRDAATGRGVLFATEALLAEYGKGISGQRFVIQGFGNVGSWAAQLITKAGGKVVAVSDVTGAIKHSNGLDIENLLKYSVKNRGIKGFSGGDAIDSNSLLTEDCDVLIPAALGGVINRENANDVRAKFIIEAANHPTDPEADEILSKKGVCILPDILANSGGVTVSYFEWVQNIQGFMWDEEKVNSELKTYMTKGFKHVKEMCKTHNCDLRMGAFTLGVNRVARATLLRGWEA

SEQ ID NO: 22370 - protein, 1054 aa, Arabidopsis thaliana
MSSNTSRSYSTRSRQNSRVSSQVLVDAKLHGNFEESERLFDYSASVNLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22371 - protein, 437 aa, Cicer arietinum
NSARVMTLKLGQVTTVVISSADMAKEVLLTHDLITSNRTVPDALSVLNHDQYSLSFMRVSPRWRDLRKICNYQLFSNKTLDSSQALRRRKLQDLLNDIERCSKVGEAVDVGKAAFKTTVNLLSNTFFSVDFVHSAKEAGEYKEIIVSILKEVGVPNVSDFFPMLKFLDLQGIRKRSIVSVKKVLSIFKRFVGERVKMREGTGSIGNDDVLDALLNMSSDGGKIEMDKDEIEHLLLNIFVAGTDTTTYTLEWAMAELIHNPEMMSKLKEELEKTVGKGIPVEETDIAKLPYMQAVIKETFRLHPPVPLLLPRRAEIDVKIGDYVIPKDAQILINAWVVGRDPTKWENPNVFIPERFLDSEIDIKGHHFELIPFGSGRRTCPGLPLAIRMLPLMLGSLVNCFDWKLEDGLNVEDFNKEDEFGITLEKSQPVRIVPTKLY

SEQ ID NO: 22372 - protein, 208 aa, Oryza sativa (japonica cultivar-group)
MPYAAVRPSPPPQLSRPIGSGAGGGKACPAVPCEVARYHEHAVGAGQCFSTVVQAIAAPADAVWSVVRRFDRPQAYKKFIKSCRLVDGDGGEVGSVREVRVVSGLPATSSRERLEVLDDDRRVLSFRIVGGEHRLANYRSVTTVHEAAAPAMAVVVESYVVDVPPGNTWEETRVFVDTIVRCNLQSLARTVERLAPEAPRANGSIDHA

SEQ ID NO: 22373 - protein, 416 aa, uncultured marine gamma proteobacterium EBAC31A08
MPGGVNSPVRAFKNINGNPIFFERASGAYLYDADHNEYIDYIGSWGPMIMGHSHPDIVGAIKNQVALGTSYGAPTSLESDVARLIKKCIPSIEKIRMVNSGTEATMTTIRLARGFTGRNKIIKFDGCYHGHVDSLLIKAGSGVATFGLPDSPGVPADLAKYTFSCEYNNKEQFLEIFNEIKDDLAAVIVEPVAGNMGFVPGHEDFLKLLRETTSANNSILIFDEVMSGFRVSLGGAQEIYNITPDLTALGKVIGGGLPVGAFGGKEEIMNYLAPSGPVYQAGTLSGNPLAMAGGTALLQLLIKENPFKELERNASVLLDGMKTLMIESGIPFSINRIGGMFGFFFSEELPNNINDVAKTDDVLFSNFLNSCIRSGIYFAPSKYEAGFISAMHKDQEINRTLETVKQIIQKGITHEI

SEQ ID NO: 22374 - protein, 1841 aa, Burkholderia pseudomallei K96243
MQTVVLGWFGFSAVWFIPLFWRLVKAALPGGGGLAGPGSIRLWLGFVGVLTASCTLATALTGDATTNALGHALARGFEHVFGHVGTPFAMIALFVVGLPWLVGVRWRQVNAWLDASFGIRFARERGDEEPRGVADLPRAALHRDDDRRVRRAADVQPTTAHTVNSMAPRQNGRYARPTLWKPNDAQRGERRSASAGGAARAAAEPTAPAGWLKPGAQPRGAQPAAAMATGAAGTAAAGASTAGFAKVAGAAAAASEPAKTAGGAMSAHHAPKTINPPLSVGGAPKAAGPAMTGSGAAKTPPPASAMPAPTIAAAKPAAATMPPSGLSKAERLAAPTGGAAAPLAAPAAAVTSPAAFAPAATGIAKPIGSTAAVAALGKRAQARPAAPDPRFAPRRPATQAAVSAARNRPMTFTPSRQTTGATPPQPAPRAQTAAPTAETARKRAPANPARAPLYAWHEKPAERIAPAASVHETLRSIEASAAQWTALAGATSTAATPVTARESMAAPAAPSGGAAASAAPDGHAPTSAETAAPNDHAPTSAETVAPDGHVPTSAETAAPDSHAPTSAETAAPDGHAPTSAETATPNDHASTSAETAAPDSHAPTSAETAAPDGHASTITEAAAPNGHVSATVETSAVAAPVGITQAAPPIAADTCPAGEHVIAAVEPAGTSDSAAIGAGAIAHAEAGAAASTAETASPIGVDTHIAPSREADRTAQTAPTAPSPAEATPHVDAPHALDVAARALVGNTAATAHGAAAVDGSAQRADTASPAASTSGPPAPVAASAASSDRAAPQPVATAAPASIATSGALGTMKAIGAAGPQPSTIAAQRASAIDDTGQPPSTGHSTHAAVSNELGRRPHAAPDAVTPALPPAAAARAAAVPTSASAVQRQALASESAEAAQGVARAAAAGDSRETTQVSPAGARPDKAAPSAAGANPIAPLPGASAITAHEDAPTSAAPDAATPVIAAMDSAMPNAVAPASAIASNAGMSPASASAAAPRMASAPASAAVPNTHPPLTRAAAAVPGVASIGVAAPGVIVTNAATALPAAPGRIASPAGASAVAPGAMTPNAASTDVAPAAAPASDVSPNVVPAPAVGANASVPPAGASSAARHVNAPMVASTGAAAPAPSIPSSLPPSTVTSNAERRATTTAPTAAPAGLAPNPVAASSFVAPTTSAAPGQFAPAATAPADNAPAAAEAPPGRVPNPPAGAGFVTPTSPTPGPLPPAAETPAATATPTAPPPGLAPNPPAGAGFAATPEAVAHPFGNPSAPAPGAIPESPATAPSVALTANGTEAPGAPQAFAPSPVPAMPAAPAAADPASAAPAAEPVRPSRPPAPNAFEFHAPAASNVELPTLDLLEPASDTIEAISDEHLAQTGQIIEQRLQEFKVPVTVVGASAGPVITRFEIEPALGVRGSQIVGLMKDLSRGLGLTSIRVVETIPGKTCMGLELPNAKRQMIRLSEILASRQYQHSASQLTIAMGKDITGNPVVTDLAKAPHMLVAGTTGSGKSVAINAMILSLLYKATPEDVRLIMIDPKMLELSVYEGIPHLLAPVVTDMKLAANALNWCVGEMEKRYRLMSALGVRNLASFNQKIRDAAAKEKKLGNPFSLTPEDPEPLSTLPLIVVVIDELADLMMVAGKKIEELIARLAQKARAAGIHLILATQRPSVDVITGLIKANIPTRVAFQVSSKIDSRTILDQMGAESLLGQGDMLFLPPGTGYPQRVHGAFVADEEVHRIVEYLKQFGEPQYEEGILDGPSAEGGTQDLFGEAPDAEADPLYDEAVAFVVRTRRASISSVQRQLRIGYNRAARLVEQMEAAGLVSPMGINGSREVLAPPLPE

SEQ ID NO: 22375 - protein, 482 aa, Burkholderia pseudomallei K96243
MSDSVAKPVDATFDQFGLAAEILKAIAEQGYTTPTPIQAKAIPVVLSGRDVMGAAQTGTGKTASFSLPIIQRLLPQANTSASPARHPVRALILTPTRELADQVAANVHAYAKHTPLRSAVVFGGVDMNPQMAELRRGVEILIATPGRLLDHVQQKTANLGQVQILVLDEADRMLDMGFLPDLQRILNLLPKERQTLLFSATFSPEIKKLASTYLRNPQTIEVARSNAAASTVTQIVYDVAEGDKQAAVVKLIRDRSLKQVIVFCNSKIGASRLARQIERDGIIAAAIHGDRSQSERMQALDAFKRGEIEALVATDVAARGLDIAELPAVINFDLPFNAEDYVHRIGRTGRAGASGDALSLCSPNERKQLADIEKLIKRTLSLETLALDLPRHRHDDRGGRRERDRDERRGAPAGRRSAGGERTHHPRREAPIDDFFLKPYVPSPSANQPDEAKPVQPEKKAPKQPLAALLGGFGMPRKTSSS

SEQ ID NO: 22376 - protein, 248 aa, Pseudomonas fluorescens Pf-5
MCLIVFAWRPGHAQPLIVAANRDEFYARPSLPLGQWPELPQIHAGRDLEAGGTWLGVGAEGRFAALTNIRNPHQPPARRSRGELVARFLAGDVPLDDYLRDVVGRSVEYAGFNLLLGNAEQLWHYNARDPQPQRLEPGVYGLSNAGLDTPWPKLLKARAALQEVLHDPQPQALLALLSDPQTAPFADLPDTGVGLATESLLSSVFIASPSYGTRASTALIVHADGSRHLLERSFGPYGGHLGEVELKV

SEQ ID NO: 22377 - protein, 355 aa, Arabidopsis thaliana
MAIRSLPSSSRCSSSSSSSSYSLASTSLSNRLETIFKKASELCTLCDIEACVIYYGPDGELKTWPPEREKVEDIALRYSQLNEALRRKKSVTLYDFLNKKKDKTNLEKKAKITDNDDLKTCLKNVNILKYPLADHYSPDQVSQLIQSLEPHVSKVRERIRFVESQKHKETKPDHQSLASSSLNHQTQSLNPSQFSLFMYNHGDNTLSQIPVSASNFNQDYFSALLEQSELKSQIMKQDLCGYEQNMCMSNHGDATLSQIPLSASNLNQDFSALLQDESGLMQQELCGYDQNMFMNNNNFQHSFVSNTQDHSAPVVQESVNNNYGLMPHVPCGYDQNLFTSDITNNNLLINNSMFL

SEQ ID NO: 22378 - protein, 580 aa, Ostreococcus tauri
MASILGSWFGVGDDVESDSESGGSGAGSESDGATTPRARRDAEEAEQRALLPPATTLHSYEDVRRAVNGNRSEEDYPSGLTNGGNTCFAAAALQCLRRATPLTAWFDDVDTFHDAKRCAETRRFCVVCEYARHLERARESRDAHSIGRLTKDISKVAKQFRRGRQEDSHEFITALLDAMHVMFLKDLGGEKKFDLRTQETTVIYHVFGGYTLGTVKCLECGYVSKSFQSTLDIPLEVTGKITSIEEALRENFCSEELLQGSNKYKCSKCKALVRAKKGTKIHVSPNILTIPLKRYSTGRFSKITKYVTYPATFSLVEFMSDDAPYEESAPEYELFGVLVHQDFYASAHAGHYVAYVKLRDDSWVLCNDNRISPSSEKEAMKQKAYILFYERSRARGAPPIRPPGYLEELKLARDAERGAPATRQDDELAAREQMLDQSTSSTAERLVSKLDSMTLSESAQGAVSSPRATLTPSASIRRVVRPDVPTSGQPTYIMETVRTEKGRELRVSVTLPGCVTAREFEVELTTRTKSSPSCLVIKAPTLYTDPLEISLPDNVDDPTKSSFIKNSSKLNVRFPIHEGN

SEQ ID NO: 22379 - protein, 331 aa, Porphyra yezoensis
MSKIFMFDALRAATDEEMAKDPTVCVIGEDVGHYGGSYKVTKDLHSKYGDLRVLDTPIAENSFTGMAIGAAITGLRPIVEGMNMSFLLLAFNQISNNAGMLRYTSGGNFTLPLVIRGPGGVGRQLGAEHSQRLEAYFQAIPGLKIVACSTPYNAKGLLKSAIRDNNPVVFFEHVLLYNLQEEIPQEEYFLPLNKVEFVRKGKDITILTYSRMRHHVIQALPALLKEGYDPEVIDLISLKPLDIDSISISVKKTHKVLIVEECMKTAGIGAELIAQINEYLFDELDAPVVRLSSQDIPTPYNGSLEQATVIQPSQIVDSVKSIITSVKAIIT

SEQ ID NO: 22380 - protein, 346 aa, Porphyra yezoensis
MSYPKKVQLPLTNYNSTGLNLNKSNLLVLYEDMLLGRNFEDMCAQMYYKGKMFGFVHLYNGQEAVSTGVIKLLNPTDYVCSTYRDHVHALSKGVPSKNVMAELFGKETGCSKGRGGSMHIFSAPHNFLGGFAFIAEGIPVATGAAFQSIYRQQVLKETEDLRVTACFFGDGTTNNGQFFECLNMAVLWKLPIIFVVENNQWAIGMAHHRSSSIPEIHKKAEAFGLPGIEVDGMDVLAVRQAAKQAVQRARQGDGPTLIEALTYRFRGHSLADPDELRSRQEKEAWVARDPIKKLKKYILDNEIANIGELNEIQNAVKTELEQAVKFAISSPEPNMSELKRYLFADN

SEQ ID NO: 22381 - protein, 102 aa, Castanea sativa
MAALVGGVSDVKGHENSLQIDDLARFAVDDHNKKANTLLQFKKVVNAKQQVVSGTIYILTLEVEDGGKKKVYEAKIWEKPWLNFKEVQEFKLIGDAPTHHSA

SEQ ID NO: 22382 - protein, 128 aa, Gibberella zeae PH-1
MAMQKRGIGRPAGHQSTGGKTILGGKRHRKILRDNIHGINTFADRIILAKPAIRRLARRGGVKRISAGIYEEIRTALKARLETILRNCVIYVEYRNAKTVTVQDVIHSLSRMGRPLWGFDLETYNPNK

SEQ ID NO: 22383 - protein, 1054 aa, Arabidopsis thaliana
MSSNTSRSYSTRSRQNSRVSSQVLVDAKLHGNFEESERLFDYSASINLNMPSSSCEIPSSAVSTYLQKIQRGMLIQTFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22384 - protein, 170 aa, Oryza sativa (japonica cultivar-group)
MRKHHNTRIRFFHVMITLKSSDGEPVEVTEASARISKVIGDKIDAGRGGEAIPLPHVDKKTLKKVIEYCDEHANENSDTDEQKEELKNWDKAFIDELDEDDGSFLFLVLLASSYLKIDGLLDLTYQRVADNSKAKTTEEIRKTFSTIEIELSDKEEEEQQQEEEIRPENV

SEQ ID NO: 22385 - protein, 1054 aa, Arabidopsis thaliana
MSSNTSRSYSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22386 - protein, 181 aa, Oryza sativa (indica cultivar-group)
MAAMLLRLHPCPLLFPPPPPHPHLRRQLAVYSIPKSSFRSAAAAARARNPPHLASVGGAERRRVGDDYDEEEEDLGQALERTRQLVECAMFASVAGLAYFLSNSLAIENYFSCFFPLPIVISSLRWGLEAGRKTAVATVLLLFTLSGPVKASTYLASQSGNFDSVIKTALGQRVEDIYTLK

SEQ ID NO: 22387 - protein, 424 aa, Thiomicrospira crunogena XCL-2
MFEIAKQRLSDVFKHIDVEEEVITRLSVPKRSIKASIPVRMDDGSLRIFTGYRVQYDDTRGPTKGGIRYHPRVNEDEVTSLSFWMTVKCAVAGLPFGGAKGGITVNPKELSQLEIERLSRGYIRAFADVIGETRDIPAPDMYTNATIMGWMADEYSIISRQQVPGIITGKPVHLNGSEGRTQATGQGALFCLNEYARRQGWDIKNTTVAVQGFGNAGYHFARLAQQEGYRVIAVSDSSGGILTPSGLNIDDVKQYKDQTSELQAVYCDGSVCKVIEHEKLTNEELLELEIDVLVLAAMENQVTQENVDNIQAHTILEIANGPVSPQADEVLYAKNIQIIPDVLANAGGVTVSYFEWVQNRAGFYWEADEIRVKLSKIMKRESNTIYDLAIRYETSLRTAAYIHGIERLAGAINQRGNRKFFKKN

SEQ ID NO: 22388 - protein, 414 aa, Schizosaccharomyces pombe
MGQTLSEPVTEKHSVNGSNEFVLYGLSSMQGWRISMEDAHSAILSMECSAVKDPVDFFAVYDGHGGDKVAKWCGSNLPQILEKNPDFQKGDFVNALKSSFLNADKAILDDDQFHTDPSGCTATVVLRVGNKLYCANAGDSRTVLGSKGIAKPLSADHKPSNEAEKARICAAGGFVDFGRVNGNLALSRAIGDFEFTNSNLEPEKQIVTALPDVVVHEITDDDEFVVLACDGIWDCKTSQQVIEFVRRGIVAGTSLEKIAENLMDNCIASDTETTGLGCDNMTVCIVALLQENDKSAWYKKIADRVAANDGPCAPPEYAENHGPGWRSGDNNKKVIVPPNFHQVKLNGSDGYDKDANENSKEDDSTNGSLAAGFRWKEHFFPHKAEEENSSSETDIVNSNKDVADDHKEAVSAAD

SEQ ID NO: 22389 - protein, 414 aa, Legionella pneumophila str. Lens
MSVKNAIYAQSGGVTAVINASACGVIQTAKLFPEQIGKVYAAKNGIIGALNEELIDTSLESEEDIAKLMQTPSGAFGSCRYKLKDNGEEYQRLIAVFKAHNIGYFFYNGGGDSQDTAHKVSQLGKTMGYPITCIGIPKTVDNDLPFTDNCPGFGSVAKYIAISTKEAGFDVASMAASSTKVFILEVMGRHAGWIAAASGLAEQNPGEPPHIILLPEVPFEPTRFLKKVKDCVNSYGYCVIVVSEGIRNKEGKFLSEAGLRDAFGHAQLGGVAPVIAQLIKSELGFKYHWAVADYLQRAARHIASQVDLDQAYALGKAAVEYAVKGYNAIMPIVIREQDEPYQWSIGQVPLAEVANQEKSMPPEYIAEDGMGITDACKRYLSPLIQGEAYPNYKNGLPDYVRLKNQLVAKKINQD

SEQ ID NO: 22390 - protein, 143 aa, Saccharomyces cerevisiae
MSQTREDSVYLAKLAEQAERYEEMVENMKAVASSGQELSVEERNLLSVAYKNVIGARRASWRIVSSIEQKEESKEKSEHQVELIRSYRSKIETELTKISDDILSVLDSHLIPSATTGESKVFYYKMKGDYHRYLAEFSSGDAR

SEQ ID NO: 22391 - protein, 322 aa, Mycobacterium sp. MCS
MDLWALLHWISSDSEEMTVGFEGQQNGSAHQTGTARVKRGMAEMLKGGVIMDVVTPEQARIAEGAGAVAVMALERVPADIRAQGGVSRMSDPDMIEGIIDAVTIPVMAKARIGHFVEAQILQSLGVDYVDESEVLTPADYTHHIDKWKFTVPFVCGATNLGEALRRITEGAAMIRSKGEAGTGDVSNATTHMRKIGGEIRRLTSLSEDELYVAAKELQAPYDLVAEVARAGKLPVTLFTAGGIATPADAAMMMQLGAEGVFVGSGIFKSGNPAERAAAIVKATTFYDDPDVLAKVSRGLGEAMVGINVEDIAQPHRLAERGW

SEQ ID NO: 22392 - protein, 301 aa, Triticum aestivum
MAAPSSLASSHLSRLAAAAPAPQHHHQNHQLRLGCSRRRAQRLVAMAGSGKFFVGGNWKCNGTKESISKLVSDLNAATLESDVDVVVAPPFIYIDQVKSSLTDRIEVSAQNTWIGKGGAFTGEISAEQLVDIGCQWVILGHSERRHVIGEDDQFIGKKAAYALSQNLKVMACIGELLEEREAGKTFDVCFKQMKAFADNITDWKNVVIAYEPVWAIGTGKVASPEQAQEVHAAVRDWLKTNVSADVASTVRIIYGGSVNAANCAELAKKEDIDGFLVGGASLKGPDFATICNSVTSKKVTA

SEQ ID NO: 22393 - protein, 547 aa, Methanococcoides burtonii DSM 6242
MSMPFTKATIGEFFEEQARKDPNRDFIVYPDRNLRFSYSEFNDRVDDLANGLISIGITKGDHVGIWARNVPDWLTFLFATARIGAVLVTVNTAYKSHELAYVMKQSDMKAIAIVDRFRDVDYVETIYELVPELKTCKRGNLNSKGYPKLESVIFIGQEKHRGMYNTAEMLLLGKHSESEELDSLKGTLDCKDVINMQYTSGTTGFPKGVMLTHENILNNGYYIGERQKFTEDDRLCLPVPLFHCFGIVLGVLATLTHGGTLVMIELFDPLLVLAAVQKEKCTALYGVPTMFIAEFSHPMFKMFDMSSLRTGIMAGSPCPIEAMKKVIDEMNCKDITIAYGLTEASPVFTQTSTNDPIERRVSTVGTSLEHIDVKIVDSETGEIVGPNEQGEICCRGYNVMKGYYKMPEMTNRAIDKDGWLHSGDLATVDEDGYYRITGRIKDMIIRGGENIYPREIEEFLYTIEGIKDAQVIGIPDEKYGEIVGAFVVLKEGSKLTPEDIRDFSITKIARYKVPKHIFIVDEYPLTASGKVQKFKLREMAVELMEEN

SEQ ID NO: 22394 - protein, 553 aa, Glycine max
MCGLDKSTCLTVMFDLSSSDRSNTPGAINPQLYLQFLTSYQDPSGQSVLRVTTVTRRWVDSSVSSEELVQGFDQETAAVVMARFAKLVARSKSRFSPFSFITILKLLVSFSMGDTYVLATPKRNRSDDVDGGEAKKLLLQQGEADPAAALASARHEFGEHGGVNMSIEASATFTVMEPETMRRMFAGELGPDRDFFIYSRHFNPTVLSLSRLMAALEGTEAAYCTASGMSAISAVLLQLCSHGEHVVASRTLYGGTHALLSHFLPRTCGISTSFVEVTDLDMVDAAIVEGKTKVLYFESVSNPTLTVANIPELCHMAHRKGVTVVVDNTFAPMVLSPARLGADVVVHSISKFISGGADIIAGAVCGPARLVNAMMDLQQGSLMLLGPTMNAKVAFELSERIPHLGLRMKEHSNRALEFATRLKRLGMRVIYPGLEEHPQHQLLKSMHNKDYGYGGLMCVDMETEERANRFMSHLQNYGQFGFMAVSLGYYETLMSCSGSSTSSELSTEEKELAGISPGLVRMSIGYIGTLEQKWSQLQKALTRLNDSGYNKIA

SEQ ID NO: 22395 - protein, 285 aa, Prochlorococcus marinus str. MIT 9515
MITSNTSFLALIGNPVSHSLSPIMQNAAIKYLGLDLIYIAIPCKNEDLEIVVNSLKKMNCKGLNITIPFKKKVFDLCSEISPVAKKIQAINTLKLKNDNNWSGTNTDIEGFIYPLKNLNLTNKNSIILGSGGAARSVIQGLIDLKLSKITIISRNNNSLNELITLFKNDIKIEGILNTNDEIGNLIEETDLIVNTTPIGMSQTSDNDAIPFGQSSWETIDSNTIVYDLIYNPSPTPFLKFCDRKGCMTIDGTQMLIAQGAKSLSFWTNGLEVPFEVMHDALKKYL

SEQ ID NO: 22396 - protein, 323 aa, Porphyra yezoensis
MAMSPSLFYPVEQELCSLEKNLKAVAGTRHPILYAAAKHLFDAGGKRVRPALVFLVAKATSEKQDINTGQKRLAEITEIIHTASLVHDDIIDECTTRRGVKTVHNLFNTKIAVLAGDFLFAQSSWYLANIENLAVVKAISKVITDFAEGEIRQGLVHFDPSISIDAYIEKSFYKTASLIAASCRGAAMLNGSNHQINNDLYLYGKHMGLAFQIMDDVLDITGSTKSLGKPAGADLINGNLTSPLLFSLTQEASLNDLIDREFCNSTDIASTLFLIKRSGGITKAKDLAKEQVQAALSCLQFLPQSTPVSSLKELTHFIITRLS

SEQ ID NO: 22397 - protein, 846 aa, Psychrobacter arcticus 273-4
MVKIREGLPLVDGQTTQADSATLAAQLVANQRSHQSANSYAQIPLDIKYQLATRKLHTTFDRSVNYAYYSHDSNLENDYLRDKILDESEAFSQQELEALDLDHINIDVPTWLDNVAKRIGQDSVPNLSAACAFIRKHMNTSASERSGAYVTGIGMTDILTYLYQDEDALVAAMLYRSARQSIISLNDIEKKFGADISTLVKDTLAMGQLSEIIESNKRLEDHFVNNQRDQLSNIYSMLISVTNDVRVVLIKLSERTFAMRELTFSNEDRQTRVAREVMTIYAPLAHRLGIAQLKWELEDLAFRYLAPDRYKEIAKLLSEKRSERESYIQRVQDRLNESLAESGIEGEVSGRVKHIYSIYRKMKLKGLSFDQLYDIRALRVLVTTPSDCYHVLGLVHGLWRYIPEQFDDYITNPKSNGYRSLHTAVIAENKSLEVQIRTQEMHFEAELGMCAHVNYKEGLKNKKDNYLNQRISSLRQLLSINNQPRSSLSTGDELEETEFDDEEQLVDFDELERIYIFSRDGDITELPKGATVLDFAYYVHTQVGNRAQAARVNQRYVPLTYQLKTGEQVEIITKSSREPNRDWLVASLGYIHTNRARSKLRQWFNKQDRDKNIEIGRQMLSKELERLSVHPNSIDLNDYTQHFNVNNTDDIVVGLVTGEIGLNQLTSHISRQLHLEPERSEEDFAPTIDKRESGKLDAYKIQIDGLDNIEVGLAGCCHPVHGEPIAGYITLSRGVSVHNRGCPEYLRLIERDPEREIKAAWKIKSGRYQPVDIHIEAYDRRGLLRDLTQIIDKENVNIRQVQTLSNDDNIAFLKFHIEVSGLAHLSKLLAKLEQQHGILHARRAVA

SEQ ID NO: 22398 - protein, 223 aa, Pseudomonas fluorescens Pf-5
MTQDQLKQAVAQAAVDLILPKLDDKSIVGVGTGSTANCFIDALALHKGTFDGAVASSEATAARLKGHGIPVYELNTVSDLEFYIDGADESDEHLNLIKGGGAALTREKIVAAVAKTFICIADASKLVPVLGNFPLPVEVIPMARSHVARELVKLGGDPVYREGVITDNGNIILDVHNMQITNPVELESQINAIVGVVTNGLFAARPADVLLLGTAEGVKTLKA

SEQ ID NO: 22399 - protein, 469 aa, Chlorobium tepidum TLS
MQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 22400 - protein, 124 aa, Cytophaga hutchinsonii ATCC 33406
MSNLLKIVEQDYLAVQKALPEFKAGDTINVHVKIKEGAKERIQQYQGLVIQKRNSGNGASFTVRKISAGIAVERIFPTMSPFIDKIEVLRAGAVRRARLFYLRDKTGKNARIKEKKKPVVEAAK

SEQ ID NO: 22401 - protein, 233 aa, Oryza sativa (japonica cultivar-group)
MDHNLLAQHSLQTQKVLVQLASQLGLERRKPERRRRPRRRRRGRGEEPVAAAVVEMEGEDAVVPEAVAADAEKAEEKESGSRMITLKSNEGKAFVVTEVSARQSTTIGHMIDDDCTREAVPLPNVDSKTLEKVIEYFDEHANNKADTDDEKAALDKFDKDFIGELDGDKAFLFHVTMAANYLHAQGLLDLTTQCIADTIKGKTPEEIRTAFNIAYDLTEEDQEEIKEEDAWAF

SEQ ID NO: 22402 - protein, 622 aa, Dehalococcoides sp. BAV1
MCPCIQAIFRRKILENYQRTDIRNIAIIAHVDHGKTSLVDVMLKQSRIFRENQHVGELIMDRNTLEREKGITILAKNTAITYRGVKINIIDTPGHADFSGEVERVLNMADGCLLVIDSIDGPMPQTRFVLKEAMQKKLKPIVVINKIDRENSRPEVVLGLVQDLFLELATTEEQLDFPVVYTSAREGYAVNTPGTKNTDLVPLFECILSKIPPPSIAQGEFQMLISNLDYDTHKGRIAIGRIQRGKICSRDRIVNIDSQNKAHSFEVGQVFTFMGLGKQEVECAEAGEIVAITGLENASIGDTVTSPLQPEALPRIEIGEPTVRMTFGVNTSPFGGRDGKFCTSRQLRERLYRELETNIGLRVEETDSPDSFLISGRGELHLSILVETMRREGYEFEISKPEAITKTIDGKIHEPVEALTIDVREDFVGEVTELLGKRQARMTDMHNDGEGNVRLEYNIPTRGLIGFRNSFLTATRGTGVLNSQFLEFQPWCGEIEQSRTGALVAAEAGLSCTYGLSNSQERGIIMIDANIPVYEGMIVGLHARGLDLAVNVCKQKKMTNIRSSTSDIAIKLVPPLKLSLEQSMDFIADDELVEITPKGIRLRKKILNTDLRLRARKRTDNN

SEQ ID NO: 22403 - protein, 1054 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIEKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVELEFRIIHPAPGLP

SEQ ID NO: 22404 - protein, 524 aa, Bradyrhizobium japonicum USDA 110
MPVAEETRRSIKGGHKSKQGIEATMNVAVRSHATAKQVSEHFDVLIVGAGISGIGSAYHVTKHLPGTSYVILETQATFGGTWSTHRYPGIRSDSDLHTFGYSFKPWVGPPIATAEEILAYMNEVIEDNDIARRIRYKHKINSASWSSDQNLWTIEAVTTDTGEARTFTANFLWMCQGYYRHSEGYTPEWKGMDRFKGRIVHPQTWPDDIDLTGKRVVVIGSGATAATLVPNIADDCAHVTMLQRSPTYFRLGRNAIEIAEELRRLQVDEAWIHEIVRRKILFEQDAFTKLCVSKPEQVKKELIGQISAVLGPDYDVETHFTPSYRPWRQRIAFVPDADLFKGIASGKASVVTDEIECFVENGIQLKSGKLLEADIIVTATGFNLAALGDIAFEIDGKPLAFGDTVTYRGMMFTGVPNMVWVFGYFRASWTLRVDLVADFVCRLLGHMKAKGKKKVEVSLRPEDHNMPILPWIDPENFNPGYMMRNMNLLPKRGDKPEWQHSQDYWTEKDEIPKTDLDDKAFVYG

SEQ ID NO: 22405 - protein, 418 aa, Thiomicrospira crunogena XCL-2
MSQSQPFHYQNNILHAEGCPLDTLAQKYGTPLYVYSRQAFEDRWREFDQAFGRQPHLVCYAVKTNSNIAILNLLARLGSGFDIVSQGELERVLRAGGDPSKVVFSGVAKKSSEIERALTVGIRCFNVESHAELDRIQAVAKKLNKIAPISIRVNPDVDAKTHPYISTGLKDNKFGVDINTAPALYADAQALSHIDIIGIDCHIGSQLTEITPFVDALDRVLELKKTLTDQGINIHHLDLGGGLGIQYTDETPPEIADYIQALMKKLDDPSIEVIIEPGRAIAGNAGVLVTEVEYLKPTEHKNFAIIDAAMNDLIRPALYQSHQTIQPVTPRTDGEDVEWDLVGPVCETGDFLGKQRKLNLKAGDYLAVMSSGAYGFTMSSNYNTRTRAAEILVDHKQAYEIRPRETYNDLMGKEKLIP

SEQ ID NO: 22406 - protein, 1054 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVELEFRIIHPAPGLP

SEQ ID NO: 22407 - protein, 155 aa, Triticum aestivum
TACIITLKDQGIHAVNLGDSGFVVVRDGRTVLRSPSQQHDFNFTYQLESGGGSDLPSSAQVFHFPVAPGDVIVAGTDGLFDNLYNNEISGVIVEALRVGLEPQIAAQKIAALARQRATDKNRQSPFASAAQEAGYRYYGGKLDDITVVVSYVKSA

SEQ ID NO: 22408 - protein, 1110 aa, Oryza sativa (indica cultivar-group)
MSTSPGRTRSGRPLSSSSSSSAPAPAPKRRRRPDKPPDHDPAPAPAPDKDLLVSPHTPPMDAEAPKPIHLLNDKDKDKEGDDGSHQDTPTLQSPPRGSDAHPIPTELNVSAAVARPPQPPHAQPTELNAVAAAASALPMELDAAAAAAVPAESTELNAAATAVPAQPTEVNAAAEIVKPIGLNAVAAETAKPDMAMELQEPPTVTAANGRDVSHESFEQNLQHQVLDNALTDPSLLAESTATPASTAGLKPARRFTRSLLKNKPEEEPTASKSQDPAVSMISEDNNEASVDLALAPEKPQRRFTRSLLKLQKAVLKGVIAGCNIRCFCLSCNGSKNIFLHHKLKSLEAFCVNVALSQNNIKIPLPHLMLVRAIPVALCSGKLMGISRIKESTVITATEWLARQHLRLMRVREQDASQNVVKGEIFSLAKCAQACVGLSGVPSEWYCDNCSNLVQKEKALAENKNAKAAGRQAGVDSIEQIMKRAIRIVPNLWIELGWGVPYAKWYPSSMKTVTDYLWTGKIFWQKDFNNSVFDERTVILCDQCEKEYHVGCLQSQWQVDLKELPEGEWFCCNSCSEIRSSLDKIISDGALILAESDIDIIRKKHEMKGLSMDTNTDLRWRLLAGRKASEDGDLLLSAAVPIIHQSFDPIIEVQSGRDLIPEMVNGRRPKDGMPGQDYSGMYCAVLTLGTSVVSAALLRVMGGEVAELPLVATSKDLQGLGYFQALFSCIERMLISLKIKHFMLPAAQEAEGIWMNKFGFTKIPQEQLDFWSVSWVGIIARFGRACLMWLSSFDGKEHIVFVDIHASLSKSFEGRQKKIGQAGRPILIPSRSHANSNNRYKSVRRRRREREMEMDPPRLGMGAYSGPVRPVGDGDGGAAGETMLLWALGQPAAQRHNAFVRHGAHSLTLDACGRRLSLLQSPSSMSTPGVTGAVVWDSGVVLAKFLEHAVDSGLLTLRAARALELGAGCGLAGCVAALLGAHLLRKNVDLNVGDDARGSARVAQLVWADDPHPDLLNPPLDYVLGSDVIYSEEAVDDLLLTLKHLSAPHTTIILAAELRNDAVLECFLEAAMADFQVGCIEQQQWHPDFRSTRVALFILLKKPPSQPDVLL

SEQ ID NO: 22409 - protein, 301 aa, Oryza sativa (japonica cultivar-group)
MECSISRTNLNCISLGDPDTKKSVALLKQACLDSGFFYVVDHGISQELMDDVFAQSKKFFDLPINEKMELLRDEKNRGYTPMLDEILDPENQVNEVLPRWRKVMEQYHSEALRVAKSIARIIALALNLEEDFFDKPEMLGEPIATLRLLHYEGGQKTGKVSNPAEGVFGAGAHSDYGLITLLATDDVVGLQICKDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 22410 - protein, 356 aa, Legionella pneumophila str. Lens
MLIKLMLGLLEFKKKPFIGMRDLFEQLSTGQNPETLFITCSDSRIVPSLITQADPGDLFSIRNIGNIIPPYPSSYSEAGAIEYALKVLEIKDIIICGHSNCGAMKGLLNSHIEEHLPCVASWLNHSQAVLQEVHEERETETNTPDRELEIATKKNILLQMEHLKTYPLVIEKTAHKELTIHGWYYELETGKVFIYEPDLKEFINLEYALDRALESRKNKIVSGLCMNYLQQMIPLKSEKEYCRLMELITNLQEDILPIWEFIREPAKQQLWKELGGFYASPEDEEFIAMVESSTSIKLTELEEFKKKVSFANNNTATSLLLNSSIFKKPTKDIGKLNVEPVISRDARVALSGDRGS

SEQ ID NO: 22411 - protein, 185 aa, Triticum aestivum
MPGISRHSTAMAPPVMASWATSVAPFQGVKSNGGLPVSRRSNGGSLGSVSNGGRIRCMQVWPIEGIKKFETLSYLPPLSTEALLKQVDYLIRSKWVPCLEFSKVGFIFREHNTSPGYYDGRYWTMWKLPMFGCTDATQVINEVEEVKKEYPDAYVRIIGFDNMRQVQCVSFIAFKPPRSEESGKA

SEQ ID NO: 22412 - protein, 143 aa, Arabidopsis thaliana
MIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 22413 - protein, 484 aa, Arabidopsis thaliana
MEKDVMTDETCIVGRNPATIVNVNGLNISHQCMISLKLKCVIIFFGVVDAGDLLFRLITPERFIRIWQRMDRINGLSDDIICHILSLLSFKEATSTSVLSMRWRYLFAFRPNLCLDDQEVGGGDSFIDFVDRVLVVTGNFPIRRISIKCRMSIDTGHVTRWMVDVLEHGVSYLDIDIISEDDIGFVPLEIFTCKTLVELKLARGFYAMVPDYVSLPSLKTLFLSSIWFCNRDCCPLGRLLSACPVLEELTIIGGCWQHIEFCRTVSSSTLKKLTITSSFHYEYWGITIDTPSLAYLEYSDLVPRHFPFVNLESLVEAKLALDLCSDSNPTNLIKGLRNVEVLELSSGYTSQILYDFREAIPVLSKLFRLSIKSNSRHYYIWNLLPILLEKSPKLETLVIKGPLSADRYEREYGLSCPVKVLEITEYGGKYEELEQMEHFLKKLPCLELVKVRASAINDKEKSRITKDLLMVPRSSNCNIKLKFC

SEQ ID NO: 22414 - protein, 323 aa, Vibrio sp. Ex25
MSNQFDFRAAAKQVLDIEVAALQELDTYFDDQFEKACELILSNSGKVVVMGIGKSGHIGNKIAATLASTGTSAFFVHPGEAAHGDLGMISPGDIVLAISNSGESNEILSLFPVLKRLNIKIISMTGKPESNMAKLSDLHLQITVPQEACPLGLAPTSSTTATLVMGDALAVALLQARGFSAEDFALSHPGGALGRKLLLKLSDIMHFGEALPKVSPNALIRDALLEISEKGLGMTAIVDEHDAMLGIFTDGDLRRTLDKRIDIHTTAIGEVMTTNPTTAHPDMLAVEGLNLMQNKNINALILCKDEKIVGALNMHDLLKAGVM

SEQ ID NO: 22415 - protein, 104 aa, Zea mays
  misc_feature (14)..(14): Xaa can be any naturally occurring amino acid
  misc_feature (19)..(19): Xaa can be any naturally occurring amino acid
  misc_feature (37)..(37): Xaa can be any naturally occurring amino acid
  unsure (1)..(104): unsure at all Xaa locations
MSGCGKGGKGLGKXGSKRXHSEGVHDNMQGIAKPVIXSLVRRGGVKRILGLMYEETLGVLNIFLENVIRDAVTYTEHALRKPVTAMDVVYALERQGGTLYGLGG

SEQ ID NO: 22416 - protein, 1297 aa, Oryza sativa (japonica cultivar-group)
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLRYNERERVMLTFESDLHLPVTCVDASEQFLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNPYIVYLGSHPYGPDASAEEHARATQSHHDLLGSVLGSKQLAKDAILYSYTKNINGFAAHLEEEVATQIARHPDVVTVMASTMLKLHTTRSWDFMDMERDGQILPDSIWKHGRFGQDVIIANLDSGVWPESNSFTDEEVVGEVPKRWKGSCSDTAKYGVSCNKKLIGARYFNKDMLLSNPGAVDGNWSRDTEGHGTHTLSTAGGRFVPRASLFGYANGTAKGGAPRARVAAYKVCWSGECAAADVLAGFEAAIHDGADVISVSFGQDAPVATVASFLQEPVTLGSLHAAMNGVSVVCSAGNSGPLEDTVVNAAPWVTTVAASTVDRDFPNVVTLGNNAHMTGMSLETTTLHSTQLYSMIKASDAALASSDPAVASTCPPGTLDPEKVKNKIVVCVRGGDIPRVTKGMTVLNAGGTGMILANGEMDGDDIVADPHVLPATMITYSEAMSLYKYMDSSKNPVANISPSKTEVGVKNSPSVAAFSSRGPSGTLPCVLKPDIAAPGVDILAAFTEYVSPTEVPNDERRSEYAILSGTSMACPHISGVIGLLKAARPEWSPAAMRSAIMTTARTQDNTGAPMRDHDGREATAFAFGAGNIHPNRAVDPGLVYDLSKEDYFVFLCSMGFNSSDLAKLSAGNFTCPEKVPPMEDLNYPSIVVPALRHTSTVARRLKCVGRPATYRATWRAPYGVNMTVEPAALEFGKDGEVKEFKVTFKSEKDKLGKGYVFGRLVWSDGTHHVRSPVVVNALDIGLRRRDSCARYRSKTGADQGLGVLLLFIF

SEQ ID NO: 22417 - protein, 503 aa, Oryza sativa (japonica cultivar-group)
MAATAAETAAAATATAGGCRVVRWRRWTFASLGALLSNLGPVWFLIAPLLAAYAPRRLLLTYFNLVLRRRARRLLAAVDPYVTVDIPDPGAADAHQQYYHTAPGSAAAARATTRTRSMRDGQDVADEFRGATMWWSSVDEEQQGGGARRRSQRLTFHQLHRRLVVDEYLPHVRRRGRELLFHNRRRRLYTNNKSLSYSSVYHKAWSYVNFDHPTTFETLAMEPAKKAAIMDDLDAFRRSGEFYRRAGKPWKRGYLLHGPPGTGKSTMIASMANYLDYDIYDVELTMVSDNNDLRKLLIETTSKSIVVIEDIDCSLDLTGDRATRRPGEIRGGGSMVTLSGLLNFIDGLWSASGGERVVVFTTNHVEKLDPALIRRGRMDMHIEMSYCRAAAFRTLAKNYLDVDAHHLFDAVDDILDKEDITPADVAECLMAAKRSSDSDVTSSLEFLVDELNKRAMENAKAVAEAKARAEAEAEAKAMADDDSEEDDDHYSDDYTDDDDYDDD

SEQ ID NO: 22418 - protein, 336 aa, Staphylococcus aureus subsp. aureus Mu50
MRAAVVTKDHKVSIEDKKLRALKPGEALVQTEYCGVCHTDLHVKNADFGDVTGVTLGHEGIGKVIEVAEDVESLKIGDRVSIAWMFESCGRCEYCTTGRETLCRSVKNAGYTVDGAMAEQVIVTADYAVKVPEKLDPAAASSITCAGVTTYKAVKVSNVKPGQWLGVFGIGGLGNLALQYAKNVMGAKIVAFDINDDKLAFAKELGADAIINSKDVDPVAEVMKLTDNKGLDATVVTSVAKTPFNQAVDVVKAGARVVAVGLPVDKMNLDIPRLVLDGIEVVGSLVGTRQDLREAFEFAAENKVTPKVQLRKLEEINDIFEEMEKGTITGRMVIKF

SEQ ID NO: 22419 - protein, 534 aa, Solanum lycopersicum
MASTSLSLPSLKLQFPSHTSSSSRKNSSSYRVSIRPIQASVSEIPPYISSPSQSPSSSSSPPVKQAKLPAQKVPGDYALPLVGPWKDRLDYFYNQGKNEFFKSRIQKHQSTVFRTNMPPGPFISFNPNVVVLLDGKSFPVLFDVSKVEKKDLFTGTFMPSTDLTGGYRVLSYLDPSEPNHAKLKKLMFYLLSSRRNEVIPEFHNSYSELFETLENELSTKGKAGLNAANDQAAVNFLARSLYGINPQDTELGTDGPKLIGKWVLFQLHPLLILGLPKVLEDLVMHTFRLPPALVKKDYQRLYNFFYENSTSVLDEAEKIGISREEACHNLLFATCFNSFGGIKIFFPNMLKWIGRAGAKLHSQLAQEIRSVISSNSGKVTMAAMEKMPLMKSVVYESLRIEPPVASQYGRAKHDMVIESHDASFEIKEGELLYGYQPFATKDPKIFDRSEEFVADRFKGEEGEKLLKHVLWSNGSETENASINNKQCAGKDFVVLVSRLLLVELFLRYDSFEIEVGASPLGAAITLTSLRRASF

SEQ ID NO: 22420 - protein, 123 aa, Brassica napus
  misc_feature (11)..(11): Xaa can be any naturally occurring amino acid
  misc_feature (16)..(16): Xaa can be any naturally occurring amino acid
  misc_feature (21)..(21): Xaa can be any naturally occurring amino acid
  misc_feature (30)..(30): Xaa can be any naturally occurring amino acid
  misc_feature (33)..(34): Xaa can be any naturally occurring amino acid
  misc_feature (37)..(37): Xaa can be any naturally occurring amino acid
  misc_feature (60)..(60): Xaa can be any naturally occurring amino acid
  misc_feature (64)..(64): Xaa can be any naturally occurring amino acid
  misc_feature (66)..(67): Xaa can be any naturally occurring amino acid
  misc_feature (71)..(71): Xaa can be any naturally occurring amino acid
  misc_feature (73)..(74): Xaa can be any naturally occurring amino acid
  misc_feature (86)..(86): Xaa can be any naturally occurring amino acid
  misc_feature (89)..(89): Xaa can be any naturally occurring amino acid
  misc_feature (92)..(93): Xaa can be any naturally occurring amino acid
  misc_feature (97)..(98): Xaa can be any naturally occurring amino acid
  misc_feature (102)..(103): Xaa can be any naturally occurring amino acid
  misc_feature (110)..(111): Xaa can be any naturally occurring amino acid
  misc_feature (114)..(114): Xaa can be any naturally occurring amino acid
  misc_feature (117)..(117): Xaa can be any naturally occurring amino acid
  misc_feature (120)..(120): Xaa can be any naturally occurring amino acid
  unsure (1)..(123): unsure at all Xaa locations
EKEEEYSMLSXAAVVXTSPAXATMVAPFTXLKXXSAXPVTRKANNDITSIGSNGGRVSCXKVWXPXXKKKXEXXSYLPDLTEVELXKEXDYXXRNKXXPCVXXQLEHGFXXREXGSXPGXYPE

SEQ ID NO: 22421 - protein, 263 aa, Oryza sativa (indica cultivar-group)
MAKYCMEDVPDLLKDESVDNVPALLSRLVKSLPANAGNLIKWVIEVRRQEEGGSGLSKEEEERLILKEMILQQVRDTELFRLVRELQFTKQPCCSCSYSSDDDSFTWIAASVCCQGAALLTGNLSSKDGFCCRETCFKCVQVDGDGPKTVVTGTAVSGVNEQSVDMLLPISTLETSVCNSNSSNEVVKYPSRTDILTVLLLALHPSTWVGIKDERLKAEFQSLISTDILHDDLKREILHLRRQLHYVRSCKEEEYGDPVPQSH

SEQ ID NO: 22422 - protein, 177 aa, Hibiscus rosa-sinensis
ECALWMPTRTGLELQLSYTLRQQNPVGYTVPIHLPVINQVFSSNHAMKISPNFPVARIRPAGKYMAGEVVAVCVPLLHLSNFQINDWPELSTKQYALMVLMLPSDSARQWHVHELELVEEVADQVAVALSHAAILEESMRARDLLMEQNVALDLARREEEKAIHARNDFLAVMNHEM

SEQ ID NO: 22423 - protein, 462 aa, Burkholderia pseudomallei K96243
MQPAPLARPASHGADAAESAHDLVYGPDERPAPMIACVAALQHLLAILVPIVTPGLLICQALGVSSRDTTLIVSMSLVISGIATFVQCRRFGPLGAGLLIVQGTSFNFVGPLIAGGSLMVKQGTPVETVMAAIFGVVIAGSFVEMAVSRILPFVKRLITPLVTGVVVLLIGLTLIKVGLVSMGGGYGAIAKGSFGSAQNLTLSGLVLGAIIVLNRVPIVWVRSTALVIALAIGYLAAAAMGRLDFTGAREAALFQIPTPLHFGLGFSWALFVPMLIIYLVTSLEAIGDVTATSKISRQPVEGPLWMRRIKGGVLVNGANSLLAGVFNTFPSSVFAQNNGVIQLTGIASRHVGIWIAGMLVLLGLFPVVAGVLQAVPEPVLGGAAMVMFGAVAASGINILAGIRLDRRALLIIAVSLALGLGVSQVPEILTNLPHALGNVLESGVATGGICALVMNWFLPEKQ

SEQ ID NO: 22424 - protein, 510 aa, Oryza sativa (indica cultivar-group)
MAAVAGTGVFAEILEGEVYRYYADGEWRVSASGKSVAIVNPTTRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQLFVISMGFGLQGLKDSGIGSQGITNSINMMTKVKSTVINLPSPSYTMG

SEQ ID NO: 22425 - protein, 559 aa, Ustilago maydis 521
MVNEVPLSIIHDSRFEIRTDLRLAALFSVVKAGRIDPSPTLTCHSRETNTSRVFGSLARSLPPPLVLFDPPRFGQAFLQPITCRPVRDYDFFLILTLLLPTRRTTCPSRFRSASAFSPVSIHWNRLRRSFAITQLCLLLPHTFRIQILTHSLGCLAMPPMNFIFKSKSRTPQELVRHLRDTILRLDSVSQLGGSNSSNSLHNHYSNGASCSSSSSSAASTAIGSSAITSSNSSASSSSSEAKRKAVDDISKTLCQIKAILFGDGDADPQPELVAQLAQEVYSHHVLQLLVAHIAKFEFEAKKDVSQIFNVLLRRQIGSRSPTVEYLATRPDVIFLALRGYENPDVALNTGMILREMLRHEALAKILLYSDRFYTFPDYIETTTFGISCDAFSNFKETLTRHKSMVASYLESNYDRFFATYTTLLQSPNYVTKRQSLKLLGEILLDRTNFSVMTRYISSDENLKMMMNLLRDRSKNIQFEAFHVFKVFVANPKKPASIENILRRNSERLVKFLSDFHNDKDDEQFVDEKQYVLQIIDATAKSHPPPPGSASHGAAPIGAK

SEQ ID NO: 22426 - protein, 465 aa, Edwardsiella ictaluri
MEYYKMTLKPLLIKNPYTGETIHELEVDSISAISEIIDTSYNYRSHLSRSQRADILKKCAMYLEKDKDEAASLITSETGLSKKDTCYEIGRTINVLLSGVNEILSSEESIMDCDLYEGFKERKIISIREPLDGIIYAITPFNHPINQVAHKVIPAIATNNRIILKPSEKTPLSAIYFRDLLYKCGLPKEMFSLVIGNPKILYERMISDLRISMVTFTGGVDVGKSIACTAGYRKIVLELGGNDPLIIMPDADLERATDLVVRGSYSNSGQRCTAVKRVLAHKSIVHDLNYLVAEKSKAWVTGDPMQSATMMGTVIDEEAAIRIQNVVNGAIDQGARLLSGNQRNGALLSPTVLTNVDPKMQLVTQETFGPVTPIITFETISEAIAIANSTAYGLSSALCTNRLDWIKEFSSRLNVGTMNVWEVPGFRTELSPFGGIKDSGLGLKEGVRESMKNYTNIKTISLPWD

SEQ ID NO: 22427 - protein, 663 aa, Oryza sativa (japonica cultivar-group)
MDVKRARSPRAPGVDADDDKKRAAEWRGAVRPHMVLVGFLITLPVLVFVFGGRWGSFQTTSAPNVGGRHVVPGGVTTTQISSSSVMWRARDDGVVLMPSPLVHPFADLVLPYHCFFQRRSSWLFTRVVPGFTGVADKLKHLGRPHALVKVGGPRWIISAVHVASNNAENEAPKNVSVPATATKSLPQPQDKLLGGLLSAAFEESSCQSRYKSSLYRKKSPFPLSPYLVQKLRKYEAYHKKCGPGTKRYRKAIEQLKAGRNADNAECKYVVWFPCNGLGNRMLTIASTFLYALISNRVLLMHVAAEQEGLFCEPFPGSSWVLPGDFPHNNPQGLHIGAPESYVNMLKNNVVRNDDPGSVSASSLPPYVYLHVEQFRLKLSDNIFCDEDQLILNKFNWMILKSDSYFAPALFMTPMYEKELEKMFPQKESVFHHLGRYLFHPTNKVWGIVSRYYEAYLARVDEKIGFQIRIFPEKPIKFENMYDQLTRCIREQRLLPELGTAEPANTTAEAGKVKAVLIASLYSGYYEKIRGMYYENPTKTGEIVAVYQPSHEEQQQYTSNEHNQKALAEIYLLSYCDKIAMSAWSTFGYVAYSFAGVKPWILLRPDWDKERSEVACVRSTSVEPCLHSPPILSCRAKKEVDAATVKPYVRHCEDVGFGLKLFDS

SEQ ID NO: 22428 - protein, 379 aa, Brassica napus
MGLRMSESAKPYFAMVCLQFGYAGMNLLTKTVLDRGMSHYVLVAYRNAFATAAIAPFAFLSERKVRSKMTFSIFMHIFVLALLGPVIDQNLYYIGLRLTSPTFSSAVSNIVPAITFILATLFRMEKVEMKKVRCQVKVVGTLVTVAGSILMILYKGPFINFFRSHLTTTATASSPLAGDYLKATIFLLIASLSWASFFILQASTLKKYSAHLSLSTMVCFMGTLQSLALTFVMEHNPSALNIGFDMNLLASAYAGIMSSSIAYYIQGLMMQRKGPVFVTAFNPLVVVIVSIMSFFVLGQGIYLGGVIGLVVLMVGVYAVLWGKHVDDDDKETRCEDNILVTVKCCSGNSDLSMMPTIDEADEDVETGKVQAVEKETSLV

SEQ ID NO: 22429 - protein, 984 aa, Ralstonia solanacearum
MPILPRLFHRTSRTSSADTQRDARTPPNASPLHGEPGRTPRSRGELGRNLRLRSNAQTSGTPGTPARPQIRASASRTAPSTPQHPQGTEGTRTVPNSPLHNDARVFRERADHTGLSAWRTEMLTRFIEHSRKHGLANDFEQVRVYDRLSRAVDHLKSVLRMSGDSVQLKSLPVPELPDVTFEIAHLKNLETVDCDLHALPATLENLFLLETLSLKGAKNFKALPDAVWRLPALQELKLSETGLKSLPPVGGGSALQRLTIEDSPLEQLPAGFADLDQLASLSLSNTKLEKLSSGIGQLPALKSLSLQDNPKLERLPKSLGQVEELTLIGGRIHALPSASGMSSLQKLTVDNSSLAKLPADFGALGNLAHVSLSNTKLRDLPASIGNLFTLKTLSLQDNPKLGSLPASFGQLSGLQELTLNGNRIHELPSMGGASSLQTLTVDDTALAGLPADFGALRNLAHLSLSNTQLRELPANTGNLHALKTLSLQGNQQLATLPSSLGYLSGLEELTLKNSSVSELPPMGPGSALKTLTVENSPLTSIPADIGIQCERLTQLSLSNTQLRALPSSIGKLSNLKGLTLKNNARLELLSESGVRKLESVRKIDLSGCVRLTGLPSSIGKLPKLRTLDLSGCTGLSMASLPRSLVLPRDGLNVIFPEHLKTDVGNARIQQNPRARLLEGHLERQNEAMNHAMFGDDESVGSMTSVPDNEAGVVSMAFHAKHAYKRLERLRQEAGSSMAAPMRNNDAESMRRALAYAFRSMSDLPTFKKLDNAARSLSYEVQEQLADLVAAPVGQKLVKAIAEGAYGAGRDARAIEQMLPELATRIANHPEIQQLREQAKRYPSSLPPEKLAAKLTPLIQPLWDGTRAVAPMPGQLRQALQDLLVTAEGRQLASEIDRAAHSHRAGDEGKALRGLLPVLAAKIGSDPRVVRVREFVSRHTFGSPQQRAESLAQTLTPVVQELWAQTQAEVAKQGQTPAASPSRQR

SEQ ID NO: 22430 - protein, 507 aa, Oryza sativa (japonica cultivar-group)
MKSSKVQLHRAAAAASPSHGAPEDTPETSTRHDDDRLLGGLLSPAFDEHSCRSRYTSSLYRRRSPFRPSTYLVERLRRYEARHKRCGPGSALFQEAVEHLRSGRNAARSECQYVVWTPFNGLGNRMLALASTFLYALLTDRVLLVHAPPEFDGLFCEPFPGSSWTLPADFLITDFDGVFTMWSPTSYKNMRQAGTISNATAEQSLPAYVFLDLIQSFTDAAFCDDDQQVLAKFNWMVIKSDVYFAAMLFLMPAYERELTQLFPEKEAVFHHLARYLFHPSNDVWGIVHRFYEAYLARADELVGLQVRVFPEMPIPFDNMYEQIIRCSEQEGLLPKLGQTVVVTAANGSSVVAPSTKLTSILVTSLFPDYYDRIRGVYHARPTETGEYVAVHQPSHEREQRTEARGHNQRALAEIYLLSFCDRVVTSAVSTFGYIAHGLAGVRPWVLLRPPSPVARAEPACVRSETVEPCLQALPRRMCGAAEGSDIGALVPHIRHCEDVQKGIKLFS

SEQ ID NO: 22431 - protein, 463 aa, Acinetobacter sp. ADP1
MLQQAVKEMFDHHELTSQPMYRPEVQKVIDQHHLKYVLAQFVDIHGAAKTKSVPISGLKAIEKDGVGFAGFAISGMGMQPHGPDFMVKGDLSTLTPVPWQPGYGRVVCEGYVNGKPHPYDSRYVLRQQVERLSAQGWTLNTGLEPEFSLFRRSEDGKLKMVDDSDNLDKPCYDYKGLSRSREFLERLTEALIPVGFDIYQIDHEDANGQFEINYTYADAMKSADMFTFFRMAAGEIANDLGMICSFMPKPDPKRAGNGMHFHLSIGSDECSNLFHDASDPSGMGLSKMAYHFIAGLLEHGPALCAFCAPTVNSYKRLVVGRSLSGATWAPAFIAYGGNNRSAMVRIPYGRIELRLPDAGCNPYLVSAAIIAAGLDGIERELMPPTACNENLYSLGLEEIAARGIQTLPQSLKEAIDALKADPLFAQKMGSEIVNEFIEQKSMEWVEYCRHVSDWEIQRYTEFF

SEQ ID NO: 22432 - protein, 426 aa, Halobacillus halophilus
MVADKPTDAANENNDKLDVLKSTQTVVKKALDKLGYPNEVYELLKEPVRMMTVRIPVRMDNDHIKIFTGYRSQHNDAVGPTKGGVRFHPNVSEKEVKALSIWMSLKAGIVDLPYGGGKGGIVCDPREMSFRELEGVSRGYVRAISQIVGPTKDIPAPDVFTNSQIMAWMMDEYSRIDEFNNPGFITGKPLVLGGSHGRETATAKGVTICIEEAAKKKGISVEGARVVVQGFGNAGSFLAKFMHDRGAKVIGISDAYGGLHDPDGLDIDYLLDRRDSFGTVTNLFKNTISNEELLELDCDILVPAAIENQIREENAHNIKASIVVEAANGPTTLDATRILSERGILLVPDVLASSGGVTVSYFEWVQNNQGYYWTEEEVEEKLHKVIVKGFDNVYKTAETRRVDMRLAAYMVGVRKMAEASRFRGWI

SEQ ID NO: 22433 - protein, 266 aa, Spiroplasma citri
MKKTNNNLGWAVVTGASKGLGYCYCEELLKLGYNVIAIARDTSPITTLQQKYSAQTIKMINYDLSNLENCEKLFNDVAKDNVTILINNAGYGVWGYFSESSLEQEMNMIDLNIKAVHILTKLFVQRFIAQQQGRVLNIGSLAAFTPASVFASYYASKAYVWSLGVAINTELKKTKSPVRVITLCPGPLKTDFWNRSSNQKDAKYHSTVKVMKTSTYARKSLLKGLKVKRKNYIITGSVNKIVKKLTKWSPQSWVLTSVYNYQRKRK

SEQ ID NO: 22434 - protein, 257 aa, Mycobacterium smegmatis str. MC2 155
MAVSRFSLEGRVAVITGGGTGIGRASALVLAEHGADIVLAGRRLEPLKNTATEIEALGRRALAVPTDVTDPEACRSLVDATVDEFGRLDILLNNAGGGETKSLMKWTDDEWRQVLDLNLSSAWYLSRAAVKPMLSQGKGSIVNISSGASLLAMPQAAIYGAAKAGLNNLTGSMAAAWTRKGVRVNCIACGAIRTPGLEADAARQGFDIDMIGQTNGSGRIAEPDEIGYGVLFFASDASSYCSGQTLYMHGGPGPAGV

SEQ ID NO: 22435 - protein, 105 aa, Mycobacterium smegmatis str. MC2 155
MTHISTHVLDTVTGRPAEGVPVTFSDAEGTVLAQGTTDSDGRIPDLYTGPASGIHRLRFDTATYFAAQQVSSLYPEVVVALDITGAKYHVPLLLAPFAYSTYRGS

SEQ ID NO: 22436 - protein, 477 aa, Mycobacterium sp. MCS
MTTVKNFIGGELVDSVSGATMPLVDPSTGEEYGTAPVSNEADIDNAYAAASKAFKDWKRTTPAQRQKALLDFADEVEKAADDLVTAEGRNTGKPNHVTMAEEIPPMVDQIRFFAGAARVLEGKSAGEYMENHTSWIRREPVGVIGQVAPWNYPMMMAIWKICPAIAAGNTVVIKPSDTTPVTTVMLAELAAKHLPPGVLNVVTGDRVTGANLVAHPTPEMVAITGSVAAGRAVAVSAGGHLKRTHLELGGKAPVIVFDDADIAAAAEGIATAGYFNAGQDCTAATRVLAPARIASDLTDALAEQAKAATTTFGRPADDEDAWVPPVNNVNQLDRVLGFFDDVPSHATVAVGGNRQGHKGFYIEPTVVGGLRQDDRMIQQEIFGPVITVQSFSDEDEAVAWANGVEYGLASSVWTKDVSRALRVSAALDFGCVWINTHIPLVAEMPHGGFKSSGHGKDLSMYGLEDYTRIKHVMAYIG

SEQ ID NO: 22437 - protein, 365 aa, Buchnera aphidicola
MKIKKYKIAVLPGDGIGPEIIKEAYKIISVIKKENDINLQTKEYDVGGIAIDKYNIALPEHTLIGCQNSDAILFGSVGGPKWNHLKLEKKPEISSLLSLRKIFNLFINLRPVKLHKKLLHFSPLKTNIIKKGFDILFIRELTGGIYFGVPKGRNELDPNNICAFDTAIYNTYEITRIAQFAFQQAQKRKKKLVSIDKSNVLESSKLWREVVTKISYTFPEVQIEHLYVDNAAMQLIQNPSQFDVILCPNLFGDILTDESASLIGSLGMLPSASLNQKNFGLYEPAGGSAPDLKGKNLANPIAQILSLAMLFKYSLGFLDISEAIEHAVITVLKQGHHTYDISDKINFISTDMMGTKISENLMKIL

SEQ ID NO: 22438 - protein, 446 aa, Mycobacterium sp. MCS
MSTLEQSRHLATAIPGPKSQQLIDRKAAAVSRGVGTTMPVYAARAQGGIVEDVDGNRLIDLGSGIAVTTIGNAAPRVVEAVAAQAGRFTHTCFMVTPYEGYVAVAEALNRLTPGSGEKRSALFNSGSEAVENAVKIARSYTHKSAVVSFDHAYHGRTNLTMALTAKVMPYKHGFGPFAPEIYRAPLSYPFRDAEFGKELATDGELAARRAIDVMDKQVGADNLAAVIIEPIQGEGGFIVPAEGFLPTLLDWCRRNDVVFIADEVQTGFARTGRMFACEHEGIEPDLIVTAKGIADGMPLSAVTGRAEIMDSPHVSGLGGTYGGNPVACAAALATIETIESENLVERAAAIGALMKDRLGRLQAEDDRIGDVRGRGAMIAVELVKPGTTEPDAALAKALAAGAHTAGVIVLTCGTYGNVLRFLPPLAISDELLDEGLDVVAGLLRDL

SEQ ID NO: 22439 - protein, 169 aa, Brassica napus
  misc_feature (152)..(152): Xaa can be any naturally occurring amino acid
  unsure (1)..(169): unsure at all Xaa locations
MNGFSDLTPSESKPSLAHLAPLEAILFDVDGTLCDSDPIHLIAFQELLQQIGFNNGVPIDEKFFIANIAGKHNSEIALVLFPDDVARGLKFCEDKEALFRKLVAEKVKPLDGLLKLTKWIEDRGLKRAAVTNAPKENAELIISKLGLTDFFXQAVILGSECEFPQTTPG

SEQ ID NO: 22440 - protein, 503 aa, Oryza sativa (japonica cultivar-group)
MAAKWAMKKKLVGGDAGYVLEDVPHLTDYLPELPTYPNPLQDNPAYSVVKQYFVNTDDTVTQKIVVHKTSARGTHFRRAGPRQRVYFQSDEVNAAIVTCGGLCPGLNTVIRELVCGLYDMYGVTSVVGIEGGYKGFYSRNTVALTPKSVNDIHKRGGTVLGTSRGGHDTGKIVDSIKDRGINQVYIIGGDGTQKGASVIYEEVRRRGLKCSVVGVPKTIDNDIAVIDKSFGFDTAVEEAQRAINAAHVEAESAENGIGVVKLMGRNSGFIAMYATLASRDVDCCLIPESPFYLEGKGGLLEFIEKRLKDNGHMVIVVAEGAGQDLIAKSMNFVDTQDASGNKLLLDVGLWLSQKIKDHFKKKRNFPITLKYIDPTYMIRAVRSNASDNVYCTLLAHSALHGAMAGYTGFTVAPVNGRHAYIPFYRITEKQNKVVITDRMWARVLCSTNQPCFLSHEDVEHLKHDDDEHHLHNTQLLEGESSPGKHTGFLYIDKIRFTIPIENR

SEQ ID NO: 22441 - protein, 174 aa, Mycobacterium sp. MCS
MTDISKVIASLMREVPDFPEPGIQFKDLTPLLADAEGLMAVTDALAATAEGADLVAGIDARGFLLGAAVALRLGTGVLAVRKGGKLPPPVHSQTYNLEYGSATLEIPADGLDIAGRSVVIIDDVLATGGTVAATHRLLTSGGATVLHAAVVLELTALGGREVVQPLSVSSLYTV

SEQ ID NO: 22442 - protein, 1437 aa, Oryza sativa (japonica cultivar-group)
MERSGGGGADGDEERLPLHHGFETERAAPWAYCGVEAAAAAAGQRWQAGSSPEWLFEIEPPADGDRDMQDDLPDDLTASQYIGYDKFLGGLLQEGFDEVSCRSRYQFARYHKNFTRIPSSYLLERLRRQEALQKKCGPGTKSYKQAVKLLRSSQGVNMTTDCNYLFLTVHAGLGNRMLEIASAFLYALLTNRILLLDRYQEIGDLFCEPFPGTSWLMPSDFPLNYGEFTQSSPESYGNMLQNKVVGDNTDQSLAGSRPPYVFLYLDGNYEFHDKLFFCEDDQQFLQDVPWLIMRTDMYFIPSLFLIPSYQDELSRLFPEKDAVFHHLARYLFHPTNSIWYSVKGYYRSYLAKANKTVGIQIRIFEKEGILQKNGRFPYVLEQILSCAQNEKLLPEISMKDEAEAPTAPKNNQTIAVLTTSLSSWYSDQIQKKYSEHPTVDGTRVEVYQPSHEEYQRSKNKKHNMKALAEIYLLSMTDVLITSGFSTFGYAAQGLSGLTPWIMFRSENHAMPDPPCRRAMSIEPCFHQAPFYDCKAKRNADLGKMVPFVRHCEDVSWGLKVLAAKSQMGVWEAELVGKGSEIGLAITLLPLLAVFLLGENVRLAVNDFAKARGEALPAAADELRRLRHRRRGHLQLCKGVLLNFEDGEGKVWRFRYSCWNSSQSYVLTKGWSRFVREKGLRAGDTIVFSGSAYGPDKLLFIDCKKNNTAAATGDEKPITSGEATRVVRLFGMDITGGGGDCRKRERAVEMGQEAFLMKRQCVKFANSEIANDRSIVPRLQAGPPSRHRQRRFRTSGGRRCTELARWQAGLETGQACTTLHRPLSEGDITAMQVQQRKPKACAESAAAARGADQQQCDGRPLEAGEESLERSVPRKRKPAAAVAAAEKRWSSVAYVVLAAFVMATVFAVLGGRRPAVWIAATKALRRGSDDKSIPLARSAADKLLGGLLPEGFDEKSCRSRYESYLYRRNPGRRPSPHLVARLRMHEELQRRCGPNTESYNRAVQRLRDGGAAEADAHSPDDEQCKYVVSISYRGLGNRILAAASAFLYAVLTGRVLLVDPSNEMDELFCEPFPGTTWLLPRDFPLASSYANFSADTAESYGNMLKNKVLGTDGSTDGDMPAAQMPAFAYLHLDHDYGDGDKMFFCDDDQRLLSNIQWLVMRTDTYIVPSLFLVTTFQDELDALFPERDAVFHHLGRYLFHPANHVWGLVARYYRAYLATARQLVGVQVRVFDHRQAKSPHVVLEQITSCAWKEKLLPEVLDAVEDAAMPTPPTTPHGGSNNSKAVLITSLRPWFYERVKAMYWERATATGEDVSVHQPSHEEYQHFGEKSHDGKAWAEMYLLSLCDVLVTSGWSTFGYVAQGLGGLRPWVMYKPVNITAVPDPPCGRDVSMEPCFHSPPFYDCKTKRGVDTGTILPHVRHCDDVSWGLKLVDPNGSPN

SEQ ID NO: 22443 - protein, 529 aa, Oryza sativa (japonica cultivar-group)
MDLKERIRRSPTPPTQGEELLAASPAGPRGGRKGRAVVLPLSAAALVACAVVLLLLAGGSAARRGQFVGADPTVLPSRGGGVGDLHLSQSKSNDGENVTIASSEVVNDKLLGEVWSHTESYKKAIEQLKAGQGAKVMECNYLVWVAYSGLGNRILTMASAFLYAILTRRVLLVDSDKGTADLFCEPFPETSWLLPPKFPIKQFKNFSNGSPESYGNMLKNKAIRSNPAFLYLHMAHDYSDYDKLFFCEDNQQYLRNIPWLILKSDNYFVPSLFLIPAYQEELTRLFPQRDSVFHHLGRYLFHPSNVVWGMVTRYYDSYLARADERLGIQIRVFDPEPGPFQHVLDQVLACTLKENLLPAINSKQPIVSTRHSRLKSVLITSLNSGYYEKIRSMYWEHPTTNGEMISFHQPSHEEHQNSDKKMHNMKAWAEIYLLSLSDVMVTSAWSTFGYVAQGLSGLRPWLLFKPENRIAPDPPCRQVLSMEPCFHAPPFYDCKAKRGADTGKFVPYVTLYLSYRKAIFDMVNTNAVV

SEQ ID NO: 22444 - protein, 458 aa, Halobacillus halophilus
MQKQQTIIEESLKALMEDESFLPDLQAQTREQAFKSLVALLSTPNHIHKSFLRVTLDDNTIVRIPAFRVQHSDTVGPYKGGVRFHESVNEGEVSNLAKLMTLKNALHELPFGGGKGGVVIKPKEYNIKELNLICKKYVQYFDDILGPDKDIPAPDVGTGEREMDWMMGEFKNIHPGEPYRNSFTGKSVVNGGSLGRREATGKGVYFTFRYMMHNFLNENRKWLSDTDNIFANTALNHHDQKLSMAIQGFGNLGSVAALEAYQCDYLQNKIVAVSDHNVMLYNNDGLDVPALIKFTEESDGDLPTTEEELEEHEIKAEIRERDELLEMDCDVLLLAALEDQIHEDNMERIQASMIIEGANGPITEDADRYLADKGVLIVPDILANAGGVIVSYYEWIQGREAQFMTEDQVFERLFDKMKYTMDTILPQFFGDPFPLRQNCYIHSVMKLSTIMYRQGKLY

SEQ ID NO: 22445 - protein, 443 aa, Halobacillus halophilus
MGLTKEEIYKKLDEENVRFIRLQFTDMLGTIKNVEIPLSQLDKALEGMMMFDGSSIEGFVRIEESDMYLVPDLDTFVVFPWTSEKGKVARFICDIYNPDKTPFEGCPRYNLKRNIKKMEKLGFSAFNIGTEPEFFLFKLDEKGEPTMELNDKGGYFDLAPTDLGENCRRDIVLELEEIGFEIEASHHEVAPGQHEIDFKYSDAVKHCDDIQTFKLVVKTIARQHGLHATFMPKPLFGVNGSGMHANMSLFNEDGNAFYDENGDKELSEVAYQFTAGIIKHATNFTAITNPTVNSYKRLVPGYEAPCYVAWSGQNRSPLVRVPTSRGLSTRIEVRSVDPAANPYMAMSVLLAAGLDGVENKLKAPTPVDRNIYVMNKKEREAHGIKDLPATLFNALEELQEDPIMVEALGEHLFEHFIEAKEIEWDMFRTQVHPWEREQYLQTY

SEQ ID NO: 22446 - protein, 665 aa, Oryza sativa (japonica cultivar-group)
MMLMSTRAPIPYQHNQTNSTRRATGMFVNFPPVAAISRSICPFELAKSQQQRPRAPSLLCNKQPHAPHPWPPSSQQRTTTTTVSSHGLFRLPTALSPPVLTRGSIPPPPSRRPHPPRAVVDRVRAVLLDTGRGRCRVGGAAGAAGGAARGAVLGAQGEVPGRAEPVGEGEAGEGAHIVVHGGRHQGARQDAHGGDRGRQALQGGHRHGRFMMRLKLPNGVTTSEQTRYLASVIEAYGKDGCADVTTRQNWQIRGVTLPDVPAILDGLNAVGLTSLQSGMDNVRNPVGNPLAGIDPDEIVDTRSYTNLLSYITSNFQGNPTITNLPRKWNVCVIGSHDLYEHPHINDLAYMPAVKDGKFGFNLLVGGFISPKRWEEALPLDAWVPGDDIIPVCKAVLEAYCDLGTRGNRQKTRMMWLIDELGMEVFWSEVEKRMPNGVLERAAPEDLIDKKWQRRDYLGVHPQKQEGLSYVGLHVPVGRVQAADMFELARLADEYGSGELRLTVEQNIVIPNVKDEKVEALLAEPLLQKFSPQPSLLLKGLVACTGNQFCGQAIIETKQRALLVTSQVEKLVSVPRAVRMHWTGCPNSCGQVQVADIGFMGCLTKDSAGKIVEAADIFVGGRVGSDSHLAGVYKKSVPCDELAPIVADILVERFGAVRREREENEE

SEQ ID NO: 22447 - protein, 752 aa, Cytophaga hutchinsonii ATCC 33406
MKIKDIVNRDLVNLQNCDQEPIHIPGSIQPHGFLIAITKETWEIRFCSENVIDFIGLSHKQLLGKKITEIFDDIFFGKVIQCKDYAVGESKLIQGKIEDKEFDFTAHQNEDVIILESEIHIDNTPKNDLFDMSKQFMDYMEDSHTLIRLCELVASGIKKVTDYDRVMIYRFDKDYNGEVIAEAKQDKLESFLGLHYPHTDIPVQARELYIKNLLRVIGDVNYKPVPIYTIDDSENQNLDLSCSVLRSVSPIHVQYLHNIGVGATLTISLIHKKKLWGLVACHHYSPKYLHYETKLAAKLQGHFITSQIEIREQNEQYATSQKLHQAVDDLISRKFSADRNSLKDIVIDSNVLQLCKAAGISILIDKKEVYKSGLTPADGDIQKLAEYVKHAIDKEQYATHFITAELPDFKNITASGIAGINYHALDKTSNSCIMWYKPETITEVKWAGDPNKAIEKDKNGLSPRKSFELWGEKVKNQSIPWSQPDLIASSNFANFLQKHLGYIFLAEEEEKQRQMTEILKEVNSELENINWISTHDLQEPLRKIQIITSYVLSVENTLSEASYEKLQKINKSANRMQALISDILRYTKLKASTEILESVDLKNIVTEVIQEVDDALEAKKANIYISDLPEMSGIPFLLAQLFLNLISNSLKFADATRVLSIHIVQEGIIVKEEQEYYKISYTDNGIGFNKDYNELIFKIFSRLHSVAEYPGSGIGLALCKKIMKTHKGFIEAQGIPEKGAIFYLYFPVSKNS

SEQ ID NO: 22448 - protein, 436 aa, Halobacillus halophilus
MTYTKETIKQEVQAHKVEFIVLEFTDMLGETKNVELPIDELDMVLNEEAMFDSSSISGFSDIQESDMYLVPDLDTFLVLPSLVDEDQSARFICDIYKPDGTPFEGDPRYILKRAMQKAEDMGYTVNVGPEPEFFLFKLNEDGYPVRKFNDRAGYFDSSPKDKGDKVRRDIVRTLKKYGFEMEASHHEVAMGQHEINFRFDNMLKTADNIQTFKNVVKDIATNHDYHATFMPKPITGENGSGMHCHLSLFQDGDSAFFDEDAEDGVSKTMKQFIAGILHHASGIAAITNPNVNSYKRLVPGYEAPVSVAWSHSNRSCMMRVPTTRGKGTRFEVRNPDPTANPYLTLAVLIQAGLEGIRNELDAGEAESRNLYEVDDDSVPTLPTNLKEAIEALKKDEVLLEALGEHTAQAYIDDKEEEWTDYSLQVSQWEVDKYMNK

SEQ ID NO: 22449 - protein, 483 aa, Acinetobacter sp. ADP1
MDLQQQPLFRQKALVAGQWCDADNAEKTPIFNPATQELIGYVPNMGRAETERAIEAAYASWEMWKTKTAKERSALLKKWYDLILLNLDVLAEILTTEQGKPFNEAKGEIIYAASFIEWFAEEAKRIYGDIIPSPYPDARIVVNKQPIGVVAAITPWNFPAAMITRKVAPALAAGCPCIVKPAPETPFTALALADLAIQAGIPAEIMSVVTGDAAQIGDAIFASDHVRKFTFTGSTPIGKLLLEKSAKTLKKVSLELGGNAPFIVFDDADIEAAVEGALIAKFRNAGQTCVCVNRFLVQSGVYEKFIQVFKAKIESLKIGNGLEAGSEIGPLINAQAVAKVQSHIEDALSKNGRLITGGQVHATGELFFEPTLIADANTEMMVATQETFGPLAAIFKFDTEQQAIQMANDTEFGLAAYCYTRDLGRAWRMSEQLEYGMVGINKGLISNEVAPFGGIKHSGLGREGSKYGIEDYLEIKYTLFGGL

SEQ ID NO: 22450 - protein, 412 aa, Oryza sativa
  misc_feature (373)..(373): Xaa can be any naturally occurring amino acid
  unsure (1)..(412): unsure at all Xaa locations
MAQQLSAPFRAAAAAGSRASAAAADPAKVLRLRSAGSAQFTSIAASSSFARNIEPLRAIATQAPPAVPQYSSGEKTKVGINGFGRIGRLVLRIATSRDDIEVVAVNDPFIDAKYMAYMFKYDSTHGPFKGSIKVVDDSTLEINGKKVTITSKRDPADIPWGNFGAEYVVESSGVFTTTEKASAHLKGGAKKVVISAPSADAPMFVVGVNEKSYDPKMNVVSNASCTTNCLAPLAKVVHEEFGIVEGLMTTVHATTATQKTVDGPSMKDWRGGRGAAQNIIPSSTGAAKAVGKVLPELNGKLTGMAFRVPTPNVSVVDLTCRIEKSASYDDVKAAIKAASEGALKGILGYTDEDVVSNDFVGDARSSIFDAKAXGIGLSSSFMKLVSWYDNEWGYSNRVLDLIAHMALVNAKH

SEQ ID NO: 22451 - protein, 625 aa, Ashbya gossypii ATCC 10895
MSFQLFARTPAGPQIFEAYPSFQQVESPEVSGFITSKTSPCGRFLAVSSENGVRVFKNERFQELLLELALKDVYDLEFSPGGSYLSTWERPHVDNEQHDNVKIWFLNEDEPSAEQPKFQYQAKTQNAWSLQFSKLDNYALKRFGKELRIAKLDHSSPEFNFNQPYARLVPEGHLSTYLISPAEHPTICTFCDEKEGKPGQLTIYPITEGNIQKKTASKMVFKADSCQLKGNDLGNAVLCLAITDFDASNKSYYGENTLYLLSFQGVNGSLGGDSVRVPLGKEGPIHDFTWSPTSRQFGVIYGYMPATITFFDLKGNAVHSLAEQRKNTMIFSPSGRYILIAGFGNLQGAVEILDRHDKFKCFSKFDAANTSTCKWSPGGEFILTATTSPRLRVDNGLKVWHVTGKLCFVNEYTELLEASWRNACKYRPKRPDSHVILNWDSSKVEAAKDPAIVPSQLEVHPSVSAYSLKNPNKKNGGSSVSKPVGAYKPPHARRAAASNTSSPKSSVPGMTFKPTKSVVPGMAPKETKSAAKNRKKRENTGIRKGPDSDGGSSNGTTPEPKEPPKVNKETSPEEKKIRSLLKKLRAIESLKMRQADGDKLEDTQILKIQTEQAVLQELDYLGWKP

SEQ ID NO: 22452 - protein, 463 aa, Zea mays
MRPRLPPNVPSLPSSLSLLANSLSSPVTNTPTRPDSFPAYLQLAHLMVSQERQEPAVPSSSSSSAKRAATSMDASPAPPLLLRAPTPSPSIDLPAGKDKADAAASKAGAAVFDLRREPKIPAPFLWPQEEARPSSAAELEVPMVDVGVLRNGDRAGLRRAAAQVAAACATHGFFQVCGHGVDAALGRAALDGASDFFRLPLAEKQRARRVPGTVSGYTSAHADRFAAKLPWKETLSFGYHDGAASPVVVDYFVGTLGQDFEPMGWVYQRYCEEMKELSLTIMELLELSLGVELRGYYREFFEDSRSIMRCNYYPPCPEPERTLGTGPHCDPTALTILLQDDVGGLEVLVDGEWRPVRPVPGAMVINIGDTFMALSNGRYKSCLHRAVVNQRRARRSLAFFLCPREDRVVRPPASAAPRRYPDFTWADLMRFTQRHYRADTRTLDAFTRWLSHGPAQAAAPPCT

SEQ ID NO: 22453 - protein, 508 aa, Oryza sativa
MEEGAKIGREHEQQQQQHGRVNGSGRVAAVGGGSGGGGDEIEIEVAAAAGASPSRQHGGLHGDVQAPTWKRFLAHVGPGFVISIAYLDPSNLQTDLVAGSSHRYSLLWVLLFGFIFVLTVQSLAANLGIITGRHLAELCMGEYPKYVKYCLWLLAELGVIAATIPGVLGTALAYNMLLHIPFWAGVLACGACTFLILGLQGYGARKMEFTISVLMLVMATCFFMELGKVNPPAGGVIEGLFIPRPKGDYSTSDAVAMFGSLVVPHNLFLHSSLVLTRKMPYTSKGRKDASTFFLLENALALFIALLVNVAIVSISGTICANNLSFADTSTCSSLTLNSTYVLLKNILGKSSSTVYGVALLVSGQSCMVATSYAGQYIMQIVLSFVLPFALIPLIKFSSSCTNIGPYKNATSIIRIAWILSLVIIGINIYFFCTSFVAWLVHSDLPRVVNAIISSLVFPFMAAYIAALIYLAFRKVNLSDPFPTNSVSGEIEVQHIQIQEKQEDLGVHL

SEQ ID NO: 22454 - protein, 360 aa, Oryza sativa (indica cultivar-group)
MEVENEGNSTHSRTQVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWRRWGGADTHTTSFDHVLVIDTVEFDPFTAITGNVVISKSYLKTFWLHSNKKFPALLTTSGGYNLQEHVQLPDNNPLLIFPEGTCVNNRYTVMFKKAAFELGCIVCPIAIKYHQEFTDTFWDIELFRLMTSWGVVCDVWFLDPLQIMPGETAIELALHLK

SEQ ID NO: 22455 - protein, 130 aa, Glycine max
MGYGRSRASSVLDGFSLNPVPYPVLLILSLILLFLGISWYLSYEEVVEAAEEQLGWMLLATPVVLILVVRWLSSVDTSEWFFFNSSPWERRRRTHHFPSEGSSPWGVAALILLVLVLLHYHSTFLDAWFV

SEQ ID NO: 22456 - protein, 289 aa, Cryptococcus neoformans var. neoformans JEC21
MPIATETYPIPPFDRPVPTTEDLDWADLTELPLDLFYDPKGRAQLVESVKHALEVDDLGFWSVTNAGFSDEEIDHQFAIAQAFFNLPIEERKSNAIDAKNGGYLGYRAPYERTIADTDVLDNMELVNIPKYTDDYKDYPRHDIFKSHETVIADFHRKCWQQIAKPLFVLFALAMELPENYFVERHEYNKPSQDHLRYMQYHPRTPEDDAKCNNLWSWAHTDYGSLTLLFSQTVSGLQVKFSDGTYHDIKYKKGSVIVNIADTLSFMTKGYLRSTIHRVTVPPGIQSSIQ

SEQ ID NO: 22457 - protein, 455 aa, Oryza sativa (japonica cultivar-group)
MGGSGKWVKSLIGLKKPDREDCKEKLQVPSVNGRGGGKGRKWKLWRSSSGDHGSLWRGSRGGGCCGGHHRSASSDASDDASSAAADPFTAAVATVARAPAKDFMAVRQEWAAIRVQTAFRGFLARRALRALKGLVRLQAIVRGRQVRKQAAVTLRCMQALVRVQARIRARRVRMSTEGQAVQKLLEARRTKLDILREAEEGWCDSQGTLEDVRVKLQKRQEGAIKRERAIAYAYSQQIEGATKCNFWTECVIFLVFAQQQPKPTSYGRLNQSGMLLKHQHFDKSNGNWSWLERWMAARPWENRLMEEHNQTNSSSPDLLSSKNCEDSFGILGDFSEPNSVKVRKNNVSKRVCAKPPVVSHHQRIKAQSISSLSTELHNDESSASSSSCFASTPISFSTFVTTEKTEDSIRARPNYMNMTESIKAKRKACNAQRTTAGKLMEDRKASGVELKVAQV

SEQ ID NO: 22458 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENLKGLQEFKPVEEGASA

SEQ ID NO: 22459 - protein, 527 aa, Burkholderia sp. 383
MRDADNGIVTSLCGSDVMSGSDSSSSRPDLAQGIALDDLADGAMIEGHVGDAAVLLVRRADELFAVGAQCPHYGAPLADGLLEGDTIRCPWHHAAFCLRTGELLRAPALDGLPCWRVERRDGRAVVLDARPAAVPPALNAAGLPVSVVIVGGGAAAIAAAVTLRQEGYPHPVTLLTADADPPYDRPNLSKDYLAGTADADWLPLRAPSFYADHHIDVRCGTRVARIDPARQAVELADGSRVGYGALLLATGAEPNRLTVPGADLPHVCVLRSRADCDALIAKLKTARRCVVVGASFIGLEAAAALRTRGLDVQVVAPDAHPMARVLGDALGSTIQALHESHGVVFHLGATPAQITPDSVTLSTGDVLPADLVVVGIGVHPNVALAQDAGLAVERGVTVDRFLQTSAPGIYAAGDIARWPDPLTGERIRVEHWVVAERQGIVAARNMLGQQRPFDAVPFFWSQHYDLTVNYVGHAEQFDRVEIDGDLGAHDCTIAYWRGNTRLAVATIGRDLDSLKAEAAFEQQIAAA

SEQ ID NO: 22460 - protein, 539 aa, Oryza sativa (japonica cultivar-group)
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 22461 - protein, 295 aa, Polaromonas sp. JS666
MCLIAFAINASERWPLVIAANRDEYLNRPSLPLARWTSVSGREIISGRDLRAGGTWLGMTPDGRVAFLTNVREGYPQAAAPRSRGELVMRWLEANCEAGDFIRVLEKDGAAYGGFNLVMGDFQRDAWTWVTNKAALGWHAQPLAAGIYGLSNAALDTPWPKTVELKQTLATALSTTPAAHQPEVLQAPLWTALGNRQRAPLASLPDTGVPLVIEAALSSAFVDFPENAYGTRSSTVLLASAADHGDGVRRWDLQLEERTHVRAKADAQAAANAPRRPASRSLASRYQTAWLQTGV

SEQ ID NO: 22462 - protein, 276 aa, Oryza sativa (indica cultivar-group)
MAAANLLSRALLPALNPNPSSHSNRVSPSAVSLRRRHGLTASVRASLSTAAPSPPPRPAAAAADGRAPKRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITK

SEQ ID NO: 22463 - protein, 320 aa, Polaromonas sp. JS666
MRHSADPHKLLTPAMRDVLRRMAKAGRPPMHTLTPQQARAAYAAGADVLEIPSPRLARVEDFALPARDGHAIAARLYAPSSDHLPVLVYFHGGGFTIGGIDTHDVLCRQLSHLAGCAVISVDYRLAPEHKFPVAGHDAWDALHWVATHGASQGIDNTRIAVGGDSAGGTLAATCAVLARDAGLPLALQLLFYPGCAAHQNTPSHQKFATGFVLEETHISWLFSQYVRSPADREDWRFAPLHTPDVDGVASAWVGLAECDPLVDEGVMYADKLRTAGVPVDLEIYRGVTHEFIKMGRVIPEARRAHADAAQAIQRAFGSAP

SEQ ID NO: 22464 - protein, 283 aa, Glycine max
MEDPSAATTLLLNSEYSRLFVEDTDLYNRIVLGTLLPHFVWGPLPHFLQTWLRNYLGGVLLYLLSGLLWCFYIYYWKRNVYVPKDAIPSRRAMLLQISVAMKAMPWYTLLPTVSEYLVETGWTKCYPRLYNVGWLAYLVYLAIYLSIVEFGIYWMHRELHDIKPLYKYLHATHHIYNKQNTLSPFAGLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 22465 - protein, 545 aa, Ralstonia metallidurans CH34
MLGLMQDRPLLISSLIEHAATYHPTREIVARTVEGPIHRTNYAEIHRRAKRVANALASLGVGVADRVGTLAWNTHRHFELYFGVSGSGAILHTVNPRLFPEQIEYIVNHAEDKVLFFDIGFAPLVEKLAPALKSVQHYVAMTERANMPAIDVPNLLCYEDLLAEHSDTYDWPELDERAASSLCYTSGTTGNPKGVLYSHRSTVLHSLVACAADAFAVGASTSVLLAVPMFHANAWGMPYAAAMVGAKMVMPGPHLNGQSLYELMRDEGVTVSQAVPTVWLMLFQFLDEHPEIDMKALGLKIIGSGGAASPRSMIERCERDFGVEYLQAWGMTETSPIGTTGRLLPKHAALPKDEQTTIKMKAGRAVWGVGLKIIGDDGQELPHDGRAFGHLHVRGPWIASGYFKHTGGEVLDKDGWFPTGDIGTIDPDGYVQLVDRAKDVIKSGGEWISSIDLENAAIGHPAVHEAAIIAVAHPKWQERPLLLAVKRPGKDVTREELLQYLSERVVKWWVPDDVVFVDQLPHTATGKLLKTKLREDYRNYRLPTA

SEQ ID NO: 22466 - protein, 417 aa, Mycobacterium smegmatis str. MC2 155
MTELSQALKQATGVIAARGEGVLLYDEQDRRYLDFTAGIGVTSTGHCHPRVVEAAQRQVGTLIHGQYTTVMHRPLLTLVERLGEVLPAGLDRMFFANSGSEAIEAALRLSRQATGRPNVIVFHGGFHGRTVAAASMTTSGTKFRSGFSPLMAGVHVSPFPDPTHFGWPVEQTTDFALSQLDYVLQTVSAPADTAAFFVEPVLGEGGYVPANERFLAGLRERADAHGILLVLDEVQTGYGRTGKFWGGEHFDAKPDILVTAKGLASGFPLSGIAASSELMAKAWPGSQGGTYGANAVACAAAIATLDVIADENLVANAAERGAQLKQALQTVADKHEQITDVRGLGLMIGNEFRDADGKPDGTTAAAVQQEAARRGLLLLTCGAWGQVVRFIPALVVSADEVEEAAGIWADAVSAVVS

SEQ ID NO: 22467 - protein, 494 aa, Mycobacterium smegmatis str. MC2 155
MPTTISTPRYLLDQARRRFTPTPNTIPGMGAIEKRLKRKQWDQFVFSTPPAGSGLKPIMGDSGLPVLGHMIEIFRGGPDFILEQYRRNGPIHYAYSPALSSVMALGPDATQTVFSNRNKDYSQRAWDPVIGPFFEGGLMLLDFDEHMYHRRIMQDAFTRSRLTGYIPHIDSVASQVLANDWVSDDPRFLFYPAIKELTLDIASEVFMGVPAGTDKKLVTTVNHAFTTTTRAGNAIVRTPVPPLKWWRGIQARKTLEDYFLSRIDEKRRAESTDMFSVLCHSADEDGQTFTDDQIVSHMIFLMMAAHDTSTSTMTTMAYHLAANPEWQDRLRDESERIGDGPLDIEALEKLETYDLVINEALRMMTPLPFNFRQAVRDTELLGYFIPAGTNVVTWPSINHRLPELWTDPEKFDPERFAEPRSEHKKHRYAFAPFGGGAHKCIGMVFGQLEIKTVMHRLLRQYRLELPRPGYTPRYDYGGMPVPIDGMPIVLRPLR

SEQ ID NO: 22468 - protein, 333 aa, Triticum aestivum
FFFVPVSAVAIIVLVATCSIIALKIHRSGRSPFPSLTGKDYNDRRDNIKKILGNYGSLAPRRYQFSHLKKVTKSFGEKLGQGSYGMVYKGTLANGRHVAVKFLHDTTGNGEEFVNEVISIRRTSHVNVVTLLGFCLEGSKRALIYDYMPNGSLDKFIYTENSKQALGWETLYGIATGIARGLEYLHRGCNTRIIHFDIKPQNILLDQDFVPKIADFGLAKLCNPKESYLLSMDGMRGTVGFIAPEVFSRRFGVVSTKSDVYSFGMVLLEMVGGRRNLRASVERESEVYFPDWAHSHLAQFGSLQPFDLGFDGPEEIAKKMATIGLWCIQISPA

SEQ ID NO: 22469 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENFKELQEFKPVEECASA

SEQ ID NO: 22470 - protein, 400 aa, Cryptococcus neoformans var. neoformans JEC21
MCSSHATAVESVSPAPRKSQYEVKYDPDLVLKSAEFKELKQGDKELEDPKANLACAYDEKHNVKMINKPIPKARQDEVVVHIKATGICGSDVHFWKHGQIGPTMIVTDTCGAGHESAGEVVEVGPGVEQWKVGDRVAIECGVPCGQASCGPCVTGRYNACPQVVFFSTPPYHGTLTRYHAHPASWLHRLPDNLSYEEGALCEPFAVALAALERAGNRLGDPVLICGAGPIGLVTLLASHAAGCTPIVITDLQASRLEVAKKLIPTVKTVQIERSWTSKETSEAIKEAAGTGIRVAIDATGFESSITAAIYSVVFGGKVFVIGAGPSEQKYPFGYCSANEIDLQFQYRYAHQYPKALRIVSGGLINLKPLLTHTFPLNKAVEAFHVAADPTKGAIKVQIID

SEQ ID NO: 22471 - protein, 421 aa, Streptococcus thermophilus LMG 18311
MENKMTKTPFITADKLDQITAEFPTPFHLYDEKGIRETARAVNAAFSWNPGFKEFFAVKATPNPAILKILKEEGCGVDCATDTELVMSNKVGFDSTAISFTSNDTRAEEFVYARDINAIINLDAYEDIFFLEESAGLPETLSLRFNPGGVFLLGTDIMDHPEESKFGMTKEQLFKGYAYLKEKGVKSFGLHAFLASNTVTNEYYPTLAAQLFELAVEIKNELGISLDFINLSGGVGVDYTPANKQNDIAAIGEGVHTKFDEILVPNDLGDISIYTELGRFMTAPHGLLVTKVLHIKDTYRRYVGVDASAVNLLRPAMYDAYHHITNMTNPNGDIQVVDVTGSLCENNDKFAKNRELPEARIGDTLVIHDTGAHGFSMGYNYNGRLRSAEILYQEDGTARMIRRAETMNDYFATLDGFDFEI

SEQ ID NO: 22472 - protein, 441 aa, Alkaliphilus metalliredigenes QYMF
MNHKEALLKKAKELEVEFIHLQFTDILGVMKNVSITIEQLEKALDNEIMFDGSSIDGFVRIEESDMYLAPDLSTFIVLPWTDSPREARLICNVYKTDGTPFHGCPRNALKKVVKEALDMGYTINIGPECEFFLFHTDEKGEPSLQTHDNAGYFDLAPVDLGGNARKDMTMTLKQMGFEIEASHHEVAPGQHEIDFKYADALVTADRIMTFKMVVRIIAQRHGLHATFMPKPKFGINGSGMHINMSLETMDGKNAFYDDKDKLKLSKVAYHFLAGVLKQAKGFAAVTNPTVNSYKRLIPGYEAPVLIAWSASNRSPLVRIPAKRGNSTRIELRNPDPSANPYLALAAVLKSGIDGIKNEIDPPKPVDSNVYDMDELEMKEKGIEGLPANLYEAVKMLSTNEVVKEALGQHIFKKLTGAALYEWNEYSKDVSQWEINRYLRKY

SEQ ID NO: 22473 - protein, 426 aa, Glycine max
MMSVTGKSIDFAGKNLVSCGCSSNASSFDRYTVRNYAKLNSNNSKGCGRDHGARKLVCCKKRSTHCRVSSMKTAQPTVNGGTHAFEGLTTGLDLKGYSEDPISPARLFEVVADDLLTLNKNLQSIVGAENPVLMSAAEQIFSAGGKRMRPALVFLVSRATAELLGLKELTAKHRRLAEIIEMIHTASLIHDDVLDESDLRRGKKTVHQMFGTRVAVLAGDFMFAQSSWYLANLENIQVIKLISQVIKDFASGEIKQASSLFDCDVQLDEYLIKSYYKTASLIAASTKGAAIFSGADSSVTEKMYEYGRNLGLSFQVVDDILDFTQSAEQLGKPAGSDLAKGNLTAPVIFALEKEPKLRDIIESEFSEVGSLEEAINLVKSCGGIERAQELAKEKADLAIQSLQCLPQSVFRLALEDMVAYNLQRIA

SEQ ID NO: 22474 - protein, 130 aa, Cryptococcus neoformans var. neoformans JEC21
MVRVSVLNDALNNIVNAERRGKRQVLIRPSSKVVIKVLSVMQKHGYIGEFEIIDDHRGGKVVIQLNGRLNKCGVISPRFNVPVDSIENWVAQLLPARSFGKIILTTSAGIMDHVEARNKHVGGKILAFVY

SEQ ID NO: 22475 - protein, 134 aa, Zea mays subsp. parviglumis
MRKHRIVSLVFALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENLKGLQEFKPVEEGASA

SEQ ID NO: 22476 - protein, 219 aa, Brassica napus
MAVVVSANGNGPAFEAKMTVYVFVCVLIAAVGGLIFGYDIGISGGVTAMDDFLKKFFPTVWERKQHAHENNYCKYDNQHLQLFTSSLYLAALVASFLASAVCSKLGRKPTMQFASVFFLIGVGLAAGADNIVMLIIGRILLGFGVGFGNQAVPLFLSEIAPAQLRGGLNIVFQLMVTIGILIANLVNYFTATVHPNGWRFALGGAAIPAVILLLGSLII

SEQ ID NO: 22477 - protein, 295 aa, Mycobacterium smegmatis str. MC2 155
MPFQLSTADGVEEARRKFSELPRAEIHPELSVHDRTIEGPAGPIGVRVYRPPTAEGVKLPVVLFFHGGGWSVGDLDSYDATARRHAAGAEAVVVSVDYRLAPEHPYPAAVDDVWAATQWVAAHAEELGGDAERLAVAGDSAGGNLAAVVAQLARDAGAPALRMQLLWYPATTWDTSLPSFAENADAPVLAIDAVKGFSAWYAGHVDLTDPPATLVPARHDDLSGLAPAYIAVAGHDPLRDDGVHYGDLLAAAGVPVQLDNADTLVHGYLGYSGVVPAATEAFDRGLAALREALHS

SEQ ID NO: 22478 - protein, 340 aa, Brucella suis 1330
MALGVVLNLDGKMKQEGSVQPLVDLTRADMARVNELILSRAGSDVEMIPEVANHLISSGGKRLRPMMTLASARMFGYEGDGHVRLATSVEFMHTATLLHDDVVDESDLRRGKSTARTIWGNQASVLVGDFLLGQAFKMMVDVGSFDALDVLATSASIIAEGEVMQLAAAKNMETTEDEYLAVIKAKTAALFSAAAEVGPIIAGAQRSDRAALRDYGLNLGLAFQLVDDALDYGGSAADLGKNTGDDFREGKITLPVILSYRRGTDEERAFWKGAIEGGASYDASLQKAIGLMMKHGAIADTVQRARHFGEIARDALAPLKASPQKDALIEVVDFCISRVN

SEQ ID NO: 22479 - protein, 355 aa, Cryphonectria parasitica
MSRSQAPNPAGSRKISFNVSEQYDIKDVVGEGAYCVVCSAIHKPSGQKVAIKKITPFDHSMFCLRTLREMKLLRYFNHENIISILDIQRPRNYESFNEVYLIQELMETDMHRVIRTQDLSDDHCQYFIYQTLRALKAMHSANVLHRDLKPSNLLLNANCDLKVCDFGLARSAASQEDKSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTLFPKTSELALDLLEKLLAFNPVKRITVEEALKHPYLEPYHDPDDEPTAPPIPEEFFDFDKHKENLSKEQLKQLIYQEIMR

SEQ ID NO: 22480 - protein, 134 aa, Zea mays subsp. parviglumis
MRKHRIVSLVSALLILLALAVSSTRNAQEDSMANNTGTLVGGIQDVPGSENDLHLQELARFAVDEHNKKANALLGFEKLVKVKTQVVAGTMYYLTIEVKDGEVKKLYEAKVWEKPWENLKGLQEFKPVEEGASA

SEQ ID NO: 22481 - protein, 623 aa, Burkholderia sp. 383
MRSRPARPSGSHAFESSFGTTCVDVDRTRFWLWAPASRTAAVEIEGEDAPAVAMTAVGDGWFEATVPCGPGTLYRYRLDGGLAVPDPASRFQPGGVEGPSQVVDPAAYRWRHDAWRGRPWHETVLYELHIGACGGHASVERRLPEIAALGVTAVELMPVNAFPGMRNWGYDGVLPFAPDASYGRPEELKALIDAAHGLEMQVFLDVVYNHFGPEGNLLPRYAPAFFRADRQTAWGPAIDFSREQTSTFFIENALYWLDEFRIDGLRIDAAHAIDDDAWLRELARRVRAYVGDTRHVHLVLENERNAASLLGPGGFDAQWNDDFHNSAHVLLTGERDGYYRAYADAPLRHLARTLGEGFAYQGEPSPLHDGAARGEPSAHLPPTAFVAFLQNHDQVGNRAFGERLRTLANEDAVRAATALLLLAPSIPLLFMGEEDGSTQPFQFFTDYRGALADAVREGRRREFAAFPAFADAAHRDAIPDPNDIATFVRSTLHGSSDETTPDTDAWRRFYRSALAVRAALVTPNLPGARALGVDLLTGDGDPQALVARWRLGDGSTLTIALNLGSHDAVLPALPVGKIVFETPPRARDRLRDLRLPPRACIAWRDGKVNHDARQHRINGQGRS

SEQ ID NO: 22482 - protein, 708 aa, Burkholderia sp. 383
MPTALPARLESGRSYPLGATWDGLGTNFAVFSAHAQRIQLCVFDPTGRKELARLDLPECTDEVWHGYLPNAHPGTVYGFRADGPYQPQHGHRFNPTKLLLDPYARKLVGQFRWSDALFGYRVHSSRADLSMDRRDSAPAMPKCVVVDEAFDWRNDRRPRVSWRNTVIYETHVRGASMRRAGLRPPERGTFAAFAHPAFIDHLLSIGVTTVELLPVHAFLQQRALVNRGLRNYWGYDTAAFFAPEPAYLATRRLDEIRIAIRQLHAAGIEVVLDVVYNHTCEGNELGPTLSWRGLDNASYYRLMPDDHRFHVDETGCGNTLNLSHPRVVQMVMDSLRYWATAFNVDGFRFDLGVTLGREEHGFDPGAGFFDALRQDPVLAQRKLITEPWDLGPGGYQLGRHPPGFAEWNDRFRDTVRRFWRGDAGQRPELAARLAGSADLFNHQRRHTWASVNFVTAHDGFTLADLVSYSAKHNDANGEDNRDGRDDNCSANWGVEGPSDDAAIRAVRARVARSMLATLFTALGTPMLVAGDEFGRTQHGNNNAYCQDNELSWLDWDLARSDEAVTLMRFVSRLAALRRMYPVMSTPRYPSGDRDAAPGMAEIDWFDERGDAMTVPAWQDRERRALTMRRVGTGRTGRTEALLVMLNASSETVVFAPPAPVLDYRVLVDTATPDAGPRAWPADGLDVAAHAAAIAVAAVPPDLHSGDSP

SEQ ID NO: 22483 - protein, 361 aa, Oryza sativa (japonica cultivar-group)
MGSSSGSDRLRDLQAFDDTKAGVKGLVDAGVTTIPAIFHHHPLLLDDAEEDADVIPVIDLQADVDRGHLVGQVRAAAQCVGFFQVVNHGIPGELLEEMLAAVRRFNEQPAEGKKAWYSRDSGRRVKFNSNFDLFQSPAANWRDTLLLELTPRPGPAAEEIPPACRGVVGEYVEAVQRLGGALLELLSEALGLPPEYLGGLGGGLATMAAHYYPPCPEPHLTLGTTRHSDPSFLTVLLQESKGLQVLMRQRQRWVDVPPVAGALVVNIGDLLQLVSNDLFRSVEHRVLATTAAAEPRLSVACFFRPDYACTRVYAPVTTTPPPPLYRSTTMPEFLSHYRAKGLDGRSALHHFRIPPPSSPPH

SEQ ID NO: 22484 - protein, 1075 aa, Alkaliphilus metalliredigenes QYMF
MPKHKHIKKVLVIGSGPIIIGQAAEFDYAGTQACKSLREEGVEVVLVNSNPATIMTDENIADHVYIEPLNTRAIELIIKAERPQGILPTLGGQTGLNLAVALYEEGILQKYGVELLGTSVDTVKRAEDRQLFKETMEKLGHTVPKSAIVAKVEEAMAFGEEVGYPLIVRPAYTLGGTGGGIALNQEELRGIVVRGLRLSMINQVLIEQSVANWKEIEYEVMRDRNDNCITICNMENFDPVGIHTGDSIVVAPSQTLRDEEYQMLRSASIDIIRELKVEGGCNIQFALHPESLDYVVIEVNPRVSRSSALASKATGYAIAKVAAKIAIGLTLDEIKNPVTGKTTACFEPALDYVAVKIPRWPFDKFTTGDRKLGTQMKATGEVMAMERTFGAALLKAIRSLDGKVYQMFLDGIADLDESVFKERLSYPNDQRLFAIFEALRNGYSVEDVHKITAIDLWFLRRMKDIILLEIKLKQRGFNLETIKECKKAGFSDAHIGKVLGHPEKILRKYRDDHEIKPVYKLVDTCAGEFESTTPYFYSTYEQECEVNKEKKRKAIILGSGPIRIGQGIEFDYCCVHGAWSLKEQGIETIIINNNPETVSTDFDTSDKLYFEPLTPEDVINIAKMEDVEGVVVQYGGQTAINLTKPLHEAGIKILGTPPSGIDLAEDREKFSKLLVELNIPQSKGVMVSDIKEVEEAAKVLGFPLVVRPSYVIGGQSMEIVRDEEELLYYANHLTDFNKYNAILMDQYILGKEVEVDGISDGKEILIPAIMEHIERAGVHSGDSMSVYPVQSLSEKVVKDIVDYTQKIAMALGVVGLINIQYVVKDEQVMVIEANPRASRTVPIVSKVTRIPMVALATEVMMGKALKDLGYGTGVAAHPPYIVVKAPVFCLEKLGDVDTMLDPEMKSTGEVMGIGLNYQEALLKAFEGAGFHIPSKGRVLFSIADRDKTEAIALARELEEQGFEIIATSSTGKHLVKHGVHIKEVLGSNDEILEAFKSGSVAMVINTPTKGKKIERQGFQIRRQSIDYSISCFTSLDTAYQFLDVIKFAKTYTYQVIKLFEPQAIDKISPKLSNIV

SEQ ID NO: 22485 - protein, 174 aa, Vibrio sp. Ex25
MAGSSVIVMGVCASGKSTIGEHLAKKLGRKFIDGDDLHPRANIQKMASGQPLNDDDRKPWLERIRDAAYSLESKNEHGIIVCSALKKIYRDQIREGNDNVTFLFLDGDMELILNRMRMRKGHFMKENMVKSQFETLERPDNEPQTLIVSIDGDISDVVERSAAELIKMQAIEVA

SEQ ID NO: 22486 - protein, 707 aa, Oryza sativa
MGCVASKNAVSVTPAADSSGALRERSLPRAPEAAATVVSVTASSLRCSSAAAAGRRSEKKRDEAAVAAAGEEPSEKAHKAAATASRSFRLRSLRRSLEGEQVAAGWPPWLSAVAGEAIQGWIPLKADSFEKLEKVGQGTYSSVFRARELDTGKIVALKKVRFDNFEPESVRFMAREIQILRRLDHPNVMKLEGLITSRLSCSLYLVFEYMEHDLAGLSSSPDIKFSEAQVKCYMNQLLSGLEHCHSRRIVHRDIKGANLLVNNEGVLKIADFGLANYFDPNKNHPLTSRVVTLWYRPPELLLGSTHYDAAVDLWSAGCVFAEMFRGKPILQGRTEVEQLHKIFKLCGSPADEYWKKSKLPHATIFKPHCPYQSTLQDVFKEMPANALRLLETLLSVEPYKRGTASAALTSEFFKTKPYACDPSSLPKYAPNKEMDAKLREDSHRRKASRGHGPEASRKSRLSRAARETTTVNKQTDGKEESKTKANGTKDNSILDRTKVNGDARLFSDIQPVSVAQVKERSRHVKNDSREEIPFSGPLIVSSSSGFAWAKKPPEDRSFARSRTKSSSRGQFTAELDQDNKMPAKENQNLGLKEQPNRDMHIARANSKVREPHDAAKRAVLKKWSQLGRPDSFDSYDTYHSQNFSNAMYLGDTLSSKNSIKGDHDQGERVEYSGPLLSQSHKVDELLEKHERHIRQVVRKSWFSRGKK

SEQ ID NO: 22487 - protein, 801 aa, Oryza sativa (japonica cultivar-group)
MSYLLPHLHSGWAVDQAILAEEERLVIIRFGHDWDETCMQGMMDEVLAAVAETIKNFAVIYLVDITEVPDFNTMYELYDPSTVMFFFRNKHIMIDLGTGNNNKINWALKDKQEFIDIVETVYRGARKGRGLWAPLPPPHSIFSSSSSGTTVVDDDTPKGQRRSANAEESAPAAAANHGNSRLPRSSYVPPHLRGQAAPAAPAQAGALPSAAAAAQPSVGQPGVVGGPRWAGIVNGGGGGGGGSVGGSRQGFGAGGRGGGGGGGGGAWNSRPGGWDRRDREPDPFANSEAAEVDFEGENTGINFEAYEDIPVETSGHDVPPPANTFAEIDLGDALNENIRRCKYVKPTPVQRYAIPISIAGRDLMACAQTGSGKTAAFCFPIISGIMRSRPPPRSRGSRTAYPLALILSPTRELSVQIHEEARKFAYQTGVKVVVAYGGAPITQQLRELERGVEILVATPGRLMDLLERARVSLQMIKYLALDEADRMLDMGFEPQIRKIVEQMDMPPRGERQTMLFSATFPKEIQRMASDFLADYIFLAVGRVGSSTDLIVQRVEFVLDADKRSYLMDLLHAQRANGTHGKQALTLVFVETKRGADALENWLYNNGFPATSIHGDRTQQGISKYVMKKEREYALRSFKSGATPILVATDVAARGLDIPHVAHVINFDLPNDIDDYVHRIGRTGRAGKSGLATAFFNESNTPLARPLSELMQEANQEVPQWLERYAARSSFGGGGGRNRRSGGGARFGGRDFRRDRGSGGGGYGGGGGGYGGGGYGGGGGGGGYGGGSSYGGGGQGFSSAWD

SEQ ID NO: 22488 - protein, 410 aa, Acinetobacter sp. ADP1
MDVRLSDRVNAIKPSPTLAVTNKAAELKAAGKNVIGLGAGEPDFDTPQHIKDAAIEAINNGFTKYTAVDGTPGLKKAIIAKFKRDNNLDYQANQILVSCGGKQSFFNLALALLNKGDEVIIPAPYWVSYPDMVIIAEGTPVIVKCGEDQRFKITPEQLEAAITPNTRLLVLNSPSNPTGMIYTKAELEALADVLRKHPQVYIASDDMYEPIRWEDEFYNIATVAPDLYDRTLVLNGVSKAYAMTGWRIGYAAGPAKIIGAMKKIQSQSTSNPTSISQVAAEAALNGPQDVLEPMIEAFKRRHDLVVNGLNEIHGISCLPADGAFYAYANIRPLIRAKGLKSCTEFSEWLLEETGVAVVPGDAFGLGGFMRISYATADDVLVDALARIKKAADSIEGIDAAIASIEAEKNA

SEQ ID NO: 22489 - protein, 233 aa, Magnaporthe grisea 70-15
MADVDMTDAPGGAGPVAKKKGGDGAAGEGKKRFEVKKWNAVALWAWDIVVDNCAICRNHIMDLCIECQANQASATSEECTVAWGICNHAFHFHCISRWLKARQIPPPKSHDHHRSAFSSITMFCDVCSGFDPPPTGSHLTGWRLKNGQGGRTRANAEPLISLAYNNVAAQSPSLRQLNAIVGSKTGPDPTLGLSGLRSLPHKTSGCINSPLSLDSSRRKSCSIKIYKDLRRVW

SEQ ID NO: 22490 - protein, 482 aa, Arabidopsis thaliana
MDFGRSRDIISGLPDSLLCHILSFLNTKEAASTSVLAKKWRYLFASVPNLDFDDSVHLRLGKRNPAVSDQVLRLQDNSPLHKFSLKIRDCVDIVRIICWILKVLERGVSDLELDMHLKWKSSLPSKIFLSETLVRLKLSVERGPFIDVEDVHLPKLKTLHIVSVKFEKHGIGLNKLLSGCHILEELNLEYISWCLWDFVSVSLTTLKRLTFCGEVMQDENPISVSFNTPNLVYLMFTDAIADEYSTVNFDSLVEAHINLQMSEDQVEQTRFSDSEGNMEGCMVANATELIMGICNVKILYLSVYTLEVLTYCCEAIPLFNNLTHLTIESNSEVGWESVSGLLKNSPNLETLVFKGLVHRFTDKCGDMCLCKPWEEDEEEEEDEETPTCLSSCPVKVLKILEFGKIYDDEIEKRIDQVKHFLEKIPDIEQLILHYNTPVDEDVIKVYQQLRRHPKVASSKCKLQLISDNLSLSSKDCALFGID

SEQ ID NO: 22491 - protein, 307 aa, Klebsiella pneumoniae
MNGKIWVLGDAVVDLLPDGEGRLLQCPGGAPANVAVGVARLGGDSGFIGRVGDDPFGRFMRHTLAQEQVDVNYMRLDAAQRTSTVVVDLDSHGERTFTFMVRPSADLFLQPEDLPPFAAGQWLHVCSIALSAEPSRSTTFAALEAIKRAGGYVSFDPNIRSDLWQDPQDLRDCLDRALALADAIKLSEEELAFISGSDDIVSGIARLNARFQPTLLLVTQGKAGVQAALRGQVSHFPARPVVAVDTTGAGDAFVAGLLAGLAAHGIPDNLAALAPDLALAQTCGALATTAKGAMTALPYKDDLQRSL

SEQ ID NO: 22492 - protein, 180 aa, Mycobacterium smegmatis str. MC2 155
MTQHHDTAEVSRVIATLTREVADFPEPGIQFKDLTPLLADARGLRVVTDALADIASGADLVAGLDARGFLLGAAVATRLGTGVLAVRKGGKLPPPVHGATYQLEYGTATLEIPAEGIDIAGRNVVIIDDVLATGGTLAAAARLLGDCGANVTGAGVVLELEALRGREAVAPLGVRSLHII

SEQ ID NO: 22493 - protein, 221 aa, Salmonella enterica subsp. enterica serovar Thompson
VDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 22494 - protein, 264 aa, Rhodopirellula baltica SH 1
MDVSQMCLLAVQYRLVPESPILVAANREEYVDRPSQTPSIQSGKPRVLCGIDQKAGGTWLGVNQNGLFVGLTNRATATPLFGQRSRGQLAMDLLRCTSSRRALEKAHAEFAKNRYEGCNIILADAKAGFAIHADERQEVVELQEGLNIIGARNLNDPDDGRVQLARRLLTLQTLDSPVKFLAVASKVFARSPVGQGRPSMVIRNGDYATVSSTLIALGVKPRDAIYQFSSGAPDESKYEDYSPMLRDILSRGLREARTKAKVGS

SEQ ID NO: 22495 - protein, 307 aa, Salmonella typhimurium
MNAKVWVLGDAVVDLLPESEGRLLQCPGGAPANVAVGVARLGGNSGFIGAVGGDPFGRYMRHTLQQEQVDVSHMYLDDQHRTSTVVVDLDDQGERTFTFMVRPSADLFLVEEDLPQFAAGQWLHVCSIALSAEPSRSTTFAAMESIRSAGGRVSFDPNIRPDLWQDQALLLACLDRALHMANVVKLSEEELVFISSSNDLAYGIASVTERYQPELLLVTRGKAGVLAAFQQKFTHFNARPVASVDTTGAGDAFVAGLLASLAANGMPTDMTALEPTLTLAQTCGALATTAKGAMTALPYQRDLNRQF

SEQ ID NO: 22496 - protein, 307 aa, Vibrio alginolyticus
MNQVWVTGDAVVDLIPESETSLLKCPGGAPANVAVAIARLSGKSAFFGRVGDDPFGRFMQSILDQEGVCTEFLIKDPEQRTSTVVVDLDDQGERSFTFMVKPSADQFMSVEDMGNFKQGDWLHVCSISLANEPSRSSTFEAIKRAKAAGGFISFDPNLRDEVWQDQSEIQAVVMKAVAMADVVKFSEEELLFLTDSTSMAQGLQQIAAMNIALVLVTQGAKGVWRVFESQSELITGQVVSPIDTTGAGDAFVGGLLACLSRHADWKNHPVVSSAIQWANGCGALATTQKGAMTALPTQTELLRFIGQ

SEQ ID NO: 22497 - protein, 555 aa, Ashbya gossypii ATCC 10895
MATTNTFSDFKLASELPAWAKLQELYEKKGKTLSLKEAFATDEQRFQKYSRTFSNHDGSKILFDFSKNLVDDEILGALAQLAREANVTQLRDQMFNGEHINSTEDRAVYHVALRNRANKPMYVDGKNVAPEVDAVLQHMKEFSEQVRSGAWKGYTGKSIKDVVNIGIGGSDLGPVMVTEALKHYAGPLKVHFVSNIDGTHLAETLKEVDPETTLFLVASKTFTTAETITNATSAKNWFLSKTGNNPAHISKHFAALSTNETEVAKFGIDTKNMFGFESWVGGRYSVWSAIGLSVALYIGFDQFEDFLKGAEAVDKHFTSTPIEDNIPLLGGLLSVWYNNFFDAQTHLVVPFDQYLHRFPAYLQQLSMESNGKSVTRGNVFANYSTGSILFGEPATNAQHSFFQLVHQGTKVIPSDFILAAQSHNPIENNLHQKMLASNFFAQAEALMVGKDEAQVKAEGATGGLVPHKVFSGNRPTTSILVQKITPANLGALIAYYEHVTFTEGAIWNINSFDQWGVELGKVLAKVIGKDLDTTGETTSHDASTNGLINQFKAWL

SEQ ID NO: 22498 - protein, 363 aa, Oryza sativa (japonica cultivar-group)
MASSDDGVVALYGGGKVSCKPPAATFSVKVGLAQMLRGGVIMDVVTPEQARLAEEAGACAVMALERVPADIRAQGGVARMSDPALIRDIKRAVTIPVMAKARIGHFVEAQILEAIGVDYVDESEVLTPADDAHHINKHNFRVPFVCGCRDLGEALRRIREGAAMIRTKGEAGTGNVVEAVRHVRSVMGEIRALRNMDDDEVFSYAKRIAAPYDLVMQTKQLGRLPVVQFAAGGVATPADAALMMQLGCDGVFVGSGIFKSGDPARRARAIVQAVTHYSDPEILADVSAGLGDAMSASTSTTKMSSATPPAPTEQLLLLLLLPLSSSLSAPHRWMVNVNQQSSSLTNFLLTMDWRMDDCCCHYY

SEQ ID NO: 22499 - protein, 422 aa, Mesorhizobium loti MAFF303099
MNHFDYRDGVLHAEDVAIPDIAAQVGTPFYCYSTATLTRHYRVFAQAFAGLDALVCYAMKANSNQAVLRTLARLGAGADVVSEGELRRALAAGIPASKILFSGVGKTAREIDLALEAGILCFNVESEPELELLSARAVALGKVAPISLRINPDVDAKTHKKISTGKAENKFGIAWQRARQVYARAATLPGIKVTGIDTHIGSQITELQPFDDAFALLVDLVGALRADGHAIEHVDLGGGLGIPYRVDNNPPPLPDAYAQIVRKHVTKLGLKVMFEPGRLIVGNAGILVSEVIFVKEGDAKNFLVVDAAMNDLIRPTLYDAFHDIRPVVQPPADTPRMMVDVVGQVCETGDYLGLDRDLPRLKAGDLVAVSTAGAYGAVQAGTYNTRLLVPEVLVDGDRFHIVRPRLTYDDLIGLDSVPDWLA

SEQ ID NO: 22500 - protein, 298 aa, Haemophilus influenzae Rd KW20
MSAQNSLFSGSIVALVTPMNHYGEVDFSCLEKLVEHHIEAGSNALVSVGTTGESATLSIEENVKVIEKTVEFAKGRIPIIAGAGANATSEAITMTKLLRDSGVAGCLSVVPYYNKPTQEGMYQHFKAIAECTDLPQILYNVPSRTGSDMKPETVARLAEIENIVGIKEATRDVSRIVKIKQLAGKNFIVLSGDDATGLEAIKLGAEGVISVTNNIAAKDMADMCRYALAGDFDKAEEINARLMRLHHDLFIESNPIPVKWAAYRLGLIKSPHLRLPLTTLSEEIQPKVGDALKIAGLL

SEQ ID NO: 22501 - protein, 109 aa, Glycine max
DYQELAEYTRQRIQQRSKELYTFEVQMEDARNEGLFFKNFRKKAPVDKAKAKEEAEKIEDVAREKAGSRTRKGIYFLYIGLLTFAIEDSVASSSTDWRKIAVQGAILVA

SEQ ID NO: 22502 - protein, 224 aa, Burkholderia sp. 383
MRIETSFLFDLDGTLVDSVYQHVLAWKEALDAEGIELSVWRIHRKIGMSGGLFLNQLLRETSGDLDAERVERLARLHAAAYQRLRAQVRPLPGARELLAALSSAGIRWAIATSGRMETAAINLEALGVDPAKNVVVTRDQVKYAKPDPDLFLTAAAQLNVPIEHTVVVGDSIWDMLAAARCRSLGVGLLSGGYGSDELERAGALRVYDDPADLLWHLDEIAARP

SEQ ID NO: 22503 - protein, 451 aa, Vibrio sp. Ex25
MATHFDYICIGGGSGGIASANRAAMYGAKVALIEAQDLGGTCVNVGCVPKKVMWHGAQIAEAMNLYAEDYGFDVDVKGFDWSKLVESRQAYIGRIHQSYDRVLGNNKVNVIKGFAKFVDEKTVEVNGEHYTADHILIAVGGRPTIPNIPGAEYGIDSNGFFDLAEQPKRVAVVGAGYIAVEIAGVLHALGTETHLFVRKESPLRSFDPMIIDTLVEVMEAEGPTLHTHSVPKEVVKEADGSLTLHLENGESQNVDQLIWAIGRHPATDAINLASTGVATNEKGYIKVDEYQETNVKGIYCVGDIMEGGIELTPVAVKAGRQLSERLFNNKPNAKMDYDLVPTVVFSHPPIGTIGLTTQEAEEKYGKDNIKVYTSGFTAMYTAVTKHRQPCKMKLVCAGEEETVVGLHGIGFTVDEMIQGFGVAMKMGATKADFDSVVAIHPTGSEEFVTMR

SEQ ID NO: 22504 - protein, 532 aa, Prochlorococcus marinus str. NATL1A
MAITDIFQLNNNDKWERYCDLLYSDDSLGFWLDISRMDVAINDFEDFNEIYSKAFDALESLENGSIANIDEGRQVGHYWLRNPKVAPSAEISDSITKEIQNISKFGASILNGEITNRHGKKYTDVFWIGIGGSGLGPLLIKESFKRESIGLNLHFLDNVDPEGISHKLNSILPNLDSTLFVVVSKSGGTPEPLIGMEQAMKFVLDHSQNWSSRAIAITSKGSKLDVLANNENWLDIFDLPDWVGGRTSITGAVGLLPAALIGADINKFLNGASQMDALTRVKDIKNNPAALLSLAWFKSGNGKGLRDMVVLPYRDRLEVFSRYLQQLVMESLGKKFDRDENQVNQGIAVYGNKGSTDQHAYVQQLRDGIDNFFVNFIEILHDPLEIVEVKNKRPGDYLSGFLQGTRSALTEGGRQNLTITFKSFDESSLGALIALFERAVSLYAELINVNAYNQPGVEAGKEAATKIIKLQKEIEELLDDGKQRTLNEINDALSSDSTESIYLILRKLSENSDHYSMIGNQSNPDKLIISKT

SEQ ID NO: 22505 - protein, 661 aa, Vibrio vulnificus CMCP6
MTTSLARPYPLGATLHDKGCNFAVHSPDCASIRLALFDDNNEFKTFELCEEYAGIRYTFVENVQHGQKYGFIIDTDNGPLLLSDPYAKALDGPLHYQTPYSAEKSFSMPKCVVYQDDFDWQGTESPRIPREEMVLFETHVKGLSKLNPEVPPAAQGRYLGLVSDAMLAFYRQQNINTLQLLPVAACMHEPHLLDMGKVNYWGYNPYLFMVPDPRYADKDAILELKTAIRELHRNGIQVILDVVYNHTAEGGAGPTIFNLKGLDSRCYFKHGTHFANFTGCGNTVDLTYQPALNLVMDTLRYWISEFKVDGFRFDLAATLGRQGDDYSRDAAFFKAVAQDPVLKETKLIAEPWDIGPNGYQVGNFPFGWNECNDKLRDITRSFWRGDQGYLKEFATRLMGSRDIYSAANWPYKLTVNYITYHDGFTMQDLVSYKHKHNEDNGEQNRDGHGDNRSENYGAEGPTENLMIIATREKQKRNFMASLLFAFGIPHILTADVLSHSQKGNNNAYCQDNETSWLNWEHSERKHDFRHWLAQMVENRQRYMVPFIRAFSGPSRNLNRIYWRRVDGVHMEHDDWNRLSAVSLHIGIGEKGDEMVYLINQTSAPARFTLPDDNQQQWTYICDTNVRNVSPELAQGEVLLSPVSMAILHYHPQESTPPTAAV

SEQ ID NO: 22506 - protein, 416 aa, Chlorobium tepidum TLS
MLDSHFFSFSDGILCCESVALDELARQFGTPLFVTSRQSLVSQYRSFEEAFASLPHFTCYSVKANFNLAVIRTLAEEGCGCDVNSGGELYRALTAGVPANKIIMAGVGKSEAEIKYGLTSGVMMIKAESISELKAINSVAEHLGKVAQVGVRINPNVTAETHPYITTGDSKEKFGIDEAGLGEVFELFKTLPNLELHGLDMHIGSQIFDPEYYVAATQKLLEVLESARHLGFDIKWLDLGGGFPVTYDPQKPAPPITKFAEKLIPMLQDKGVTVIFEPGRFIAANASVIVTKILYRKKNQIGKEFFIVDAGMTELIRPALYQSHHEVLSVKQHDRSVVADVVGPICESSDFFARHRTIDDAPEGELLAVLSSGAYGAVMSSNYNGRLRPAEVMVDGDEVTLTRRRETYEQLVQNEL

SEQ ID NO: 22507 - protein, 126 aa, Photobacterium sp. SKA34
MTKVITSKSAPDAIGPYSHGNAFGELIFTSGQLPVCKEKGGIVDGGIAEQSRQSLVNLRSVLEAGGGDMDTVLKTTCYLANIEDFAAFNAVYADFFKTECPARSCFAVKDLPMGALVEIEAIAYRK

SEQ ID NO: 22508 - protein, 346 aa, Bacteroides fragilis NCTC 9343
MLAYTYVEHGKFELLEKLRPQIKDARDAIVRVTLGSICTSDLHIKHGSVPRAVPGITVGHEMVGIVEEVGSGVISVRPGDRVTVNVETFCGECFFCRHGYVNNCTDPDGGWALGCRIDGGQAEYVRVPYAEQGLNRIPDNVSDEQALFVGDVLATGFWATRISEISEDDTVLIIGAGPTGICTLLCVMLKKPRRIIVCERSAERIRFVREHYPDVLVTEPENCRDFVLCNSDHGGADVVLEVAGSEETFRLAWECARPNAIVTIVALYDKPQFLPLPDMYGKNLIFKTGGVDGCDCAEILSLIEQGRIDTTPLITHRFPLNEIEEAYRIFENKLEGVIKIAITGGR

SEQ ID NO: 22509 - protein, 90 aa, Zea mays
MEYLPDVYEKPEAIKGLAGRCMSGRKLGVCRPSAPSIRRPRAGAVVAKYGDKSVYFDLDDIGNTTGQWDLYGSDAPSPYNPLQSKFFETF

SEQ ID NO: 22510 - protein, 278 aa, Debaryomyces hansenii CBS767
MSLQKLTGELYQLFESEKYTQCQKILTPIKIELIKHNLLVPLASNSGNKDQLNDLKIAERILEIGSLASLLSNDYQGFENYFAQLKPFYSNEKLHSKLEINTDSTKIISLYLLYLLSQGLISKFHVELEYIFNKRQYNIEKDSYLQFPINLERNLMEGNYNKIWKLLNESDNKLPCKEYKHFIDTLITALRFEIAKSLERTYESLPVSNCKNLLYFPQEQSDSVFQQFCERDLEIETWSFKDGTIFFHSKSKDETSGDNSTAVINNVLNYAEQIESIV

SEQ ID NO: 22511 - protein, 149 aa, Arabidopsis thaliana
MEQTFIMIKPDGVQRGLIGEVICRFEKKGFTLKGLKLISVERSFAEKHYEDLSSKSFFSGLVDYIVSGPVVAMIWEGKNVVLTGRKIIGATNPAASEPGTIRGDFAIDIGRNVIHGSDSVESARKEIALWFPDGPVNWQSSVHPWVYET

SEQ ID NO: 22512 - protein, 126 aa, Photobacterium sp. SKA34
MTKVITSKSAPDAIGPYSHGNTFGELIFTSGQLPVCKEKGGIVDGGIAEQSRQSLVNLRSVLEAGGGDMDTVLKTTCYLANIEDFAAFNAVYADFFKTECPARSCFAVKDLPMGALVEIEAIAHRK

SEQ ID NO: 22513 - protein, 228 aa, Oryza sativa (japonica cultivar-group)
MAADSLLDMSLDDLITNKYKRRSRPGPAPSARRSHSRAATRSAAAPYHAITFQAPPTAYVHPTPAANVETGTKLYISNLDYAVSNEDIKELFSEVGDVKRYSINYDRSGRSKGTAEVVFSRKSDALAAVKRYNNVQLDGKPMKLELIGINIEPPPPAIFGFAAPAGYFDFPPKRGGRGWPRGRGGFGGRGRGHVGRGRGRGDRGSRKISAEDLDADLDKYHAEGMQMS

SEQ ID NO: 22514 - protein, 758 aa, Desulfitobacterium hafniense Y51
MEFSRRNFLKTCAISAAMMTVGCTSQTKTIQVDPPEPAPSAPKQIDVDQWVKSVCRYCGTGCGVLIGVKDGKVAAVKGDPDNEGNKGLLCAKGYYLPQVITHSERVTKPLIRKNGKLEPCTWDEAMELVTAKFKESIANNGPDSVAFYGSGQQLAEEGYVANKLFKGAIGTNNIDGNPRLCMASAVGGFTTTFGADEPMGCLEDFEHANVFFIIGSNIAEAHPVLFGRLTDKKKKDPDTKIIIADPRRHRSHEIADISLQFVPGTDMALLHAMAYVIIEEGMADEEFIAKHTSFSNGKEAITFEAYKEFLKEFTPEKAEKVTGLPAAQIQEVARLFGEKGKNTMSMWTMGINQRVAGVWANNLIHNLHLLTGKICKPGSTPFSLTGQPSACGSVRETGALSHLLPGHRVIANEKHRKEVAELWGVPADRISPQAGLHTMELFKACGDGRVKCLYVMCTNPAHSLPNVNAYQEGFEKVFLVVAEAFHPTATTKYADVVLPAAFWCEKEGVYGNTDRRTQHLAKAINPPGEAKPDLDILLDLAQRLGYGELFPFKTPEDVWNEYLKCTTGTHMELATYPALREAHGIQWPVKDHQGNKGAVRRYVAPEDPYVKEGIDFYSAKDHKAVIFARPYLGPAEVVDEEYPYYLTTGRILEHWHTLTMTGKCPTLMRAVPKQYVELNPQDAAELGIKEGDTVRLVSRRGKVEIPVRVGKPGEPRPGLLFALWFEPDPLVNAVTIDAVDAASKEPEFKICAVKIEKV

SEQ ID NO: 22515 - protein, 321 aa, Medicago truncatula
MENRCPIYGPLTEELTFLEGSAPFNNCHASTIVEFDKDHFLVAYFGGTSEGAPDVKIWLQTCKNGRWESPVIADEQPNVPMWNPVLFKLPSDELLLFYKIGQEVQKWSGFVKRSYDKGNTWTEREQLPPGILGPIKNKPILLENGHLICGSSVESWNSWGAWVEVTSDFGRSWSKHGPIYIENEPLSVIQPVPYQTADGKLRVLLRSFDGIGRVCISESSDGGQTWGHAKPTQLPNPNSGIDGVKLRDGRILLVYNTTSRGILKVALSNDDGDSWYEALTLEDSSGMEFSYPAVIQASDGLIHITYTYKRTQIKHVTLRPN

SEQ ID NO: 22516 - protein, 388 aa, Arabidopsis thaliana
MDKTFFSSNEGKPITCKAAICRKAGEALVIEDIHVDPPQAYEVRIKILCTSLCHTDLTFWKLSFGPISRFPRILGHEAVGVVESIGENVDGFKQGDVVLPVFHPYCEECKDCKSSKTNWCDRYAEDFISNTRRYGMASRFKDSSGEVIHHFLFVSSFSEYTVVDIAHLVKISPEIPVDKAALLSCGVSTGIGAAWKVANVEEGSTIAIFGLGAVGLAVAEGARLRGAAKIIGIDTNSDKFELGKKFGFTDFINPTLCGEKKISEVIKEMTEGGVDYSFECVGLASLLNEAFISTRTGTGKTVMLGMEKHAAPISLGSFDLLRGRVICGSLFGGLKSKLDIPILVDHYLKKELNLDSFITHELNFKEINKAFALLEEGKSLRCILWMDK

SEQ ID NO: 22517 - protein, 381 aa, Mycoplasma mobile 163K
MVKKEMIAMILAGGQGTRLKNLTKKIAKPAVPFGAKYRIIDFTLSNCINSGIDTVGVLTQYRPLSLLKHIGSGIPFDLNRLNGGVVLLSPYVKESEGYWYAGTAHAIFENIDFMNEYDPTYALILSGDHIYKMDYSKMLDFHKEKNANVTIATINVSFEEASRFGILNTNENNMVEEFEEKPKIPKSTKASMGVYIFNYQLLKDTFEELKSKGNNFQDFGHNILPYILKKYSKIFAYEFNGYWKDVGTISTFYEANLDLIKNHKNLDLREKNWTIFTKSSSHSPQYITSGGNVVNSLVANGAKIEGHVSNSVIFENVKIGKNTIIEDSVIMSNAIIGENSFIKKTIIMENTVVKEKMVLNSLNNQSLNEEDGIILYDGKEK

SEQ ID NO: 22518 - protein, 797 aa, Cryptococcus neoformans var. neoformans JEC21
MSASYNGIEAPIPRDQATDFPIQTFYASTESPELDQKQEDNVDLEKNESTDNVEVKVESIKDPGVELTPNEAFRWNVDGDQSPFPEVAACVPNTDDPSIPCNTVRAWILLTVFVVLFAGVNQFFGLRYPSLTIGYVVCQLLVFPIGRAWEKLPKWVVPLGPFSFYLNPGKFTIKEHALIVICVNLTASTAYAMGSLVAIISPVYWNSDFGAGFSFVYLLTTQALGFGLAGLARRWLVYPAALIWPSSLASTVLFRALHEPQSRSPANGWTITRYRFFVYLTIGAFIWFWFPDYIWTSLSTFAFITWIVPHNQKVNTIFGMNSGLGLLPISFDWTQINYAGYPLTTPFYITCNAFAVVVFFYLFLSPILYYKNVWHSAYLPLLSSSTFDNTGSSYNISRVVDEKLDFVLAKYQEYSPMYISMSYSLTYGLSFAAVTSIVFYTYLYSGKEIWAKFKDAKHGGEDIHKRLMSSYKEVPDWWYGVLTLVVLGLGIFTCRYWDTQLSVWGFIVVCFGMGLVLIVPEGILEGTTNQRIFLNIITELIAGYAWPGKPIANMLVKCYGYNSVKHGMDFAQDLKLGQYMKIPPRTLFWAQIYSTLLATMTQTGVLRWMIGNIKDLCQPTNSDRFTCAGAKVVYNASLIWGTIGPQRMFQAGQVYNGLMYFFLIGPVVTVLVYLVYRRYPSSWVKYINVPVFFNAAGNIPPANTTQYSLWFIFGFIFNYLIRRRAFAWWKRYNYLTQAAMDTGTALATIIIFFALSYNGVKLNWWGNTVGSDTDDAKGTPWLTVPSGSYFGRGPGEF

SEQ ID NO: 22519 - protein, 722 aa, Mycoplasma mobile 163K
MNKTALLDLYNPHDLEAFLDDFNEIVIKAPKNFYTHNDSFSLENINTNEKLNNLQIAYIDDKNTFSYLHLFIKSNFIDFKNYYKIIGKYNYEIALKFGQIIKKEIFDEIFFYSGNDLGPTYSKQSTTFKVWSPTSYKLRLKIKKSFNDIAEYFDMERQEKGIWQITISRDLESYLYQYEVENNFITSETIDPYAKASTANGKYSYVINLDLLEKYNFVYKSKLANKTDRIIYEISIRDFTDSNEFKYPGKYLGLTEEGIKNKDGFSIGIDHIKNLGINTVQIMPFYDFATVDEERDVENQYNWGYDPLQWMVPEGSYSTNSYDPYLRLIETKKMINNFHKNDIDVVMDVVFNHVYDAFSFSWHILAPHYFYRYNTDLSLSNMSGTGNDVASEKKMVRKYIVDVVKHWQETFKIDGLRFDLMGLLDIETILEVDENTKNNNSNFIIYGEGWVMNSESTKKILANMENSRFLANIGFFNDYFRDVFKGNQWNVYSKSFSAGDWQQGHKALNSITGSLGLYEYAKKFNFLSQSVNYVECHDNYTLFDFFKIKLSSFSDFTIKKIHALTTAITLISQGIPFIHAGQEIFRTKYNVENSYNFPIEINRFEWNKLKENYWNVELIKKIIEIRKKYNLFRLETIQLVKEHVKIFVGNNSLIYYLLEDSDYSIQVNININQNDIEIDLDSNFWTCILNSQNLENNEIKNNKILIEAHGFYIFIKNKKKVK

SEQ ID NO: 22520 - protein, 433 aa, Medicago truncatula
MSLFLSFLHIVFLISSIIHTAYSFSGLNSTEAHGKGYIQGLVVEEFTFPAKSSVPFNSCHASTIVEVGKGHFLVAYFGGTSEGAPDVKIWLQTYKNGIWQAPVIGDEEPNVPMWNPVLFKLPSNVLLLFYKIGQDFQKWSGFIKRSYDKGITWTEREQLPPGILGPIKNKPILLENGDLLCGSSVESWNSWGSWAEVTTDFGKTWRKYGPIYIKNNPLGVIQPVPYQTAKGTLRVLLRSFTGIGRVYMSESFDGGKTWGYAEPTQLHNPNSGIDGIKLKDGRLLIAYNTISRGVLKLALSEDDGDSWHQALTLEDTVGMEFSYPAVIQASDGRVHVTYTYNRTQIKGASPDKKKNEKLEAYRKGYKTTISQQGLRHNARNNSRRPQIKFCKSICNLVSLAKNMLHLITRQISNAIGDFEKPRSNDDFFHTPSK

SEQ ID NO: 22521 - protein, 181 aa, Brassica napus
MASSMLSSAAVATSPAQATMVAPFTGLKSSAAFPVTRKSNTDITSIASNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 22522 - protein, 1065 aa, Clostridium acetobutylicum ATCC 824
MPLDKTIKKVLIIGSGPNNIGQAAEFDYSGTQACKAVKEEGIETVLVNSNPATIMTDSHIADKVYIEPLTEEAVEKIIEKERPDGILAGFGGQTALNLAMNLNDAGVLDKYNVRLLGINSEAIKKAEDREEFKNLMEEIDEPVPKSIIATHIDECIDFVNKFGLPVIIRPAFTLGGTGGGIASTMEELKEICDRGIKMSPIGQILLEQSVAGWKELEYEVMRDAKDNCIIVCNMENLDPVGVHTGDSIVTAPSQTLTDKEYHMLRHSALKIIRNLKIEGGCNIQFALNPKSNDYIVIEVNPRVSRSSALASKAAGYPIAKIAAKIAVGYSLDELKNYVTKNSSACFEPALDYVVVKIPKWPFDKFNTAERHLGTQMKATGEVMAIDRDFESALLKAVTSLEGKISGLRLEKFEYTTVRELLEKIKKQDDERIFAIAEAFRRGVDVKQIHEVTEIDNWYLNGINRIIDMEKELQDKNNKDKDKSIIKAKKMGFTVAEIARITSLEEGKIKNILNVNNVKPVFKMVDTCSGEFEAETPYYYSSYENEDENEVTDDKKIVVIGSGPIRIGQGIEFDYCCVHGVWAIKEAGYKSIIINNNPETVSTDFDTADKLYFESLYIDNVMNIIEKEKPEGVIVQFGGQTAINLADKLYKNGVKILGTSFESIDLAEDREKFSELLKELNIPQAKGMAVTSMEEAYEAVKEIGYPVIVRPSYVIGGRAMQVVYDKLALQKYMTEAVTLSTEHPVLIDKYIKGTEIEVDTISDGENILIPGIMEHIERTGVHSGDSITMYPYHTLPKEVVDKLVKYTKSLAKALEVKGLMNIQYVYDGENVYVIEVNPRASRTVPILSKVTGVPMVKLAVEILTGKNLKELGYGVDLKKDNKLYAVKVPVFSNEKLANVDIYLGPEMRSTGEVMGIDSDFEVAIYKGFRAAGIEVPKDGGNLYVSIKDVDKQESVPIIKKYTEFGYKIYASLGTGKFLQKQGIDCEVLRTDDLMKAIGDGKINLIINSPTRGNTVGTRGFSIRRKAAEYKVGAFTCIDTAKAFLTAIKVKREEAKVEYRAMKEYFK

SEQ ID NO: 22523 - protein, 598 aa, Mycoplasma mobile 163K
MDKSKIRNFSIIAHIDHGKSTLADRILELTETVEKRDLKAQHLDSMDLEKERGITIKLNAVQIKYKDYVFHLIDTPGHVDFTYEVSRSLAASEGAILLVDATQGIEAQTLANVYLAMDNGLEIIPVINKIDLPSSDPEAVKKEIEEVIGIDASDAILISAKTGKNIEDVLKAVIEKIPAPKNADDNKPLKALVFDSYYDQYRGVVLLIRIFEGKIKVGDEFFFMQSKNKFHATELGVRKPVELKKDSLEAGEVGWLSASIRNAKDVSVGDTITLYNNPTEKPLQGYKKLKPVVYTGFFPIDSQDYDDLKESLIKISLSDSSISFEPETSKALGFGFRVGFLGMLHMEILQERLSREFNIDLIATAPSVEFHVTTTNGEMLSISNPSLLPEKNYIQKIEEPYIKASIILPKEYVGAVMEMCQGKRGVYQDLEFLDENRRRLVYNLPLSEIVFDFFDRLKSLTKGYASFDYEIIGYLESDLIKVDVLLNGEKIDALAIIVHKDFAYSRGRDLTVKLKEVIPRQNFEIPVQAAIGAKVIARETIKAYRKDVTAKLYGGDVTRRQKLLKKQKAGKKRMKSIGSVEIPQEAFLAILETDVTKK

SEQ ID NO: 22524 - protein, 176 aa, Triticum aestivum
  misc_feature (16)..(16): Xaa can be any naturally occurring amino acid
  misc_feature (85)..(85): Xaa can be any naturally occurring amino acid
  unsure (1)..(176): unsure at all Xaa locations
PHSFEFRLRIALGAGXDLSLTSRIRNTNTDGRPFSYTFAYHTYFSVSDISEVRVEGLETMDYLDNMKGKERFTEQGDAIVFESEXAIIDHDMRRTFVVTKEGLPDAVVWNPWDKKAKAMQDFGDLEYKHMLCVEPAAVEKPITLKPGEEWKGRLGLSAVPSSYCSGQLDPLKVLHG

SEQ ID NO: 22525 - protein, 515 aa, Mycobacterium smegmatis str. MC2 155
MAVFTFAELTPTSLLQRSAQAFPDRLAIVDGELRLTYTQFAERCGRVTSALAAAGVQPGDRVAALCTNSHVMLELHQAVPARGAVLVPLNTRLAFEEMQYIIGHAGARILIATREFADRARELADDAGIDVVIEGDGYEEWLPDVASPEDRVAVGERDLLAINYTSGTTGRPKGVMYHHRGAYLQAVAMAYHTRLDPSTGYLWTLPMFHCNGWCFTWAVGAAGGTHICLRKIDSAEIWRWLRGGGITHFSAAPTVLTMIAEDPSAQPLPARVHVDTGGAPPSPALLARLTPLGFDVTHLYGLTETYGPVAVNVWQPEWDELPDDEQARLRARQGVGNIIANPLRVVDLGGDDVPRDGTTIGEIAARGNDVMLGYYNDDAATSAATRDGYFLTGDLAAMHPDGYVEIRDRAKDVIISGGENIASIEIEKVIDSHPEVVESAVVGVADEKWGEVPVAFITRRDGSDVTFDQLTTFLREHLAGFKVPRTMVFDHLPKTSTGKIQKNVLRARAEQDKAN

SEQ ID NO: 22526 - protein, 580 aa, Mycobacterium bovis AF2122/97
MPEFRVWAPKPALVRLDVNGAVHAMTRSADGWWHTTVAAPADARYGYLLDDDPTVLPDPRSARQPDGVHARSQRWEPPGQFGAARTDTGWPGRSVEGAVIYELHIGTFTTAGTFDAAIEKLDYLVDLGIDFVELMPVNSFAGTRGWGYDGVLWYSVHEPYGGPDGLVRFIDACHTRRLGVLIDAVFNHLGPSGNYLPRFGPYLSSASNPWGDGINIAGADSDEVRHYIIDCALRWMRDFHADGLRLDAVHALVDTTAVHVLEELANATRWLSGQLGRPLSLIAETDRNDPRLITRPSHGGYGITAQWNDDIHHAIHTAVSGERQGYYADFGSLATLAYTLRNGYFHAGTYSSFRRRRHGRALDTSAIPATRLLAYTCTHDQVGNRALGDRPSQYLTGGQLAIKAALTLGSPYTAMLFMGEEWGASSPFQFFCSHPEPELAHSTVAGRKEEFAEHGWAADDIPDPQDPQTFQRCKLNWAEAGSGEHARLHRFYRDLIALRHNEADLADPWLDHLMVDYDEQQRWVVMRRGQLMIACNLGAEPTCVPVSGELVLAWESPIIGDNSTELAAYSLAILRAAEPA

SEQ ID NO: 22527 - protein, 435 aa, Oryza sativa (japonica cultivar-group)
MASEKHFKYVILGGGVAAGYAAREFAKQGVKPGELAIISKEAVAPYERPALSKGYLFPQNAARLPGFHVCVGSGGERLLPEWYSEKGIELILSTEIVKADLASKTLTSAVGATFTYEILIIATGSSVIKLSDFGTQGADSNNILYLREVDDADKLVAAIQAKKGGKAVIVGGGYIGLELSAALKINDFDVTMVFPEPWCMPRLFTADIAAFYESYYTNKGVKIVKGTVAVGFDADANGDVTAVNLKNGSVLEADIVVVGVGGRPLTTLFKGQVAEEKGGIKTDAFFETSVPGVYAVGDVATFPMKMYNELRRVEHVDHARKSAEQAVKAIKGKESGESVVEYDYLPYFYSRSFDLGWQFYGDNVGDTILFGDSDPTSAKPKFGSYWIKDGKVLGAFLEGGSPDENKAIAKVAKTQPPVANIEELKKEGLQFASKI

SEQ ID NO: 22528 - protein, 1203 aa, Vibrio vulnificus CMCP6
MNKQPLKLSVVAKAIMPLMATSLLIGCNSSNDGETANPQPDTGKVARVYFKASETATRAAADSSAYDQASLYVWNNDTCGGYAETDEGHDDWGTGIKPTGVDDKFGAYWDLQVRSEATQCINFIPRVDGAKPLGDFDAKLDLTQTGKNNAVYTQQGVAAVYPELISTSDIPANTARVYMNTPDGDEGHFTLHVWNNDTCGAFDGNDTSWPGMEPTGFSDVYGPYWDLPVKGAEGCINIIPNNKSNGDYQTENLKFEFDKTTAIGNVAFVFKGTNKVYYTALAQKPVAQVELAGASAIFADDSVILVNAKDATSVTLYYSENGELAFDSASKKVTGATKQISSSKAASSDWNKTKPHLSNDFIGFEMDFSGEGNALKDLLKGQLILVASDATGVIKATEVQPASALDALYAAAATKLSYGAVINPDSTTTFRLWAPTAQNVKLIPYNAEKQAQTAIAMTFDATSGAWVAANTALKHGDFYRYEVTVYHPATDKVETYQVTDPYSLSLSMNSEYSQVVDLTNAELKPSGWDALAAPHNQANPAEFVLYEAHIRDFSALDDSTAEANRGKYKAFTQAGTAPVEHLKKLAQSGVTHLHLLPTFDIATINEDPTKVANINQPFAKLCELDASVKNDADFGNYCDSNETLSTVFETLAKKDSKESAVVQRLNSHVRNLDSFNWGYDPFHYTVPEGSYSSDAEGMVRIKEFREMVMSVKKEIGMNVVMDVVYNHTNESGVSSKSVLDRIVPWYYQRLNEFSGAVEQSTCCSNTAPENQMFAKLIDDSISTWVKEYKIDAFRWDLMGHHPLAQMQQTLAAAKAVDPNVYFYGEGWNFGEVGSDRMFKQATQLNLAGTGIGSFSDRLRDAVRGGGPFDSQDSLRSNQGFGNGIYVQVNEKNEQNAALKTTALHLADLTRLGMAGNLKAFPFTDSKGKAITGAELDYNGQPAGYAQDAWEIQNYVSKHDNQTLWDNNQYKIAYATTAAERTRMQAVGLSTAMLGQGVPFIHMGSELLRSKSMQRDSYDSGDWYNRVDFTKQDNNWNVGLPREDKDGSNWAIIDAVITGSSDRAMPSATDIDNMDKFFNELAALRASSGLFTLGKGSEIIKRVAFHNTGAEQTPGLIVMSIDNSGDNHDATIDATRDGVVIVVNASPTMVSDFAKFDATGYTLHAVQTNAGNDSLAKNQDKAAQVVNGKLTVPAWSVAVFEKLR

SEQ ID NO: 22529 - protein, 320 aa, Arabidopsis thaliana
MKITDISGKIETLVDSLRDMSPTRVRSSFSDEHVSENDDERSSWIALHPSALDMFEQIMRDAEGKQIIMFLDYDGTLSLITEDHDRAYITDEMREVVKEVATYFKTAIISGRSTDKVQSFVKLTGIHYAGSHGMDIKGPTNTDQSNQEEVMFQPASDYLPMIDEVVNVLKEKTKSIPGATVEHNKFCLTVHFRRVDETGWAALAEQVRLVLIDYPKLRLTQGRKVLELRPSIKWDKGKALEFLLNSLGIAESKDVLPVYIGDDRTDEDAFKVLCERGQGFGIIVSKTIKETYASYSLQDPSQVKEFLERLVKWKKQTLGE

SEQ ID NO: 22530 - protein, 165 aa, Thlaspi caerulescens
MEGMLGLLKIRVKKGINLARRDSRSSDPFVVITMGLHKLKTRTVEDNCNPEWNEELTLAIKNLNEPVNLTVYDKDTFTSHDKMGDAQIDILPFVEVHKLGLQELPDGTVIKTVLPTKDNCLAEESKIVSKDGKIVQDMILVLRNVECGEVEIQLEWIVLPGGRGL

SEQ ID NO: 22531 - protein, 304 aa, Prochlorococcus marinus str. NATL1A
MHNFLPFAWFEGQCIPFNDAKLSIATHALHYGTAAFGGMRAIPDPNNSKSFLLFRADKHAKRLCQSAKFLMTELDEDFVLNSLETFLVKNKPTQPVYIRPFVYTSDLGIAPRLHNIETNFFIYGIELGDYLSPDGVTCRVSSWTRQQDNSLPLRGKISGAYITSSLAKTEAVKSGFDEALLLNSQGKVSEASGMNIFIVRNGDLITPGVDQDILEGITRASVIELAKSNGINVIERPVDKTELFISDEVFLTGTAAKITPIKMIETTLMSKEMPIMNLLRDKLTKITEGLAPEYENWVKRVNID

SEQ ID NO: 22532 - protein, 573 aa, Debaryomyces hansenii CBS767
MCGIFAAFRQPEVEQFKSKALQYSKRIRHRGPDWSGNVIQNSTILCHERLAIVGLDSGAQPITSEDGNYTLAVNGEIYNHIQLRDEFPSYPYKSLSDCEPIIPLFEKYDVDAPKYLDGMFAWVLYDKKNDRIVASRDPIGITTLYMGKSSKNPKTRYFASELKCLTDECDEIFAFPPGHVYDSNTDEITRYFNPSWWEESSIPSKRVDLKEVRETLELAVRKRLMAEVPYGVLLSGGLDSSLIAAIAARETQKAAAGISKDGIDANKELSGVDEKGSLHSSGWNQLHSFAIGLPGAPDLIAAEKVAHFIGTIHHSHTFTLDEGLDALDDVIYNLETYDVTTIRASTPMYLLSRKIKAQGVKMVLSGEGSDEIFGGYLYFANAPSPKDFHEECVKRVKNLHYADCLRANKSTMAWGLEARVPFLDKQFLEVCMNINPEDKLIKPAEGKIEKYILRKAFDTSDDPNAKPYLPEEILWRQKEQFSDGVGYSWIDGLKDAAEAAISDEQFANPKAEWGTDVPTTKEAYWYRCKFDEIFHSKAAASTVMRWVPKAEWGCHADPSGRFATIHEQKVDQD

SEQ ID NO: 22533 - protein, 396 aa, Oryza sativa
GTGGRWGRLGEEDRRGEDDGAMGGGAMTWGMRTGVDVSIRCGSPIDLKPVLDDHESEFQHQFMIWVDYVLHGPEFQTPVLKSKQCMNENARLLDSFPRTSSCRLRKHMPIVIPSNTECAAHNNIKHPVLKSFNAYNSWPTQPAGWWAAGKAEVKLILGGRDELGGGTWLGCTRDGKLAFLTNVREPGTLVGPNVRGELPVRFLQGNQCPLEYAEEIAKEADQYNGFNLVLADVQSGNMAYISNRPEGDPVVQKVLPGFHVLSNAAIDCPWPKMLRLGQSFNRFLATQDGAEVSLQQMVEELMMDPVKADKSAVPDTGVDPDWEYQLSSIFIDTEKGQARYGTRSMTALAVKFNGEVTFYERYLESNLWKENLMQFELEMSQWEDLRGTSNISPKSC

SEQ ID NO: 22534 - protein, 486 aa, Photobacterium sp. SKA34
MTFINNVQVEKSLYIAGEWQSGINTIANINPSDISENLGDFAQASEAQVEQAIQAAKVAQPEWEKTPIERKQAVLQAIGDELIARCDELGTLLSREEGKPFAEGRGEIYRAGQFFHYFAAEVLRQIGDNAASVRPGVFVEVTREAVGVIAIISPWNFPTATAAWKIAPALAFGNSVVWKPANLTPASAVALTEVIHRQGLPAGTFNLVLGSGSQVGNTLIHSKDVNGVSFTGSVDTGRKVAAATASNFVRCQLEMGSKNALVVANDADIQIAVEATIAGSFSGAGQKCTASSRLVVMDGIHDAYVEALIKRMSELKVGHALEEGIFMGPVVDGNQLEANFVWIDKACQSGAELAFGGERLNLKNEGFYMSPTLFLNTQNSWEVNQEEVFAPMASVIRVSDLDEAIAVANDTRFGLTGGIITQSLRNSAIFKQQIQTGCVMVNLPTAGTDYHVPFGGRKESSFGPREQGQYAKEFYTVVKTAYQRPY

SEQ ID NO: 22535 - protein, 1240 aa, Arabidopsis thaliana
MASQMPFTTISRKISCMKLLPLCPLQLSTTQTPTTIPMSLSFYKNELSDDTPCQSGYTDYISFQVPDETFPEISNCIGIAKGYKQNSNNEKNGYTSLEAVLLSVPNGYTCVDLSLYKDKELVLLLNKTNTDSEGSGEACMMVVQTGDLAFISISGSSSLNQWELEDLKVLLISSINIDGSIVNLEMENEKVRKVPHSVIAPLAVSASRGVACVFAERRRALVYILEEDEDEEISDENSTKEARRNSLSFSKLYATVTEVVLFCLMENDQFMCPTDIITGIVFIDGELAMLTLTADGELRWTEYGLRQYLSMKKDVLGFIVEGKQIRVKAVVEKEAGGICCGQFGGDFVRKDFVFEPLIDQNGWCYKLRQYLDSLGRPKRLLVFVNPFGGKKSAREIFVKEVKPLFEDADVQLEIQETKYQLHAKEFVKSMDVSKYDGIVCVSGDGILVEVVNGLLERADWRNALKLPIGMVPAGTGNGMIKSLLDTVGLRCCANSATISIIRGHKRSVDVATIAQGNTKFFSVLMLAWGLIADIDIESEKFRWMGSARIDFYVCLVDKFDNYCIAVVKLLALQRIICLRRYNGRILFLPAPGFEGYGQPASCSLYQEPHVSDKEVGYQGPETKFEDLEWREMKGPFVTIWLHNVPWGSENTLTAPAAKFSDGYLDLIVLKNCPKLVLLSLMRQTSSGTHVESPYIVYIKLTVEKVKAFVLEPGALVDEPDKEGIIDSDGEVLARGKRTYKCDQKALMSYDKLQVTVDQERLFCKFCISQRELVLAKLSPTTKLVSLHLAMDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGRTRSLDVATISQGTTKFFSVLMLAWGLVADIDIESEKFRWMGSARFDIYVCLVEHLKIFCNACFNMRYSTKLLVEVEQKKKKKEIGLQRIICLRQYHGRILFVPAPGFESYGQRASCSIDKEPSGSDKTLVYQGPDSKLENLDWREMKGPFVSVWLHNVPWGAENTLAAPDAKVKAFVLEPGARIDEPDKEGIIDSDGEVLARGRKSYKCDQKALMSYDKLQISVDQGLATLFSPE

SEQ ID NO: 22536 - protein, 608 aa, Ashbya gossypii ATCC 10895
MSNANHHHQQQKMYTGGRNMPHGMHRPGSIPIGQRIGKYQVIKTLGEGSFGKVKLAHHVSTGQKVALKIINKKVLAKSDMQGRIEREISYLRLLRHPHIIKLYDVIKSKDEIIMVIEYAGNELFDYIVQRDKMSENEARRFFQQIISAVEYCHRHKIVHRDLKPENLLLDEHLNVKIADFGLSNIMTDGNFLKTSCGSPNYAAPEVISGKLYAGPEVDVWSSGVILYVMLCRRLPFDDESIPVLFKNISNGVYSIPKFLSQGAANLIKRMLIVNPLNRITIHEIMEDEWFKVDLPDYLVPVDMKADATSKPGTDDERIDEALVAVLANTMSYDKDEIYEALEDPNQTDPTVLEIRDAYLLLKENKSLIDGLRSNKQKLDQLDTFLSQSPPTFESHSQLGPGSGFQAALGGSQHGDQNPHQVKRLASRQRTYQLSFSEQQDEDSTIAILPSSLPQIHRANMVAQGSPAAVKISPLSNKKSKTRWHFGIRSRSYPLDVMGEIYLALKNLGAEWAKPSEEDLWTIRVRWKYDVGTQQNERIPDLMRMVIQLFQIETNNYLVDFKFDGWESSSGNPISSSSTDDEMSTFSAYPFLHLTTRLIMELAVNSQSS

SEQ ID NO: 22537 - protein, 444 aa, Zea mays
MGKRSGGRKLPFFTRSSSSSSKRNRSARRLPSLPKQDNATRALLASPSAASPSATPGSAAAGQTAQLPPPLSVTAGGGVAVSGKVNKKKAGTRLWMRLDRWSASEIVELDKASIIRRAGLPPRDLRILGPVFSRSSSILAREKAMVINLEFIRAIVTAEEVLLLDPLMHEVLPFVDQLRQHLPLRSRVGENGECAPDGNGEKQKGSLNEATGAEHELPFEFHVLEVALEVVCSSLDLSVSDLERHATPVLDELTKNVRDEIEHLLDDNEDMEHLYLTRKQVQNQQVEALMSSAASNSIVLAGTGVPRLNSSFRRSLSIATSMHLDNDVEDLEMLLEAYFMQLDGIRNRILSVREYIDDTEDYVNIQLDNQRNELIQLQLTLTIASFGIAANTFIAGAFAMNIPGSLFNTDGSLFWPFVGSTSSGCFVITVLLLGYAWWKKLLGP

SEQ ID NO: 22538 - protein, 393 aa, Sorghum bicolor
MSLSLKRKDLMIVNMGPQHPSMHGVLRLIVTLDGEDVIDCEPILGYLHRGMEKIAENRSIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWMDKCLDFCDYFLQGVVEYQQLITRNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 22539 - protein, 204 aa, Streptococcus thermophilus LMG 18311
MTKRTVIIGVGGPVGSGKTLLLERLTRRMSDLNLAVITNDIYTKEDALFLAKNSSLDEDRIIGVETGGCPHTAIREDASMNFEAIETLQERFNHDLDVIFLESGGDNLAATFSPDLVDFTIYIIDVAQGEKIPRKAGQGMIKSDLFLINKTDLAPYVGANLDRMREDTLHFRNEDSFIFTNLNNDDNVKEVEEWIRKNFLLEDL

SEQ ID NO: 22540 - protein, 879 aa, Triticum aestivum
  misc_feature (168)..(168): Xaa can be any naturally occurring amino acid
  unsure (1)..(879): unsure at all Xaa locations
MLLHGLVDRLTGKNKQAWKEGKIRGTAVLVKSDVLNLGDFHASLLDGVHDILGKDDGVIFHLVSATAPDPQNPRRGKVGKPAHLEEMVVTMKSKAAGESVFKVTFEWDDSQGIPGAVVVRNTYRSEYLLKTLTLHGVPGKGTVVFVANSWIYPNVDRVFFANDTYLPXSKMPALLVQYRQDELNNLRGDGTTGKYEEWDRVYRYDYYNDLGEPDKGHPRPVLGGTQELPYPRRCRTGRPPTKTDPRSESRIPQYKIQEALNIYVPRDERFGHLKLSDFLGYSLKAITEAILPVIRTYVDTTPKEFDSFQDIYDLYDGLLKVPDNQHLKELKKKIPLQFIKSLLPVAGDDLLNLPLPHVIRSNDYAWRSDEEFAREMLAGVNPVCIKRLTEFPVKSTLDPSVYGDQSSTITEDQIQQNLEDGLTVKQAMEKNRLFILDHHDNFMPFLDRINKLEGNYIYASRTLLFLKADGTLKPLAIELSLPHPQGMQHGAESKVYLPAGIESGVDGQIWQLAKAYASVDDSAWHQLISHWLNTHAVIEPFVIATNRQLSVVHPVHKLLSPHYRDTLNINALARTTLINAGGVFEMTVFPEKYALEMSSIVYKNWKLTEQGLPDDLVKRGMAVPDSSSPYGVRLLIKDYPYAVDGLVIWWAIERWVNEYLAIYYPNDGVLRADKELEEWWKEVREVGHGDLKDADWWPRMVTVQELAKTCTTIIWVASALHAAVNFGQYPYAGYLPNRPTVSRRKMPEEGEEEYKQLQKGGKEADKVFIHTITSQFQTILGITLIEILSKHSSDEVYLGQRDTPEWTSDAKALEAFKRFGTRLMEIEKRILDMNKDPALKNRNGPVKMPYMLLYPNTSDVDGEKGLGLTAMGIPNSVSI

SEQ ID NO: 22541 - protein, 307 aa, Zea mays
MSGAASVERVKDRATGLDKFVLREARGSSVEVYLYGGQVTFWKNNFGQQLLFVSNKATFKPRKAVRGGIQICFPQLGNHGVLEQHGFARNRFWSVDESPPPFPVATSNCHIDLILKSSPEDLKIWPHSYEFRLRVALTPRGDLILTSRIKNISSDSKPFQFTFAYHTYFSVSDISEVRVEGLETLDYLDNLQSRKRFTEQGDAVVFESEVDKVYLSAPPKVVVIDHEKKRTFVLRKEGLPDVVVWNPWDKKDEEYKSMLCVGAAAIEKPVTLKPGEEWIGKQEISAVPSSYSSGQLDPELIRRMHTI

SEQ ID NO: 22542 - protein, 254 aa, Oryza sativa (japonica cultivar-group)
MGRKFFVGGNWKCNGTTDQVDKIVKILNEGQIASTDVVEVVVSPPYVFLPVVKSQLRPEIQVAAQNCWVKKGGAFTGEVSAEMLVNLSIPWVILGHSERRSLLGESNEFVGDKVAYALSQGLKVIACVGETLEQRESGSTMDVVAAQTKAISERIKDWTNVVVAYEPVWAIGTGKVATPDQAQEVHDGLRKWLAANVSAEVAESTRIIYGGSVTGANCKELAAKPDVDGFLVGGASLKPEFHRHHQLRHREVRL

SEQ ID NO: 22543 - protein, 336 aa, Bacteroides fragilis YCH46
MKIGILTSGGDCPGINATIRGVCKTAINYYGMEVVGIHSGFQGLLTKEVESFTEKSLSGLLNLGGTMLGTSREKPFRKQGIISDVDKPALIQRNIAELGLDCVVCIGGNGTQKTAAKFAAMGINIVSVPKTIDNDIWGTDISFGFDSAVSIATDAIDRLHSTASSHKRVMVIEVMGHKAGWIALYSGMAGGGDVILVPEIPYNIKNIGDTILNRLKKGKPYSIVVVAEGIQTDGRKRAAEYIAQEIEYETGIETRETVLGYIQRGGSPTPFDRNLSTRMGGHATELIANGQFGRMIALKGDEISSVALEEVAGKLKLVTEEHDLVVQGRRMGICFG

SEQ ID NO: 22544 - protein, 533 aa, Chlamydomonas reinhardtii
  misc_feature (532)..(532): Xaa can be any naturally occurring amino acid
  unsure (1)..(533): unsure at all Xaa locations
MAAAGAPAEGASAYEYDLVVIGGGSGGLACAKEAAKLGKKVCLLDYVVPSPAGTSWGLGGTCVNVGCIPKKLMHNAGLLGEGFSDARGYGWKLPEKIEMNWEDLVMGVQNHIGSLNWGYRVALREASVKYLNAKGSFVDAHTVEAVERNGTKHTLTAERVVIAVGGRPKYLGVPGDKELCITSDDIFSRATPPGKTLVVGASYIALECAGFLRALGYEVAVMARSIFLRGFDQEIAELIGKDMERRGVRMIKPAVPTAFERDGEQIKCTFKNLDFGVEMSESFDTVLLAVGRDACTFDLGLEKVGVTYDKSSGKIPVTAEQTNVPSIYAIGDVLESRQVPGQGGRKLMGLTCSLAQTLSPPDPLAQELTPVAIKAGIRLARRLYAGATLQMDYDAVPTTVFTPLEYGCVGYSEEAATVKYGADNIEVYVSYLKPLEWTMNHEEHNGEPVRADNSVFVKLITNTADNERVVGAHYLGPNAGEIIQGVAVAVKANATKADFDDCIGIHPTVAEEFTILEVTKRSGKSALKKGCXG

SEQ ID NO: 22545 - protein, 516 aa, Prochlorococcus marinus str. NATL1A
MNMKYTITTPLYYVNDKPHLGSSYTTIACDAIARFERLNGNTVLFLTGVDEHGQKIERTAESKNLEPQLHCDEITEKYKYLWDKLNISYDRFVRTTSIEHTSLVHQFYSKVLKSDDVYMGRQSGWYCVGCEEYKDVEDKDKSPICSIHKKELEWRDEENLFFKLSKYQDQIEKLINVDGFISPKSRKNEIINFVSKGLRDFSISRVNLKWGIKVPGNKDHTFYVWFDALLGYVSGSLNDQCSPELTEKSLCNWPANRHVIGKDILRFHAVYWPAMLLSAGMKTPRSVFGHGFLTREGQKMGKSLGNVLDPIELLEYGGIDAMRWYLLRDIEFGEDGDFQMRRFVDIVNSDLCNTIGNLLNRTITMSKKWFKENIPIDNTASSDSTLKVQSETKIIEYMESFKDSNFKSSANAIIDLANSANLYLNDRAPWKLIKDISNKNVVALDIYSVLESCRIIGILLNPIVPNLSTRILKQLNIDTSNINFKDSLQWGLLDPNNRLQDPTPVMDKIEFKEDPK

SEQ ID NO: 22546 - protein, 334 aa, Deinococcus radiodurans R1
MTQPDMAYPNPAGIKRVAVLTSGGDAPGMNAAIRAVVRTGAQQGIEVVGVRRGFSGLHRGEVQLLGPRDVANTIQRGGTILLTARSHTWRSPEGRAKGAAVLREWGVDGLVVIGGDGSFHGGYFLQEEHGIPVIGVPGTIDNDLYGTDHTIGYFTAVETALEAVDKLRDTGASHERIFVIEVMGRHAGHIALDVAVAGGAEEVFIPEDKKPIGDVVNIVKDSIAKGKRGSIIIVAEGYDGGAEAVAQAIHAGTGLETRVSILGHIQRGGTPVSSDRILASRLGEAAVYALMDGKKGVMVGRIGGGIAYTPLHETWEKRKDVSRDLYRCAKMLSI

SEQ ID NO: 22547 - protein, 309 aa, Mesorhizobium loti MAFF303099
MASPPRLLSVGALTLDTILRVETLPTHQGKFIAADGVQIASGMATSAACAAHRLGAEVSLWASAGDDLIGEQLIAGIEAEGVDCSYVRRVSGARSALASILVDAHGERIIVPFYDSLAQADPETLPFADITAFDAVLVDVRWPDAAALALKAARAAGRPAILDADTASLAVLERLLPLASHIVASEPAVRIICGQALDLASACTDMASRTDAFVAVTGGAAGIWWFDRKAGSSRHVAAPRIKAVDTLAAGDVFHGAFAVGLAEAMPVEQALRFASAAAALKCLRFGGRLGAPDRAETLAMVTATWPETA

SEQ ID NO: 22548 - protein, 422 aa, Oryza sativa (japonica cultivar-group)
LFKKSIIFNFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLR

SEQ ID NO: 22549 - protein, 258 aa, Helianthus annuus
MANYGGDKQYARETRHTGDYESPIHSTGGQYEQEVLQTDEYGNPVRRTGQTDEYGNPVRRTDEYGNPVHSTTGGTMGDYGSTGLGQGTGTGGIGTGGYGTTGHHGLGTGVGHTTGGTGTDYTSGGRSTGQTGYQGLGTESEFGGKTGTFQNQPSATPVGGVGLSSGTGAGVGGTGTGTGILHRSGSSSSSSSEDDGQGGRRKKCDAKVKESLPGGHRQEDHYQSQTTTTTTGGGPGYGETHEKKGMMEKIKEKLPGHH

SEQ ID NO: 22550 - protein, 120 aa, Helianthus annuus
TNVHSTTEGYNVGGTGTTIGTGGYEEGKHGGAGGILHRSGSGSSSSSEDDGEGGRRKKKGLVEKIKEKLPGGDHGSDEHKTSATATTVGGGEYGYKEGEEGHEKKGLMDKIKEKLPGSHQ

SEQ ID NO: 22551 - protein, 584 aa, Astragalus sinicus
MCGILAVLGCADASRAKRVRVLELSRRLKHRGPDWSGLHQHGDCYLAHQRLAIVDPASGDQPLFNEDKSVIVTVNGEIYNHEDLRKQLPNHTFRTGSDCDVIAHLYEEYGEDFVDMLDGIFSFVLLDTRDNSYIVARDAIGVTSLYIGWGLDGSVWISSEMKGLNDDCEHFECFPPGHLYSSKNGGFRRWYNPLWYSEAIPSAPYDPIVLRQAFEKAVIKRLMTDVPFGVLLSGGLDSSLVASITSRYLATTKAAEQWGSKLHSFCVGLEGSPDLKAGKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALYQYDCLRANKSTFAWGLEARVPFLDKEFINVAMNIDPANKMINLDEGRIEKYILRKAFDDEEHPYLPKHILFRQKEQFSDGVGYSWIDGLKAHAAKHVTDKMMRNAANIYPHNTPSTKEGYYYRMIFERFFPQNSARLTVPGGPTVACSTAKAVEWDAAWSKNLDPSGRAALGVHASAYENQNNSVNKSIEFEKIIPLEASSVGVAIQT

SEQ ID NO: 22552 - protein, 199 aa, Kluyveromyces lactis NRRL Y-1140
MSEEEEFKQFDEENDTYKVGEKKTVEEYKNLDADDEALRKWKDSLGLGGDVLPLEHPGDERRVVIQKIQLIVDTEPAPITFDLTNEKTLKDLASKRYKIKEKSIYHLKITFKVQHEIITGLRYVQYTKKAGIAVDKIDDHLGSYAPNTTKNPFYEVELPESEAPSGFLVRGNYSAVSKFIDDDKNNHLTLNWGVEIVKR

SEQ ID NO: 22553 - protein, 80 aa, Medicago truncatula
MFNEIYIFYINIIQVSSGKDGSKKDVIMVDPIEAKRLVAKQMERIKEKEKLEKRHQIEATNGAWAMIGLTVGLAIEGQTG

SEQ ID NO: 22554 - protein, 143 aa, Medicago truncatula
MASSTILPLSNAQFPSFHHTHHSFPTTAKWGWRREQDASMASNRTQSQAFRVLANPNVSSGKDGSKKDVIMVDPVEAKRLAAKQMEIIKAKEKLKKRRQIEAINGAWAMIGLTAGLVIEGQTGKNIITQLQDYFGAIVHFFVK

SEQ ID NO: 22555 - protein, 242 aa, Mycoplasma mobile 163K
MRKKIIIGNWKMNKTKTEAENFVKEFNKITSELNLKLDKNLVAGLALPFTSLGIKKEGNFANLVIAAQNFHQNNSGAFTGEISAEMLLDLGVKMVVLGHSERREFFHETDEIVNMKMHQAIKNNLVPIVCVGETELQYNSNKSKEVIKNQIEKSLKNLSDFSKIIIAYEPIWAIGTGKTATVEYAQEMCKYIRSLTNEKTIIQYGGSVKPNNIKELLSQKDIDGALVGGASLNVKDFIDLIK

SEQ ID NO: 22556 - protein, 421 aa, Burkholderia xenovorans LB400
MTDAAAAKAQAAHAGLEAPRTIVVIGGGQAAGWVVKTLRKEGFDGRLVMIADEVHLPYERPPLSKAVLAGEADIETVRLVKPDDFEALNVEAWQPDCATSIDREQRIVRTQSGREVQYDRLVIATGGAARKLPASLVKTSHVAYLRTLDEAVALGERLRASKRVLVVGGGWIGLEVAATARKLGVEATVVEGAPRLCARSLPPMVSGFLLDLHRANGVDVRLNATLVSLEDHPNDANRIRATFADGSTLDADFAVAGIGLTPHTALAQAAGVKVEDGIVVDHFGATDDPRIFACGDVANHPSAWLKRRVRLESWANAQNQAIAAAKALLGIFEPYADIPWFWSDQYDVNLQILGDIPGDAQLAVRGDLPGKRATLFYLEDSAIRGVIAINTPRELKLSRKWMNQGRTIDLATLTDASTALA

SEQ ID NO: 22557 - protein, 499 aa, Burkholderia xenovorans LB400
MTDMTHFDTSLVPTGDIFIGGEWRQGRGNPYTSLYPADQSVNMEISTANADDARDAVEAADIAWRRADWSGLKPHQRALILYRIADLIMARHEALAQLQRRDNGKPIGETRVLVASAANTFRYFAACLETLDEEVTPSRGDYLTMSIYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAADKLMPVSLELGGKSPTIVFDDADLDHAVNGVLYGIFSSSGEACIAGSRLFVQRSIYDTFMKRLADGARKLRVGDPSRSETQMGPLITAAHRETVERYVALGLEEGGRLLCGGERPVGDGREAGTYFQPTILEGLTNNARICQEEIFGPVLVAMPFDDEASLLKEANNSVFGLAAGIWTRDYKRAYRIARALEAGTIWINTYKLFSISTPFSGWKESGMGREKGRLGIREYMQQKSLYWGLNDAPLAWAN

SEQ ID NO: 22558 - protein, 392 aa, Saprolegnia ferax
MSLKKIKNFSINFGPQHPAAHGVLRLILELNGEIVQKADPHIGLLHRGTEKLIEYKNYLQALPYFDRLDYVSMMSQEHAYVLAVEKLLNCNIPLRAKYIRVLFSEITRILNHLLAITCHALDVGAMTPFFWGFEEREKLMEFYERVSGARMHSSYFRPGGVHQDLPLGLLNDIFIFCNQFPTRLDEFEEMLTGNRIWKQRLVDIGIVKAKDALDLGFSGVMLRGSGISWDLRKTQPYEIYDKLDFSIPIGTNGDCYDRYLIRIEEMRQSINIILQTLNQMPEGPIKIDDKKISSPNRVQIKQSMESLIHHFKYYSENITVNSGETFTVIEAPKGEFGVFLVSDGTNKPYRCKIKAPGFAHLQALDFMCKDHMIADVVTIIGTQDIVFGEVDR

SEQ ID NO: 22559 - protein, 395 aa, Dechloromonas aromatica RCB
MQYGAFSTDSLMYITNRPDLVFERGEGSWLIDHQGKRYLDFIQGWAVNCLGHCPPEITEALVEQAGRLINPSPAFYNGPMVELAGLLTANSCFDRVFFANTGAEANEGAIKLARKWGRLHKGGAHEIITFEHSFHGRTLATMSASGKAGWDTLYAPQVSGFPKAAYNDIAAVEALIGPKTVAVMLEPVQGEGGVIPAGIEFLKALRELTRQRGILLIVDEVQTGVGRTGKLFAHEHADIEPDIMTLGKGIGGGVPLAALLAREAICCFEPGDQGGTYNGNPLMTAVGVAIMKRMLAPGFLAEIEARGQYLAKCLRELSAKHGLKGERGSGLLRALILDDERAPQIVQRALTMQPVGLLLNAPRPTLLRFMPALNVSETEIDQMIAMLDELLAKQD

SEQ ID NO: 22560 - protein, 521 aa, Candida maltosa
MAIEQIIEEVLPYLTKWYTIIFGAAVTYFLSIALRNKFYEYKLKCENPVYFQDAGLFGIPALIDIIKVRKAGQLADYTDTTFDKYPNLSSYMTVAGVLKIVFTVDPENIKAVLATQFNDFALGARHAHFDPLLGDGIFTLDGEGWKHSRAMLRPQFAREQIAHVKALEPHVQILAKQIKLNKGKTFDLQELFFRFTVDTATEFLFGESVHSLYDEKSGIPNDIPGRENVREAFNTSQHYLATRTYSQIFYWLTNPKEFRDCNAKVHKLAQYFVNTALNATEKEVEEKSKGGYVFLYELVKQTRDPKVLQDQLLNIMVAGRDTTAGLLSFAMFELARNPKIWNKLREEVEVNFGLGDEARVDEISFETLKKCEYLKAVLNETLRMYPSVPINFRTATRDTTLPRGGGKDGNSPIFVPKGSSVVYSVYKTHRLKQFYGEDAYEFRPERWFEPSTRKLGWAYLPFNGGPRICLGQQFALTEASYVIARLAQMFEHLESKDETYPPNKCIHLTMNHNEGVFISAK

SEQ ID NO: 22561 - protein, 311 aa, Bacteroides fragilis YCH46
MIHIACNIDSNFTIHCAVTLTSLFANNRNSEFCVHIIASTLPEADQKALSSIAESYGNKICFYFPEKDLLNNFSIKKSGNRISIATYYRCLLSRILPVNIDKILYIDCDIVVLNDISEFWDTDITQYAIGCIEDIGSDEEEYYSRLQYDKKYSYFNAGVLLINLKYWREHKIDEMCEQYFLAHSDRIRFNDQDLLNALLYKDKLFVPFRWNVQDTFYRRTYSHKVKEHSGLKEALLHPAILHYTNKKPWNYDSMHPLKQEYFKYLDMTPWKGTRPIIDFQTRVITGFKRLLYITGIKKSKYINLKDYELAQ

SEQ ID NO: 22562 - protein, 483 aa, Arabidopsis thaliana
MILFLCLIILFIITILFFKKHKTVNKIINFPSPPRLPLIGNLHQLSQHPHRSLCYLSHRYGPLMLLHFGSVPVIVASTAEAARDVLKTHDRVFASRPRSKIFEKLLYKSRNMASAPYGEYWRQMKSVSVLHLLSNKMVRSFQDVRQEEITLMMETIRKSSSKPVNLSKILSSLTNDVICRVALGRKYGVGTDFKELIDRLMRQLGTFTIGSYVPWLAWTDWVSGLEARLEKTANDFDKLLERIVQDHEDGDGDKTDFVDVLLAAQRDKSFGFDIDRLSIKAIVLDAFVGGTDTSSTLVEWEMTELLRHPTCLKKLQEEVRTICKGKSSVSEDDIQGMEYLKAVVKEALRLHPPVPLMVPHQSTQDVRLRDNHIPAGTQVIVNLWAVGREAATWGPDANEFRPERHLESPSDFRGQDFELIPFGAGRRMCPGISFAVVLNEVVLANLVHGFDWQSIDDETDVAESIGSVIRRMHPLYVIPSSTT

SEQ ID NO: 22563 - protein, 586 aa, Astragalus sinicus
MCGILAVLGCSDDSQAKRVRILELSRRLKHRGPDWSGLHQHGDNYLAHQRLAIVDPASGDQPLFNQEKSIIVTVNGEIYNHEELRKQLPNHKFRTDCDCDVIAHLYEEYGENFVDMLDGIFSFVVLDTRDNSFLVARDAIGVTSLYIGWGLDGSVWIASELKGLNDECEHFEVFPPGHLYSSKEREFRRWYNPKWFSETVPSSPYDPLVLRHAFEKAVIKRLMSDVPFGVLLSGGLDSSLVASVTARYLEDTKAAKQWGAKLHTFCVGLKGAPDLKAGREVADYLGTVHHEFEFTIQDGIDAIEDVIYHTETFDVTTIRASTPMFLMSRKIKSLGVKMVLSGEGSDEIFGGYLYFHKAPNKKEFHEETCRKIKALYKYDCLRANKSTYAWGLEARVPFLDKDFINVAMDIDPEEKMIKRDEGRIEKWVLRKAFDDENKPYLPRHILYRQKEQFSDGVGYGWIDGIKDHAAKHVTAKMMLNASHIFPDNTPTSKEGYYYRMIFERFFPQNSARLTVPGGASIACSTEKAIEWDASWSNNLDPSGRAALGVHVSAYENQVNSSVGKGVEPEKIIPKMKVSPLGVAILG

SEQ ID NO: 22564 - protein, 390 aa, Onion yellows phytoplasma OY-M
MNIKEKALEIHEKNKGKVGIVSKVKVQNLDDLALAYTPGVAEPCLKIKENPSDVYRYTMKGNMVGVVTNGTAVLGLGNIGPKASLPVMEGKAILFKELAGIDSFPICIDSTDSQEIVNIVSKISTVFGAINLEDIKSPQCIEVEDALEAKLDIPVFHDDQHGTAIVVAAGILNSLKVVKKSIEDVQVVINGAGSAGMAIAKMLLLLKVNNIVLVDKTGALYKGVANLNEPQKKLVEVTNKYQEKGTLKEVLKGKDIFVGVSAPGIVTAEMVSTMAKDAIVFALANPVPEIMPDEAKKGGARIVATGRSDFPNQVNNCLAFPGVFRGALDAKATKITEEMKKAAIYALKNIIKEQDLNENNILPTSFNKEVVKQIALAVCKVAKETGVVRK

SEQ ID NO: 22565 - protein, 254 aa, Pyrobaculum aerophilum str. IM2
MLSLVGLGPGRGYVTEAAAEAIKNADCVFYEDYTAPLDVEALRRLARGEPIRLTRADLEDHSGRKIFECLKEGKRAVLVTGGDPMLATAHAAILALARRRGYRVEVVPGVSIICAAFSLSCLSIYKLGGVATVTYPRGGVYSTRPYDLVEQNLQRGLHTLLLLDVREDGRFMPPREGAEVLLQLEERVGRGLFKEDLPIVVVYKVGWGGSAVYATLGEIARSDLEGPAVFIVPSRLGPVEKECLEGLSARSSTR

SEQ ID NO: 22566 - protein, 204 aa, Solanum tuberosum
MEMQSEFDRLLFFEHARKSAETTYAQNPLDADNLTRWGGALLELSQFQPVAESKQMISDATSKLEEALTVNPEKHDALWCLGNAHTSHVFLTPDMDEAKVYFEKATQCFQQAFDADPSNDLYRKSLEVTAKAPELHMEIHRHGPMQQTMAAEPSTSTSTKSSKKTKSSDLKYDIFGWVILAVGIVAWVGFAKSNMPPPPPPPPQ

SEQ ID NO: 22567 - protein, 987 aa, Ashbya gossypii ATCC 10895
MSVETAYGVAFRSLATTDERLYKATVQFYKRLSFATVKLYDKFKNHGDEMLLSGTSQSSRHETWLMSFKLSEVDSSGCRVPQQEAERKLQSDGAMIKVRLVNEVAAADCGALRVSYYSGSFAEAAAAFPDREEVSEHEFRIRDPLGNEIALTDTPHLHDAVLGEQAVGADFFLSGSGETHRLAQGRETAAALMRSLRETPGAPDSKPKKKLAVMTSGGDSPGMNAAVRAVVRAGIYYGCDVFAVYEGYEGLLKGGEYLKHMQWSDVRGWLSEGGTLIGTARCMEFRERKGRKQAAANLIEQGIDALVVCGGDGSLTGADLFRSEWPSLVEELVSDGRFTAQQVHPYRNLTIVGLVGSIDNDMSGTDSTIGAYSALERICEMVDYIDATAKSHSRAFVVEVMGRHCGWLALMAGIATAADYIFIPERAAPQNKWQDEMKEVCRRHKAKGRRNITVIVAEGALDTELNPITAEQVKTALVELGLDTRITTLGHVQRGGTAVAHDRWLATMQGVDAVKAVLEMTPDTPSPLIGILEEKIIRIPLMESVKLTKQVAAAIQEKDFDKAISLRDTEFIELYESFISTTIKDSTAVPESGPLRVAIVHVGAPSAALNAATRAASLYCLANGHKPFAIINGFSGLIQTGEVRELSWIDVEDWHNLGGSEIGTNRCAAADDMGAVAYHFQKNEFDGLIIIGGFEGFKSLQQLYSARSQYPVFNIPMVMIPSTVSNNVPGTEYSLGTDTCLNALVNYTDAIKQSASATRRRVFVVEVQGGHSGYVASFTGLVTGAVSVYTPEKKIDLHSIQEDLALLKENFRHDQGENRNGKLLIRNEQASSIYTTELIADIIAEQSNGRFGVRTAVPGHVQQGGVPSSKDRVAACRFAVKSVKFLESWNEKAKQAASHDDRQLGFRYVKGVKTPMLPNNDASAAVICVNGSTVSFKPVNDLWQNETDVELRKGHDIHWSEFTKVGDILSGRCNLRKEVDAMRAASA

SEQ ID NO: 22568 - protein, 789 aa, Hordeum vulgare subsp. vulgare
MKMMAMAEAPCLCARPFLAARAWRPGPAPRLRRWRPNATAGKGVGEVCAAAVEAATKAEEEEDEEEEPVAEDRYALGGACRVLAGMPAPLGATALAGGVNFAVYSGGATAAALCLFTPEDLKADRVSEEVPLDPLMNRTGDVWHVFLEGELHGMLYGYRFDGTFAPHCGHYFDVSNVVVDPYAKAVISREEYGVPAHGNNCWPQMAGMIPLPYSTFDWEGDLPLRYPQKDLVIYEMHLRGFTKHDSSNVEHPGTFIGAVSKLDYLKELGVNCIELMPCHEFNELEYATSSSKMNFWGYSTINFFSPMTRYTSGGIKNCGRDGINEFKTFVRESHKRGIEVILDVVFNHTAEGNENGPILSFRGVDNTTYYMLAPKGEFYNYSGCGNTFNCNHPVVRQFIVDCLRYWVMEMHIDGFRFDLASIMTRGSSLWDPINVYGAPIEGDMITTGTPLVTPPLIDMISNDPILGGVKLIAEAWDAGGLYQVGQFPHWNVWSEWNGKYRDIVRQFIKGTDGFAGGFAECLCGSPQLYQAGGRKPWHSINFVCAHDGFTLADLVTYNTKYNLPNGEDIRDGENHNLSWNCGEEGEFARSSVKRLRKRQMRNFFVCLMVSQGVPMFYMGDEYGHTKGGNNNTYCHDSYVNYFRWDKKEEHSDLHRFCCLMTKFRKECEGLGLEDFPTAEQLQWHGHQPGKPDWSEKSRFVAFSMKDETKGEIYVAFNTSHLAAVVELPERIGHRWEPVVDTGKPAPYDFLTDDLPDRALTVQQFSHFLNSNLYPMLSYTSVILVSRPDV

SEQ ID NO: 22569 - protein, 116 aa, Mycoplasma mobile 163K
MQNKLLDIVENDQLRNDLPEFKSGDNIKVLVRIKEGAKERIQAFEGLVIAIKNYSTHKTFTVRKISNSVGVERTFPLNSPVIVSIEVLRKNKVRRSKLYYMRDLKGKSARLKELKK

SEQ ID NO: 22570 - protein, 321 aa, Solibacter usitatus Ellin6076
MKLFLILAVSASLAAQTSEFVADPMPTPSCHASTIVELASGDLMTAWFGGAGEGRPDVAIWGARRHAGKWQPPVELAREPNIATWNPVLFHSGDGLLWLYYKFGPSPQQWTAARMWSRDDGVTWSKAEHLPAGLYGAIRAKPLVLPKGLIVSGSSVESYNSWAAWVERSTDFGKTWTRHGPIVPPEGGIIQPSVVQVEGDHLRFYARSDKAARICVSDSYDAGITWTPARVTELPNPNSGIDVVRLKDGRYLAVYNHIPRGRTPLNLAISNDGDHWTPLKTLESDPGEYSYPAMIQASDGLIHITYTWRRQKIKHVEVRVK

SEQ ID NO: 22571 - protein, 720 aa, Clostridium acetobutylicum ATCC 824
MVISNAFVTQFNKIEFQIDDFTNFLLSKITVRNTDGEIKINEYRLYKNNVCLLIDNIDIKKNYYVSYDKVTLKCSYYKLFSTTEFNNKYAYNGKLGITYTREKTTFRIWSPGASSIELLLYNHDITSNEPATSIKMKEDNGLWFLILKGDFKNFYYNYKVTIYNYTKEVVDPYAKAVGINGLRGAILDSYSTNPPNWKKDFVPQSIEHFTDAIIYEISINDISLNPNSGILHKGKYLGLCEENSKTINNIPTGIKYLKSLGITHVQIMPIFDFSYKSIDETNPINYNWGYDPQNYNVPEGAYSTDPYNPRSRIYELKTLIKTLHENGICVNMDVVFNHLWNEKENNFEKIFPEYYLRRNDDNSFSNGTGCGNDTASEHYMFQKFILDSIKYWVKEYHIDGFRFDLMGIHDIETMNKLRDELNKINSNIMLYGEGWDLTTNIEKTRKAIILNSSKTPEIGYFNDVIRDALKGSVFIPKDTGFISGKFNLEKTILYTTLGCCLDVKDYKKIFSSPSQSINYVSCHDNNTLYDKLCTSNPHDNDDIRKEKIKLAIGILLTSQGIPFLHCGVEFARTKFGITNSYNSAKEINWIDWDLRDKNKDLVNYVISLIAFRKNHSAFRFVYPNDLKNHLEITQNMPKNSIGYILKNHANNDAFKDIMVIYNANTHDIQIPLDSTWNVCIDKYNAGSEKIRTASKFYIAEALSINVLFKNSENSFLHLLL

SEQ ID NO: 22572 - protein, 454 aa, Vibrio vulnificus CMCP6
MTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYSEFCQKLVAKVSALKVGNGFDQGVHIGPLINDAAVAKVVQHVEDAQSKGAQIECGQLPTAGSRLVQPLVLSGVTDEMLVAQEETFGPMAPLFVFDSEEEVLARANNTDFGLAAYFYTQSLSRAWRMSEALEAGIVGINEGLISTTVAPFGGVKESGLGREGSFLGMDDYMESKYILMGL

SEQ ID NO: 22573 - protein, 425 aa, Alkaliphilus metalliredigenes QYMF
MSESTIKKTTVQVKESSNLFQLSKKVILALQHLIAMFGATVLVPMLTGFDPAVALIAAGAGTLLFHAVTKGKVPVFLGSSFAFIPVVITVRETYNGDLSYAQGGIIVAGIIYILMSLLIKKVGVKNITKFLPAQVVGPMIMVIGLSLVPVAIDMSSNHFAIALLTLGTALVINFTAKGFIRQLSILIAVVVGYVVSLQLGLVDTAVMREASLVAMPNFSTPKFEIGAIMVIAPIVLAVFMEHIGDITTNGEVVGQNFIEEPGLNRTLLGDGLATLFAGFIGGPANTTYGENTGVLAITKNYDPSILRLAAVFAIILGFVAKVGGFLSSIPVAVMGGISLMLFSMIAIVGVKTIKNSETALNGKNIIIIATILILGLGSDYIGGALNMTVGIPIPFAQGIAITGLSFAGLVGVLLNVVLNRNEQQA

SEQ ID NO: 22574 - protein, 320 aa, Oceanobacter sp. RED65
MTTTLEQLKRVTSVVADTGDIEAIKQYVPEDATTNPSLVYKAAQLPQYQSLIADAVDWAKQQSGDVLENTLDMVSVKIGKEILGVVPGFVSTEVDARLSFDTVATVEKARRLIALYEELGVSRDRILIKIASTWEGIQAAKVLEEEGIRCNLTLLFSFVQAIACAQANVTLISPFVGRILDWYKKAEGVDGYPDLEDPGVKSVTRIYRYYKQHNYSTIVMGASFRNTGEIKALAGCDKLTISPALLEELNGSTETLDVRLSNDQASDDAKWDELSEQAFRWEMNEDPMATEKLAEGIRNFAADLRKLEDLLNDQFLAKAS

SEQ ID NO: 22575 - protein, 323 aa, Acinetobacter sp. ADP1
MSNLTLAQYLQQKNGNLTPELAQVIETIANSCKKIDHAIQKGALADLLGSAGNENVQGETQKKLDVLSNDFLIDALKVHPHVGGLASEELDEFTPGQQDGKYLVLFDPLDGSSNIDINMCVGTIFSILPAKNSITQTQDFMQAGTEQVAAGYVLYGPSTMMALTCGEGVAFFTFDPESQTFILTSDAIQLDADTQEFAINASNQRHWEEPVKRYIDELLAGKTSVRGKDFNMRWVACMVADIHRILCRSGIFMYPYDLKDPSKAGRLRLMYEANPMSFLIEQAGGSATTGRVRIMDIQPNDLHQRVPVIIGSKNEVDLVTSYH

SEQ ID NO: 22576 - protein, 593 aa, Yarrowia lipolytica CLIB122
MPTISVDKEDLYKAIGKTYTTEEFDELCFEFGIELDEDTTNDCVGDERPQLKIEIPANRYDMLCIEGIAQALNVFLGRAEVPEIKLTKPSKMLELTIHPETAEVRPYAAAAILRNVTLDQRKYESFISLQEKLHSNICRGRQLVAIGTHDFDKMVQDGPYAYKAFKPNDPKMSFVPLNQTKELTGEGVMEFYEKDKNLGKFLYIIKDAPVYPYIVMGDDNTVCSLPPIINSDKTKVSPDTKNIFIEVTGTDKTRLEIVLSQIVAAFSEYCAEPFTVEPLKVVSEHNGETRITPEMTPRVMQAEIPYIKSCLGLDLSADDIIKLLAKMSLQASKTSNPDVLDVAIPPTRSDILHQCDIMEDAAIGYGFNSLPKTLPMKSATVGKPQLINKVSDIVRREVAMSGWAEVMPLTLCSHDENFAFLNRKDEGQAVHLANPKTQEYQVIRTSLLPGILKTIRENKKHSLPIKVFETGDVVFKDESLERKSYNQRNFGAVYSGKTSGFETVHGLLGRLMQMLRVSWIENPKESTSRGYWIEESHSETFFPGRGATIHLRTKDGAEAKVIGEMGILHPNVLAKFEIPYASSSIEFNIEPFM

SEQ ID NO: 22577 - protein, 203 aa, Yarrowia lipolytica CLIB122
MPAQPADLRRKLVIVGDGACGKTCLLIVFAKGTFPEVYVPTVFDNYVTDVEIDGRRVELALWDTAGQEDYDRLRPLSYPDSNVIIICFAIDSPDSLDNVQEKWISEVLHFCQGVPILLVGCKVDLRNDPKTIEELRRTSQRPVTTEEGNAVAQKIGALKYLECSARTHDGVREIFEHATRAALIGPKGREPTSGKKKKKCVIL

SEQ ID NO: 22578 - protein, 152 aa, Rhodopirellula baltica SH 1
MQRTLVLLKPDCVQRRLIGDVLSRFEAKGLHIVAMKLLQVTPELSKQHYAEHVEKPFYPSLEEFITSAPVVAIALEGLEVIRVVRDMLGATNGLQAAPGTLRGDYSSSRQMNLVHASDSEESAQRELDLYFNADEFCDYSLVLTPFMRADDE

SEQ ID NO: 22579 - protein, 264 aa, Zea mays
RTLGECARQSKARMRAGGEPECLVDFWMQDTLREMDEAAAAGRPPPAHTDDEEIGGFMFDFLFAAQDASTSSLCWAVSALDSHPEVLARVRAEVSAAWSPDSGEPMTAETIQGMRYTQAVARDVVRHRPPATLVPHIAGEAFQLTEWYTVPKGAIVFPSVYESSFQGFPDAEAFDPERFFSEARREDVAYRRNFLAFGAGPHQCVGQRYALNHLVLFMALFVSVVDFRRERTPGCDDPVYMPTIVPKDGCSVYLKQRCAKLPSF

SEQ ID NO: 22580 - protein, 521 aa, Oryza sativa (japonica cultivar-group)
MAAKRPAAGEGGGKAAAGAAAAKKRVALVNITNVAAAANNAVNRLNSLEGLLAPSKVQNKSFLGIREKFNSATWAAPVKKGSLASGRNVCTNRVSAVKSASAKPAPAISRHESAPQKESVIPPKVLSIVPTAAPAPVTVPCSSFVSPMHSGDSVSVDETMSMCDSMKSPDFEYIDNGDSSSVLGSLQRRANENLRISEDRDVEETKWNKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRCWNESNSNNSLIAYNRRFVRVAQVSDEDPALHLEFLANYVAELSLLEYNLLSYPPSLVAASAIFLAKFILQPTKHPWQNSTLAHYTQYKSSELSDCVKALHRLFSVGPGSNLPAIREKYTQHKYKFVAKKHCPPSVPSEFFRDATC

SEQ ID NO: 22581 - protein, 407 aa, Candida glabrata CBS 138
MGQLLSHPLTEKTIEYNDYKTKSSAAGSVPRFYNCVGSMQGYRLSQEDAHKVQNEDTILRVRFFNPFTGKHEKMMISMFAVFDGHGGDSCSKFLSGTSNPHLRAGLAKWVVYSFENHRYGAKKNISSVDNGGANNYTNTPNNSINGSNADNSTSYTRHFRTMEGLISQIIKDAYIKQDQELHQHFANSACGSTAVVALIINGTMLYVANCGDSRCILSSKARGIKTMSYDHKPQNIGELIRINDNGGTVSLGRVGGVLALSRAFSDFQFKRGVVYKNTNPMRISANGNHNSPTPPQEAQVSVEPDVLMHKLDFNKDEFLVLACDGIWDIYNNTRLIQFIKYHLMQGMKLDGIMTKLLDHGIAQANSSTGVGFDNMTAIVVVLNRPDESLHDWMNKMKLRLEREKGII

SEQ ID NO: 22582 - protein, 401 aa, Sodalis glossinidius
MTELPVRVVAAIAQARQQQDDPLAMFIYDLAALQQHIRQVMEALPDGAELYYAIKANSEPQILQTLAPWVDGFEISSGGEIERLQAAGSDKPFVFSGPGKLDSDLRAALRRQAAAIHVESLNEIDRLQRLAREQGRVQTVLIRINPQLPAQISSRLAMAGTATPFGIDEADLAVAVHRVDNADHLVLQGFHVHAMSHQQSEQRHRQLMEYYLQRWPQWKALSAQQEGITHLNVGGGIGVDYLSTSQFDWPGFCHWLGELLAVTAGAPRLRFEPGRFISAFCGYYAIEILDQKTSHGKHFLVCRGGTHQFRLPVAQGHDHPIIHLPQRSDGAGELCAWTVVGQLCTPKDVLSRDCSLKGVAIGDMLVLPLAGAYGYNISHADFLCHPRPCQLFLPLETASWA

SEQ ID NO: 22583 - protein, 567 aa, Coccidioides immitis RS
MGFSEKEISQEDSTSVQLPPFASKDEEVALEVEVAQDQPGFWTRMGCTPESFKKRTLADKHNQLNQTLKSRHLHMIAIGGSIGAGFFVGSGSALAKGGPASVVIDFAIIGVMIFNVVFALGELAVMYPVSGGFYIYSSRFIDPSWGFAMGWNYVLQWLIVLPLELTVASLTINFWKVDLSVAVWITVFLAAIIIVNIFGVLGFGEEEFWSSALKLSAVVIFMVIAVVLVCGGGPKDGIYSEYWGARLWYDPGAFRNGFRGFCSVFVTAAFAFFGTELVGLAAAESKNPLKSLPSAIKQVFWRIILFYILGLFFIGLLVRSDDDRLLGANPLIDTNASPFVIAAHDAGLVGFDSFMNVIILVSVFSIGNSAVFAGSRTLTAIAEQGYAPRIFSYVDRAGTLIAFGGLAYVNVTASGVEIFDWLLALSGLTALFTWGSICLAHIRFRAAWAHHGRTLDEIPFKAALGVWGSWVGLCLVCLVLIAQFYIAICPVSGGINDAKGFFKSYLALPVVLFCWACGYAWKRKGWLKLDEIDIDSGRREIDWEVYNQVLEKRKNSSFMKRLYYRLF

SEQ ID NO: 22584 - protein, 1125 aa, Aspergillus nidulans FGSC A4
MASVLIRRKFGTEGGSDAEPSWLKRQVTGCLQSISRRACIHPIHTIVVIALLASTTYVGLLEGSLFDSFRNSNNVAGHVDVDSLLLGNRSLRLGEGTSWKWQVEDSLNQDDQKVGNPELKREVDQHLALTTLIFPDSISKSASTAPAADAIPVPANASAQLLPHTPNLFSPFSHDSSLVFTLPFDQVPQFLRAVQELPDPTLEDDEGEQKRWIMRATRGPVSGPNGTISSWLSDAWSSFVDLIKHAETIDIIIMTLGYLAMYLSFASLFFSMKQLGSKFWLATTVLFSGMFAFLFGLLVTTKFGVPINILLLSEGLPFLVTTIGFEKPIILTRAVLSASIDKKRQGSATSTPSSIQDSIQTAIREQGFEIIRDYCIEISILIAGAASGVQGGLRQFCFLAAWILFFDCLLLFTFYTTILCIKLEITRIRRHVTLRKALEEDGITQSVAEKVASSNDWFGAGSDNSDADDASVFGRKIKSNNVRRFKFLMVGGFVLVNVVNMTAIPFRNSSLSPLCNVFSPTPIDPFKVAENGLDAIYVSAKSQKLETLVTVVPPIKYKLEYPSVHYAKLGESQSIEIEYTDQLLDAVGGHVLNGVLKSIEDPVISKWIIAVLTLSIVLNGYLFNAARWSIKEPQAAPAPKEPAKPKVYPKIDLNAGPKRSMEECEAMLKAKKAAYLSDEELIELSLSGKLPGYALEKSLENEELMSRVDAFTRAVKIRRAVVSRTPATSAVTSSLETSKLPYKDYNYALVHGACCENVIGTLPLPLGVAGPLVIDGQSYFIPMATTEGVLVASASRGAKAINAGGGAVTVLTGDGMTRGPCVGFPTLARAAAAKVWLDSEEGKSVMTAAFNSTSRFARLQHLKTALAGTYLYIRFKTTTGDAMGMNMISKGVEKALHVMATECGFDDMATISVSGNFCTDKKAAALNWIDGRGKSVVAEAIIPGDVVRNVLKSDVDALVELNTSKNLIGSAMAGSLGGFNAHASNIVTAIFLATGQDPAQNVESSSCITTMKNTNGNLQIAVSMPSIEVGTIGGGTILEAQGAMLDLLGVRGSHPTNPGDNARQLARIVAAAVLAGELSLCSALAAGHLVRAHMAHNRSAAPTRSATPVSAAVGATRGLSMTSSR

SEQ ID NO: 22585 - protein, 289 aa, Brassica napus
MAVSIDVLRTVFGILGNIISFLVCLAPIPTFIRIYKRKSSEGYQSIPYVIALFSAMLWIYYAMIKTNVVIMITINAVSLVIQIFYISFYLFYAPKKEKTLTVKFVLFVDVFAFGFIFFLTYFLLHGQKRVQILGYICMVFSLCVFVAPLGIIRKVIKTRSAEFMPFGLSFFLTLSAVMWFFYGLLLKDMNIALPNVWGFIFGVLQMILYMIYKKPGTKVLEPPVINLQEISDHVVDVVRLSSMVCSSQMRTLVPQDSADMEDTITIDEKIKGDIEKMKESKEMLLISKN

SEQ ID NO: 22586 - protein, 405 aa, Idiomarina loihiensis L2TR
MTDNKTVNREMFNDVMVPNYNPASMIPVKGEGARVWDQEGREYVDFAGGIAVNCLGHCHPAMVSALQEQSQKLWHLSNVFTNEPAIRLAKKLTEATFADRVYYANSGAEANEAALKLARRWAIEKHGEHKQQIIAFTKGFHGRTFFTVTVGGQPAYSDGFGPKPGAIEHVDYNNIDALKELISDKTCAVMMEPLQGEGGVVSPDVEFVKAVRELCNENDALLIFDEVQTGFGRTGSLYAYEQLGVTPDILTSAKALGGGFPIGAMLTTTEIAEHLKPGTHGSTYGGNPLACAVSEAVFDVVNTKETLDGVKQREQWFKEQLAAINEKYNVFSEIRGQGLLLGAAMNKEYEGRARDFLLAGQEHGVMVLIAGANVVRFTPSLVISEEDIKEGLQRFEKAVAQVVGQ

SEQ ID NO: 22587 - protein, 458 aa, Sodalis glossinidius
MYRKELLLVCQPCEKNLDYLTRQARFESNVRSYPRKLPLAIARAQGCWVTDVEGKRYLDCLAGAGTLALGHNHEAVVGAIQQFLASGLPMHTLDLTTPLKDAFSERVLSLLPAEGQDYCLQFCGPSGADAVEAALKLAKTVTGRSNVISFSGGYHGMTHGALSVTGNIGPKEALHGLMSGVQFFPYPHQYRCPLGIGGQRGEQALSHYFSQFIEDVESGVARPAAVILEAIQGEGGVNPAPVEWLRQVRTVTEKHGILLIVDEVQCGFARTGDMFAYQYAGIEPDIVVMSKAVGGGLPMALLGIKRGFDAWQPGAHTGTFRGNQMAMATGMATLNMLVGENIAAQAAQRGAWLQQQLNALRQRYPALGQVRGRGLMLGIEIVDERQPADALGSYPMDAPLAVAIQQHCFQQGLLLERGGRHGNVVRLLPPLTINEQECQSVIDRFTLALNGALVTSRC

SEQ ID NO: 22588 - protein, 297 aa, Elaeis guineensis
MAVPVINLRELDGDRRTETKSLLHEACEKWGFFWVENHGIKEALMEKVKGLVNSHYEEYLKQSFYESELAMGLGPQTQSSEADWESTYFIQHQPESNNIHDIPGHEIEFCEAMEDYIRQLIKLAETLAELMSENLGLDKCYLKEAFSPAFVGTKVAKYPQCPQPKLLMGLRARTDGGGIILLLQDDMVPGLEFFKHGKWVPITPKKDNRIFVNLGDQVEVMSNGLYKSILHRVAADKDGSRLSIATFYNPGADAIISPAPKLLYPGGYRFKDYLDYYTGTKFSDKGARFQTIKDMFK

SEQ ID NO: 22589 - protein, 447 aa, Oceanobacter sp. RED65
MYQYDLFVIGAGSAGVRASRMAANLGKKVAVAESNYYGGTCVNVGCVPKKLFVYASEYPHFVEEAKGFGVNLELKGFDWATLRDNKTKEIERLNGIYEKLLDNAGVERIWGHAKLIDAHTVEVAGQQFSAEKILLATGGWPILPDIPGKEHCIDSNAFFYLENFPKSAVVFGSGYIAVEFAGIISNLGCDTSIASRSGKLLRGFDETTRQHAETEILKGPIKLLPHQPSAIEKVGEQYRVTLQGGEELIVDAVISAIGRTPNTSNLGIDDLQIETDEKGCIAVDDHFKTSVDSIYALGDLIDTPQLTPVALAEAMCFLRQQYQNDPTPMDYSSIPTAVFSQPNLATVGLSEEEAIDQGFVVSIFESEFRALKHTLSGLNHRSYMKLVVDKETDRVLGAHMVGEHAGEILQGFAVAVKAGLTKAQFDSTIGIHPTSAEEFVTMRTASR

SEQ ID NO: 22590 - protein, 506 aa, Oryza sativa (indica cultivar-group)
MEREAWLLCAALAAAMVYYYYYYYLACTTRRAQRRLPPGPTPLPVIGNVLSLSGDMHHELARLAREQYGPVMTLKLGLFTAVVVSSPDAAREAFTKHDRRLAARTVPDISRARGLTGRSMIWLPSSDPRWKTLRSAVATHFFSPRSLAAARGVRERKVRDIVNYFAGHAAEVIDVGEAVYGGVINIVSNAFFSADVVDVGKESAHGLRETLEDIILAIAKPNVSDLFPFLRRLDLQGWRRWAEKRYDKVFGILDDKINSRLADADADASTKKHGDFLDSLLELMSAGKIACDDVTTVMFDAFGAGTDTISNTVVWAMAELLRNPSIMAKVRAEMEDVLAGKKTIEENDTEKLPYLRAVIKEAMRLHPVAPILLPHRAAEDGVEIGGYAVPKGSTVIFNVWTIMRDPAAWERPEEFMPERFLQRAEVDFRGKDFEFIPFGAGRRLCPGLPMTERVVPFILASLLHAFEWRLPVGVAAETLDLSEKFTTVNVLVTPLKAIPILASHQI

SEQ ID NO: 22591 - protein, 664 aa, Oryza sativa
  misc_feature (12)..(12): Xaa can be any naturally occurring amino acid
  unsure (1)..(664): unsure at all Xaa locations
MDVKRARSPRAXPGVDADDDNKRAAEWRGAVRPHMVLVGFLITLPVLVFVFGGRWGSFQTTSAPNVGGRHVVPGGVTTTQISSSSVMWRARDDGVVLMPSPLVHPFADLVLPYHCFFQRRSSWLFTRVVPGFTGVADKLKHLGRPHALVKVGGPRWIISAVHVASNNAENEAPKNVSVPATATKSLPQPQDKLLGGLLSAAFEESSCQSRYKSSLYRKKSPFPLSPYLVQKLRKYEAYHKKCGPGTKRYRKAIEQLKAGRNADNAECKYVVWFPCNGLGNRMLTIASTFLYALISNRVLLMHVAAEQEGLFCEPFPGSSWVLPGDFPHNNPQGLHIGAPESYVNMLKNNVVRNDDPGSVSASSLPPYVYLHVEQFRLKLSDNIFCDEDQLILNKFNWMILKSDSYFAPALFMTPMYEKELEKMFPQKESVFHHLGRYLFHPTNKVWGIVSRYYEAYLARVDEKIGFQIRIFPEKPIKFENMYDQLTRCIREQRLLPELGTAEPANTTAEAGKVKAVLIASLYSGYYEKIRGMYYENPTKTGEIVAVYQPSHEEQQQYTSNEHNQKALAEIYLLSYCDKIAMSAWSTFGYVAYSFAGVKPWILLRPDWDKERSEVACVRSTSVEPCLHSPPILSCRAKKEVDAATVKPYVRHCEDVGFGLKLFDS

SEQ ID NO: 22592 - protein, 552 aa, Oryza sativa
MSGPMQRSSQPQFISSVERNNQSNGPGTPLIDSIDVDQIVIPEKNSWKNLFSYIGPGFLVSIAYIDPGNFETDLQAGAQYKYELLWIILIASCAALIIQSLAARLGVVTGKPPGPSIAEVEYPKATNFILWILAELAVVACDIPEVIGTAFALNMLFKSLCGVVILITGLSTLMLLLLQQYGVRKLEFLIAILVSLIATCFLVELGYSKPNSSVVVRGLFVPELKGNGATGLAISLLGAMVMPHNLFLHSALVLSRKEKRSVHGIKEACRFYMIESAFLALTIAFLINISIISVSGAVCGSDNLSPEDQMNCSDLDLNKASFLLKNVLGNWSSKLFAVALLASGQSSTITGTYAGQYVMQGFLDLRMTPWIRNLLTRSLAILPSLIVSIIGGSSAAGQLIIIASMILSFELPFALVPLLKFTSSRTKMGQHTNSKAISVITWGIGSFIVVINTYFLITSFVKLLLHNGLSTVSQVFSGIFGFLGMLIYMAAILYLVFRKNRKATLPLLEGDSTVRIVGRDTATEGEGSLGHLPREDISSMQLPQQRTASDLD

SEQ ID NO: 22593 - protein, 405 aa, Burkholderia xenovorans LB400
MSADRHVIVGAGHAARRAAETLRERDPHARITMIGAEPHAPYDRPVLSKDALLAPGGEQKAFIRGLDWYAAHDIELRLATTVESIDRARHEVGLHDGSSIGYDRLLLATGSRVREFAGPVDERVPLYYVRTLADSLALRTALAPGRQVAILGGGFIGLEVAAAVTQAGCEATVIEPAAALLQRSLPPAAARFVAALHARRGVTLRLAETPSRIGYEHGRALLETDRGTLAADLVVVGIGVLPNVELAREAGLQVDNGIVVDAQCRTSDPRIFAAGEVTAHFNPLLGRHVRIESWQVAENQPAIAAANMLGDTQEYAEWPWLWSDQFDCNIQTLGTIEASHTLIERGDARNGPFCVLALDAGRRLRAVVAINAGREMGACKRLVVAGKVLDPALLADPAVALRSLL

SEQ ID NO: 22594 - protein, 496 aa, Triticum aestivum
MARKMLKDGEAPLVADDGGTYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDADTDKVLGAAMCGPDAAEIMQGIAVALKAGATKATFDSTVGIHPSAAEEFVTMRTLTRRVSPPSKPKTNL

SEQ ID NO: 22595 - protein, 735 aa, Arabidopsis thaliana
MELLLPHPSNSTPLTVLGFLDRAASVYGDCPSILHTANTVHTWSETHNRCLRIASALTSSSIGIKQGQVVSVVGPNVPSVYELQFAVPMSGAILNNINPRLDAHALSVLLRHSESRLVFVDHRSISLVLEAVSLFTQHEKPHLVLLDDDQENDSSSASDFLDTYEEIMERGNSRFKWIRPQTEWQPMVLNYTSGTTSSPKGVVLSHRAIFMLTVSSLLDWSVPNRPVYLWTLPMFHANGWGYTWGTAAVGATNICTRRVDAPTIYNLIDKHNVTHMCAAPMVLNMLINYPLSTPLKNPVQVMTSGAPPPATIISRAESLGFNVSHSYGLTETSGPVVSCAWKPKWDHLDPLERARLKSRQGVRTLGFTEVDVRDRKTGKSVKHDGVSVGEIVFRGSSVMLGYYKDPQGTAACMREDGWFYSGDIGVIHKDGYLEIKDRSKDVIICGGENISSAEIETVLYTNPVVKEAAVVAKPDKMWGETPCAFVSLKCDNNGDGSVPVTEREIREFYYALSDKLNRVYVRKKKALSSDDLNGTKVLEATEGTGGEEVIEAANEWVLVPEKVLDTRYSAEGVLEALVQWQGLPTHETSWEVLTELRQQFPAIELGDKLSSEGGGGKKKALSSDDLNGTKVLEATEGTGGEEVLEAASESGGLEAAQKRVNIDEHGRKSGGGGGDTGWRVAVGAETRECVPKKEDAGEVNDYEDSLFISISFKVQANSGASEEQARAVYAPVAFQ

SEQ ID NO: 22596 - protein, 610 aa, Zea mays
MAQLVETYACSPATERGRGILLAGDPKTDTIAYCTGRSVIIRRLDAPLDAWAYPDHAYPTTVARFSPNGEWVASADASGCVRVWGRYGDRALKAEFRPLSGRVDDLRWSPDGLRIVVSGDGKGKSFVRAFVWDSGSTVGEFDGHSKRVLSCDFKPTRPFRIVTCGEDFLANFYEGPPFKFKHSIRDHSNFVNCIRYAPDGSKFITVSSDKKGLIYDGKTGEKIGELSTEGNHTGSIYAVSWSPDSKQVLTVSADKSAKVWDIMEDASGKLNRTLSCPGIGGVDDMLVGCLWQNDHLVTVSLGGTFNVFSASNPDQEPVTFAGHLKTVSSLVFFPQSSPRTILSTSYDGVIMRWIQGVGFGGRLVRRNNTQIKCFAAVEEELVTSGYDNKVFRIPLNGNQCGDAESVDIGGQPNALNLAIQKPEFALITTDSGIVLLHNSKVISTTKVNYAITSSSVSPDGTEAVVGAQDGKLRIYSISGDTLTEEALLEKHWGAITSIHYSPDVSMFASADTNREAVVWDRASREVKLKNMLYHTARINSLAWSPDSRLVATGSLDTCAIVYEIDKPVASRVTIKGAHLGGVHGLTFLDNDILVTAGEDACIRVWKVVQQ

SEQ ID NO: 22597 - protein, 1024 aa, Deinococcus radiodurans R1
MPKRTDLQTILILGSGPIQIGQAAEFDYSGTQALKALKNEGYRVILVNSNPATIMTDPELADATYLEPLTPEFVEKIIEKEKPDAILPTLGGQTALNLAMELHERGSLEKYGVELIGAGVEAIKKGEDRELFQAAMKKIGVETARGKMVHSMEEAVEYQKEIGLPIVIRPSFTLGGTGGGIAHTYEEFLAITEGGLRDSPVTSVLLEESILGWKEYELEVMRDTADTVIIITSIENFDPMGVHTGDSITVAPAQTLSDVEYQRLRDQSLAIIREIGVATGGSNIQFAVNPDNGRVIVIEMNPRVSRSSALASKATGFPIAKIAALLAVGYHLDELPNDITRVTPASFEPSIDYVVTKIPRFAFEKFPGTPDGLGTQMRSVGEVMAIGRTFKESLQKALRSTEGDIRGVYAEMDEAGLRALLYPNPRRIEAVIELLRRGESVESLFDATKIDRWFLSQLKEIMDAEKEILDLGPIAEWKYELWREVKRLGFSDARIGEIVGLSELEVRDLRKKAKATPVYKTVDTCAAEFEAHTPYHYSTYEWEDEVAPTDKPKVVILGSGPNRIGQGVEFDYATVHAVWALQEAGYETIMVNSNPETVSTDYDTADRLYFEPLTFEDVMNIVEHEKPVGVIVQLGGQTPLKLAKKLADAGAPIIGTSPETIHEAEDRASFNALCERLGLPQPRGKVAQTPAQARELAAELGFPLMARPSYVLGGRAMRTVRSMDELTTYLDEVYAAVEGQPSILLDQFLEGALELDVDTLCDGERAVVAGIMEHVEAAGVHSGDSACILPPVTLDAGVLERVKADTERLALELGVRGLMNVQWAVKDGTAYILEANPRASRTVPFVSKAVNHPLAKSAARIAAGQTLEQIGLLETPTPRMYSVKEVHLPFLKFKDVLPVLGPEMKSTGESMGIDSDPYLAFYRAQLGAKNYLPLEGTALLIGDGLDEVAGTLEGAGLKVIREQDGDELPDLLIDVTGSPLLRTALERGVPIVSTKEGAEWTARAVAEAKKAGMLGVRSLQEWVK

SEQ ID NO: 22598 - protein, 142 aa, Oryza sativa
MAAAEEKKKKKMIKVMSSDGETFEMTEAAASMTAAPTAAPASLSKIIEYCTKHAAVEGRSTAAAELKRFDEELIDVDTDTLYHLLMAGNLMGVEGVLELAVQRTAELIRGKSPEEIRDTFKIANDFTPEEEEIIKENAWALQ

SEQ ID NO: 22599 - protein, 154 aa, Oryza sativa (japonica cultivar-group)
MHGDEDILYDFSNSTSNSTSAAATKPTALSTAVSSPGYFFGRVVVFNDPMTEGRALPPSLEETAVRAQGLYLLDKKDDFSAWFAFSIVFNSTARRGTLNLMGADPNAATRDISVVGGTGDFLMSRGVATLRTDAIEGFKYFRVQMDIKLYECYV

SEQ ID NO: 22600 - protein, 381 aa, Deinococcus radiodurans R1
MHPRARHAQTSIFTHMSLLAARHGAVNLGQGFPSNPPPAFLLDAARRAVGTVDQYTPPLGLPALREALGADLNVDPADVIVTSGATEGLLTLALSLLVPTRDGQPAELVVFEPVYDVYVPQAELAGARAVPVPLHLDPEEGWSLDLAAVRAAITPRTQALLVNTPHNPTGLVFSWAELTELVALAREHDLWLISDEVYDELYASERPTSLRELAPERTFTVGSAGKRLEVTGWRVGWILCPPGLGGGLSLAGGLANVRQVTSFCSPAPLQAAVAEALPLARSQGYYAALRADYAARRALLSSGLRSLGAQVHEPQGTYFLTAQHPTWTAEGLVESGAVAVIPGEAFYVTSPPPAGLLRFAFCKSRAELEQALERLARLSNF

SEQ ID NO: 22601 - protein, 525 aa, Magnaporthe grisea 70-15
MDRHTSQASPTLDQIARYILANPGSPPGIIILAGAGISTSAGIPDFRSPKTGLYDNLARFSLDSPTDVFDINFFRTNPQPFYSLAPELYPGRYAPTISHAFVALLARKGLLAMLFTQNIDGLEKAAGVPPDLVVEAHGSFDSQRCIDCAQEFPAADMRAHVATSSVPHCGKCGGLVKPDIVFFGEQLPDRFFRAREAHLPDLEGAPIPEILGGARQVVIVMGTSLSVPPFCELPVRAADGVPRLLFNREVVGDFGERAQDVVELGDCDSGVRKLAEMLGWGEELEVEWRRVVGNEEAERQLVRAAAAAAPHPILEMDDGLSEDSSDTSDSASDKDDLMSDDGGNTDHEVNDFSSSSFGAVATPLTLDSVYYNPHQDQMVHISSSLPSVSLAADLACLVPPVEGDFVGSFDHHNFLIDPIDTRQGQSTGYLDHSHAMLDLVPLPHGHGESGSVDDERGNQNLEDGVRNHDIDGPNDTNEGAKTTRTFQLTDSRVQTEGNVSPDPISMFTWHDDPGFWREWPGPADS

SEQ ID NO: 22602 - protein, 343 aa, Photobacterium profundum
MKIKALSKLKPEEGIWMNEVDKPEMGHNDLLIRIKKTAICGTDVHIYNWDEWSQKTIPVPMVVGHEYVGEVVGIGQEVRGFTIGDRVSGEGHITCGHCRNCRGGRTHLCRNTTGVGVNRDGAFAEFLVIPAFNAFKIPAGISDDLASIFDPFGNAVHTALSFDLVGEDVLITGAGPIGIMAAAVAKHVGARHVVITDVNEYRLDLARKMGVTRAVNVANEKLEDVMSELGMTEGFDVGLEMSGVPSAFNGMLASMNHGGKVALLGIPPSDMAVDWTQVIFKGLVIKGIYGREMFETWYKMASLIQSGLDLTPIITHHYKIDDFQKGFDMMRSGMSGKVILDWE

SEQ ID NO: 22603 - protein, 221 aa, Brassica napus
  misc_feature (216)..(216): Xaa can be any naturally occurring amino acid
  unsure (1)..(221): unsure at all Xaa locations
MISSVKPTPSSFSATSTGARRSIPTKLQFSPLRITRSCHNQSFINSNVSHQKPLHISSAQNLSSFKREVRVEAYEADRSRPLDINIELPDEQSAQKLKIGIYFATWWALNVVFNIYNKKVLNAFPYPWLTSTLSLACGSLMMLVSWASRIAEAPKTDLDFWKTLFPGAVAHTIGHVAATASMSKVAVSFTHIIKSGEPAFSVLVSRFFLGETFPLXPVYLS

SEQ ID NO: 22604 - protein, 463 aa, Oryza sativa (indica cultivar-group)
MESEVCWLLCAALAAAMACYYLTGTMRRRSRRLPPGPTPLPVIGNVLSLRGNMHHALERLAGEHGPVMALKLGLVTAVVVSSAGAAREAFTKHDRRLAARAVPDTTRARGFASRSMIWLPSSDPRWKTLRGVAATHVFSPRSLAAARGVRERKVRDIVGHLAGHAGEVVDVGKVVYGGVLNLRRLDLQGWRRWAEKRYDKVFGIFDSVINSRLADASTGKHADAGAGDFLDSLLDLMSAGTIARDDVTSIMYDLFGAGTDTIAITVEWAMAELLRNPSVMAKARAEMNHVLAGKVKATEMEENDVEKLPYLQAVVKEVMRLHPAAPILVPHRAEEDDAEIGGYAVPKGSTVIFNVWAIMRDPVAWERPEEFMPERFLDMAEEVDFRGKDHKFMPFGTGRRLCPGLSMAKRVVPFILASLLHAFEWRLPAGVTAEALDLSEKFTTVNVLVTPIKAIPILASDQI

SEQ ID NO: 22605 - protein, 511 aa, Mycoplasma mobile 163K
MKKTLDQISLKNKKVIIRVDFNVPIVNGIVTSNKRIEAVIPTIKKVVNEGGKAILMSHLGRVKSEEDLKKKSLAPVVEILVNLLGMPITFVPATNGTELEETINSMKSGEIVMMENTRFEDLNNDAESSNNPDLGMYWASLGDVFINDAFGTVHRKHASNVGISTYIAESGIGYLVEKEIKNLDKALSRPERPIVAILGGAKVSDKIGVLNNLLKYVDKIIIGGAMAYTFLAAQGIGIGKSLVEEDKIDLAREYLKNNLDKFVLPIDYALAKDFEDVKPFYNLENTLEIPNGYMGLDIGPKSIEVFKKYIKDAKTILWNGPLGVTEFKYFKEGTKAIAKAITELKGNVYTVVGGGDSVAIIEELGLDRRFSHVSTGGGATLEFLEGKELPGIQAIQNEGELGRTKEEIFSILTQNSEEVLHEHTAAFSTSEVEPANEEFPSEYNDSNSQTYFSNEVENDEDFLLNTNDFPTREASFPNEVKTEEIILNENDDEFDIEDEELDSLPNDDIKF

SEQ ID NO: 22606 - protein, 442 aa, Oryza sativa (indica cultivar-group)
MTLKLGLVTAVVVSSPGAAREAFTRHDRRLAARTVPDISRARGLAGRSMIWLPSSDPRWKTLRGVVAAHVFSPRSLAAARGVRERKVRDIVGYFAVHPGEAVDVGEAVYGGVINLVSNAFFSADVVNVGKESAHGLRKTVEDMISAIAKPNVSDLFPFLRPLDLQGWRRWAEKRIDEIYGILDNKINSRLADTDADADASTKKHGDFLDSLLELMSAGKIARDDVTNIMFEVFGAGTDTISITVEWAMAELLRNPSIMAKVRAEMDDVLAGKKTIEENDTEKLPYLRAVIKEAMRLHPVAPILLPHHTAEDGVEISGYAVPKGSTVIFNVWAIMRDPTAWERPDEFMPERFLQRAEVDFRGKDFEFMPFGAGRRLCPGLPMAERVVPFILASLLHAFEWRLPDGMSAEELDVSEKFTTANVLTVPLKAVPILASSASELQAS

SEQ ID NO: 22607 - protein, 450 aa, Idiomarina loihiensis L2TR
MSRHYDYLAIGAGSGGIASANRAAIRGAKAAVIEAKHVGGTCVNVGCVPKKVMWYGAHIAEAIKYSPSYGFELEQKGFDWATMVKNREAYIERIHGGYHRGFQGNGVEFIEGFAKFVDHKTVEVNGEKITADHITIATGGRPMIPEIPGAEHGIDSDGFFALTEQPKKAAVIGAGYIAVEIAGVFHALGTDTHLMVRRDRPLRTFDKDITDGLLERMKQDGPELHTETTVREVVKQDDGTLTLHFEGGQTMDGFDCLVWAIGRVPSTDKINLECTGVELDSEGFINVDKFQNTNVQGIYAVGDNTGAAALTPVAIKAGRLLAERLFNNMPNAHMDFENIPTVVFSHPTIGTVGLSEEDAKLKFGEDNITVYKSSFAAMYNAITPHRALSYFKLVCHGKEEKVVGIHGIGEGMDEILQGFAVALKMGATKADLDSTVALHPTSAEEFVTLK

SEQ ID NO: 22608 - protein, 331 aa, Saccharomycetales
VRVAIDGFGRIGRLVMRIALSRPBVZVVASBBPFIBLDYAAYMFKYDSTHGRYAGEVSHDDKHIIVDGKKIATYQERDPANLPWSSGDSVIAIDSTGVFKELDTAQKHIDAGAKKVVITAPSSTAPMFVMGVDSEKYTSDLKIVSNASCTTNCLAPLAKVINDAFGIEEGLMTTVHSLTATQKTVDGPSHKDWRGGRTASGNIIPSSTGAAKAVGKVLPELQGKLTGMAFRVPTVBVSVVBLTVKLDKETTYDEIKKVVKAAAEGKLKGVLGYTZBAVVSSBFLGSBHSSIFBASAGIZLSPKFVKLVSWYBBZYGYSTRVVDLVEHIAKA

SEQ ID NO: 22609 - protein, 509 aa, Pseudomonas fluorescens PfO-1
MTLHRVARFADVPEDRGLEVKIGDCKIVLLRVAGQLRAFQGQCPHAGAPLAEGALCHGRLICPWHKAAFRAEDGALCEPPALDSLKRYPLELRGDEVWVDDQPLPDPHTPPQDDPRTFVIVGAGAGGTACAAALREKGFGGRIVLIDREPDAGYDRTVLSKFVLSGEMPAAETPPLRDEDFYREQHINRVSGEVSGLDADTKTLHLSDGRTLNYSAAVLATGATPNALELPGVDLPQVFVLRSKAQAQYIMDAAQSGQRAVIIGDSFIALECASALRQHGLEVTVLARHAIPFAVQFGEAVGKAIRALHEENGVKFITDHEAREITGDGKVEAVLLDNGLRLSADLVLAGIGVHPATEAFGDLPREDDQSLLVDASLRVTESLWAIGDIATFPLNGKPQRIEHWRLAQQHARIAAANLLGGEEHYLDVPYFWTWHFGRNYDYLGHAEGWDAVEFIGKPEQPPFIGLFGSKGVVVAAVACEEERAMALLAERMKQPLPMDEAWRLIRAVR

SEQ ID NO: 22610 - protein, 510 aa, Clostridium acetobutylicum ATCC 824
MDKQLVLVIDFGGQYNQLIARRVREHNVYCEIVPYTYSIDKIKEKKPSAVIFTGGQNSVYGEDSPRMDKEIFDLGVPVLGICYGHQLITYTLGGEVMGSEIREYGKTDVTLDSVCELFEGIDIENSCWMSHTDRVAKVPEGFKVVGHTNVCPVAAMANTEKKIYGVQFHPEVLHTPFGEQLFSNFLFKICGLKEDWSMSSFAKEKIQEIKDIVGDKKVLCALSGGVDSSVAAVLVHKAIGKQLTCVFVDHGLLRKDEGDQVESIFRKQFDMNLIRVNAKDRFLGKLKGISDPERKRKIIGEEFIRVFEEEANKLGQIDFLVQGTIYPDVVESGTDTSATIKSHHNVGGLPEDMQFELIEPLRELFKDEVRAVGEELGIPHKLVWRQPFPGPGLGIRVLGEVTEEKLEIVREADAIFREEIANAGLEEKIWQYFACLPNIHSVGVMGDGRTYCETIALRAVTSSDAMTSDWARIPYEVLDKVSRRIVNEVKGVNRIVYDVTSKPPATIEWE

SEQ ID NO: 22611 - protein, 432 aa, Clostridium tetani E88
MRLFGTMEVKDNNLYIGGVSCKELKNKYSTPLYIIDEDFLRGRCKEYYNNFGVEKHGNKVAYAGKSFLTIAMCQIIKEEGLFLDVVSSGELYTALKANFPMNKIYFHGNNKTLDEIEMGIELGVGKFVVDNFYEMNNINNMARKKGIKQSILLRITPGIEAHTHDYIKTGQVDSKFGFSMVGEEVYKAVETALSLPNINLSGIHCHIGSQIFETTPYEEAVDIMFEILKEIKNRYDYEISEVDLGGGFGIYYTKEDKPKETKEYCEAILKKALNKSKELGIKLPMLGIEPGRSIIGNAATLIYTIGAIKEIPGIRKYVSIDGGMNNNIRPALYDAKYECEVANNMNSDDRELVTIAGKCCETGDIVIEDVEISKSKSGDILAIPSVGAYGYSMSSNYNKIPKPAIVLVKDGESRVMCKRESFDDMLKNELSL

SEQ ID NO: 22612 - protein, 449 aa, Vibrio vulnificus CMCP6
MNKYQLPQDSQLRQADFLFGVATSSYQIEGGAQLGGRTPSIWDTFCNQPGAVDNMDNGDVACDHFHLWQQDIALIQGLGVDAYRLSMAWPRILPKDGQVNQQGLEFYERIIDECHARGLKVFVTLYHWDLPQYLEDKGGWLNRETAYKFAEYAKVVSGYFGNKIDSYATLNEPFCSAYLGYRWGIHAPGKKGEREGFLSAHHLMLAHGLAMPIMRKNAPQSMHGCVFNATPAYPYREQDVAAAEYSDAEGFHWFIDPVLKGEYPQSVLERQAHNMPMILDGDLDIIRGDLDFIGINFYTRCVVRFDANGDLESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 22613 - protein, 228 aa, Yarrowia lipolytica CLIB122
MKLFATIGVLLVALLAFFVQPAQAEPDAEITHKVYFDIKQGEESLGKIVMGLYGDVVPKTVENFRALCTGETGKGYKGSKFHRVIKNFMIQGGDFTRGDGTGGESIYGRKFPDENFQLKHTKPYKLSMANAGRDTNGSQFFITTVVTSWLDGKHVVFGEVLEGQDIVDAIENAPTGARSNPKVDITIADAGEIPVEKSETKEAEPAKEDAKEPKEDVKKKGKSDKDEL

SEQ ID NO: 22614 - protein, 518 aa, Alkaliphilus metalliredigenes QYMF
MKRSDIRNIAIIAHVDHGKTTLVDQMLRQSGTFRSNEVVEERVMDSNDLERERGITILSKNTAIAYENVKINIIDTPGHADFGGEVERIMKMVDGVLLVVDASEGPMPQTRFVLQKALKQGVKPLVVINKIDRPEARPDEVVDEVLDLFIELGADEHQINFPVLYASAKDGIAKKYVEDESTNMKPLFDGILEHIPCPEGDENDSLQLLISNIDYNKYIGRVGIGKIQRGSIKKGQMAVLVDADSKEINVKITNLYHYQGLNRVETDQAHIGEIVAISGIEKINIGDTVCGTEKVEALETIKVDAPTISMNFMVNDSPLSGREGDFVTSRHLKERLEREMLSNVAMKLEEISADSHKILGRGELHISILIETMRREGYEFAVSRPEVITKRTEEGLFEPIERLYVEVPEESMSSVIEKLGQRKAEMVNMVPTGTGVMKLEFRIPARGLIGYRSEFLTDTKGYGLFHHLFDGYDKHKGEIRSRTRGSLIASESGTAVAYGLHSSQERGKAVYWSWNRCL

SEQ ID NO: 22615 - protein, 172 aa, Prochlorococcus marinus str. NATL1A
MDHLKKYITEINDYPKKGIVFKDLNPIYKEPKAWKELMFPLQNLISTKKPDYIAGIESRGFISASALAFKLEIGLITIRKPNKLPGEVIGTNYKLEYGEDRLEIQQNIIEKDSKILLFDDLLATGGTAGAAGKLIKKAGGNLIGYAFLVELTELKGRENLDSNLLVETLIKY

SEQ ID NO: 22616 - protein, 628 aa, Mycobacterium tuberculosis H37Rv
MPFRNVAIVAHVDHGKTTLVDAMLRQSGALRERGELQERVMDTGDLEREKGITILAKNTAVHRHHPDGTVTVINVIDTPGHADFGGEVERGLSMVDGVLLLVDASEGPLPQTRFVLRKALAAHLPVILVVNKTDRPDARIAEVVDASHDLLLDVASDLDDEAAAAAEHALGLPTLYASGRAGVASTTAPPDGQVPDGTNLDPLFEVLEKHVPPPKGEPDAPLQALVTNLDASTFLGRLALIRIYNGRIRKGQQVAWIRQVDGQQTVTTAKITELLATEGVERKPTDAAVAGDIVAVAGLPEIMIGDTLAASANPVALPRITVDEPAISVTIGTNTSPLAGKVGGHKLTARMVRSRLDAELVGNVSIRVVDIGAPDAWEVQGRGELALAVLVEQMRREGFELTVGKPQVVTKTIDGTLHEPFESMTVDCPEEYIGAVTQLMAARKGRMVEMANHTTGWVRMDFVVPSRGLIGWRTDFLTETRGSGVGHAVFDGYRPWAGEIRARHTGSLVSDRAGAITPFALLQLADRGQFFVEPGQQTYEGMVVGINPRPEDLDINVTREKKLTNMRSSTADVIETLAKPLQLDLERAMELCAPDECVEVTPEIVRIRKVELAAAARARSRARTKARG

SEQ ID NO: 22617 - protein, 312 aa, Arabidopsis thaliana
MENKTQEEASTIKVSSLTCIDLANPNFQQSAVSLKQACLDCGFFYVTNHGISEELKDEAFEQSKKFFALPLEEKMKVLRNEKHRGYSPVLDQILDPENQVDGDYKESFFIGIEVVLPGWRATMEKYHQEALRVCKAIARLLALALDLDTNYFDKPEMLGNPIAVMRLLRYEGMSDPLKGIFGCGAHSDYGMLTLLATDSVTGLQICKDKDVKPRKWEYVPSIKGAYIVNLGDLLERWSNGIFKSTLHRVLGNGQDRYSIPFFIEPSHDCLVECLPTCQSENNLPKYPAIKCSTFLTQRYQQSHVNLSIYKQP

SEQ ID NO: 22618 - protein, 251 aa, Arabidopsis thaliana
MKVLKNEKHQGYSPVLSQISDNQIHGDYKESFFIGIEGSNDTPFCRANIWPNPDVLSGWQATMEKYHQEALRVCKAIARVLALALNVDGDYFDTPEMLGNPLTFMRLLHYEGMSDPSKGIYGCGPHSDFGMMTLLGTDSVMGLQICKDRDVKPRKWEYILSIKGAYIVNIGDLLERWSNGIFKSTLHRVLGNGQDRYSIAFFLQPSHDCIVECLPTCQSENNPPKYPAIKCSTYLTQRYQDSQVDLSIYKK

SEQ ID NO: 22619 - protein, 461 aa, Desulfitobacterium hafniense Y51
MKELIKSIAVLGSGPAGYVAAIRASQLGAEVVVIEEEDLGGVCLNRGCIPTKALLKTAEIAVMAKRSKEFGIESQLEAKNWGVAVDRKNRIVKNLNSGLDNLLRARGITVLKGKGTVLSERKILVQTTEEVIEVNCEKMILTTGAVPLILPIKGIDSAGVITSDEALNLKALPESIVIIGAGVIGLEFAAMLGHAGVKVTIIELQDRILPNEDREIAAELQKIMKRQGIIFKLSASVTEIHKIEDGLIVTYSMGEKEFRHPCEKVLVAAGRKTNSDIFEKLPLTIEKGAVVVDEFMETNVKGVYAAGDLVGGKQLAHLAFMEGKVAAENALGITSKVNYSAVPTCIYTNPEMASVGMTEEQAKRAGLSVKVGRFDFRNNGRALTLGEREGFVKVIADQDNTIIGGQILGVDASEMISELTLAITLKAKADDIADMIHPHPALSEAIWEACGEILGKPIHKL

SEQ ID NO: 22620 - protein, 480 aa, Pseudomonas fluorescens PfO-1
MQLKDTQLFRQQAFIDGAWVDADNGQTIKVNNPATGEILGTVPKMGAAETRRAIEAADKALPAWRALTAKERAGKLRRWFELMIENQDDLARLMTLEQGKPLAEAKGEIVYAASFIEWFAEEAKRIYGDVIPGHQPDKRLIVIKQPIGVTAAITPWNFPAAMITRKAGPALAAGCTMVLKPASQTPFSAFALAELAQRAGIPKGVFSVVSGSAGDIGSELTSNPIVRKLSFTGSTEIGRQLMSECAKDIKKVSLELGGNAPFIVFDDADLDKAVEGAIISKYRNNGQTCVCANRLYIQDSVYDAFAEKLKVAVAKLKIGNGLEEGTTTGPLIDEKAVAKVQEHIADAVSKGATVLAGGKPMEGNFFEPTILTNVPKDAAVAKEETFGPLAPLFRFKDEADVIAMSNDTEFGLASYFYARDLGRVFRVAEALEYGMVGVNTGLISNEVAPFGGIKASGLGREGSKYGIEDYLEIKYLCLGI

SEQ ID NO: 22621 - protein, 133 aa, Medicago truncatula
MAVHCNSLAQIPIQKYDNSFVKYSNNLLMSKRCYAPKKKSTVGPVLLKITASIKNKVVYEDESQGIICYQDESGEIICEGYDEGPSYRQISRPTHHQRDVEIVNLLKQSWFQIAKGKEIDDAVEGGRLQEDLI

SEQ ID NO: 22622 - protein, 450 aa, Idiomarina loihiensis L2TR
MSYIKETIEKLKQTSPAQVEFYQAVEDVLESIEPLLEERPKYREHSIIERLLEPERQIMFRVPWMDDDGKIQVNKGYRIEFNSALGPYKGGLRFHPSVNAGIVKFLGFEQIFKNALTGLPIGGGKGGANFDPKGKSDAEIMRFCQSFMSELYRHIGPHTDVPAGDIGVGSREIGYLFGQYKRLANRFDGVLTGKSELWGGSQVRKEATGYGVVYFAQCMMDDQDDSLDGKRCLISGSGNVAIHAMEKLYELGAKPISCSDSSGTIYHDSGIDLDLVKRIKEEQGGRLKEYLETHEDAEYTSKDDYPEEGHCVWRYEADIAFPCATQNELTEKDAQALLENGCKYIVEGANMPTTQAAVDLFIESGVGYGPGKASNAGGVATSQLEMAQNASMLRWDFEEVDEKLKDIMSNIYQDAKRTAEDFGHPSNLVLGANIAGFRKVADAMLEQGVV

SEQ ID NO: 22623 - protein, 425 aa, Pseudomonas fluorescens PfO-1
MSKTNAELMARRTAAVPRGVGQIHPIFAESAKNATVTDVEGREFIDFAGGIAVLNTGHVHPKIIAAVTEQLNKLTHTCFQVLAYEPYVELCEKINARVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPKDIAAIIIEPVQGEGGFYVAPKEFMKRLRALCDQHGILLIADEVQTGAGRTGTFFAMEQMGVAADLTTFAKSIAGGFPLAGVCGKAEYMDAIAPGGLGGTYAGSPIACAAALAVMEVFEEEKLLDRCKAVGERLVTGLKAIQAKHPVIGEVRALGAMIAVELFENGDSHKPNPTAVAAVVAKARDKGLILLSCGTYGNVLRVLVPLTSPDEQLDKGLAIIEECFSEL

SEQ ID NO: 22624 - protein, 140 aa, Alteromonadales bacterium TW-7
MSDDAVTLMRNQKIILFDAQCKLCSAWCNFIISNDTNAIFKLCSVQSPKGKVLLTHFGFSTTQYASMVYLENGKVFTQSHAFFTVVKQLGYPYKLATIFSVLPNTFNNWLYDKIALNRYTLFGKYQYCRIPSKCDELHYL

SEQ ID NO: 22625 - protein, 394 aa, Pseudomonas fluorescens PfO-1
MWYEGFLGLSAWSLVAVTLVMTHVTIVAVTVYLHRYSAHRSLELNAGLKHFFRFWLWLTTAQNTREWTAIHRKHHAKCETEDDPHSPVVKGLSTVLCKGAELYREEAQNPETLRIYGKNCPEDWIERNLYSRYRLLGVAIMAVVDLLLFGTIGITIWAIQMMWIPVWAAGVVNGLGHAVGYRNFECRDAATNLVPWGILIGGEELHNNHHTYPNSAKLSVKKWEFDLGWAWIQVFSFLRLAKVQRVAPIAHRVEGKGSLDMDTAMAILNNRFQIMAQYRKLVIGPLVKQELAKVDHSVRHQFHRAKRLLSRETSLLEDRHHARIQSMLEHSQALKVIYEKRLALQQIWVKTSANGHDMLAAIKEWVHEAEASGIQSLREFADQLKTYSLRPAAV

SEQ ID NO: 22626 - protein, 144 aa, Thiobacillus denitrificans ATCC 25259
MQIREILTLKSDEIYSIAPTDRVESAVARMVELGVGSLVVLKAGEMVGLLTERDVVHGMVEHGCDLKDTEVSAIMVTDPVVANADDSVDYARDVMTKSHIGHLPILDGNKLLAIISFHDVARACLKEANFENSLLKRYIKHWPE

SEQ ID NO: 22627 - protein, 515 aa, Oceanobacter sp. RED65
MSAQPKPVALIILDGFGERDAAQDNAITTANMPTWNRLVNEYPHVQINTSGAAVGLPDGQMGNSEVGHMNLGAGRIVYQNYTRINKAISDGEFQQNAALTAAMDKAISAGKAVHLMGLLSPGGVHSHQDHIMALASMAKDRGAKQIYVHAILDGRDVAPQSAKPFLETVSEHLAGLDMGDDARIVNLIGRYYAMDRDNRWERVQRAYDMYTQGKAEYQAASAIEGLEASYDRDEHDEFVKDTIIGDAVTINDGDSVIFANFRPDRAREITRAFVEQEFNGFSRTAHPTLSDYVMMTEYAADIETSCAFPPASMKNDLGEYVSNLGKTQLRIAETEKYAHVTFFFSGGQEAVYPGEERILINSPDVATYDLKPEMSAPEVTDKLVDAIENQKYDLIVCNFANGDMVGHTGVMDAAVKACEALDTCLKRVTDAIIKVGGECLITADHGNCEQMTDANGGPMTQHTTGPVPLVHVSKKGKQVSLKQGGALCDIAPTLLTMMGETAPEEMTGQVLVKYE

SEQ ID NO: 22628 - protein, 181 aa, Thiobacillus denitrificans ATCC 25259
MAKVLVPLADGCEELEAVTIIDLLRRAGVEVIVAGLKPGVVKASRGVQLVPDVTLDQALADAYDMVVLPGGMPGAAHLKDDVRVVDLLKKMASAGKYTAAICAAPMVLAEAGLLRGKQATSYPGFLDGVPDVTLRAEAVVQDGTVLTSRGPGTAMDFALQLVETLVGRAKREQVETALVRP

SEQ ID NO: 22629 - protein, 489 aa, Arabidopsis thaliana
MSTVESSKPKIINGSCGYVLEDVPHLSDYLPGLPTYPNPLQDNPAYSVVKQYFVDADDSVPQKIVVHKDGPRGIHFRRAGPRQKVYFESDEVHACIVTCGGLCPGLNTVIREIVSSLSYMYGVKRILGIDGGYRGFYAKNTVSLDSKVVNDIHKRGGTILGTSRGGHDTTKIVDSIQDRGINQVYIIGGDGTQRGASVIFEEIRRRGLKVAVIGIPKTIDNDIPVIDKSFGFDTAVEEAQRAINAAHVEAESIENGIGVVKLMGRYSGFIAMYATLASRDVDCCLIPESPFYLEGEGGLFEYIEKRLKESGHMVLVIAEGAGQDLMSKSMESMTLKDASGNKLLKDVGLWLSQSIKDHFNQKKMVMNLKYIDPTYMIRAVPSNASDNVYCTLLAQSAVHGAMAGYTGYISGLVNGRQTYIPFYRITEKQNHVVITDRMWARLLSSTNQPSFLGPKDVFDNKEKPMSALLDDGNCNGVVDVPPVTKEITK

SEQ ID NO: 22630 - protein, 602 aa, Yarrowia lipolytica CLIB122
MARLCLSQTGSIRSRRRLWAGVGTIADFHTPDPPHIFHACACTKRSHMHSPDSLSTLFSTNFLYTSQLTMYKVHNPYLTAAVATMGGMLFGFDISSVSAFVGEDQYMQYFGHPTSIQQGGITASMAGGSMLSCSFAGFISDRIGRKPTIQIAAAWWIVGAAIQCSAQNMGQLIAGRVISGIGIGIGSSQIPVFISELSPKKIRGRLVGCFQWAVTWGILIMFYISFGCSYIKGPASFRLAWGIQMIPGAMLAFGMMFLDESPRWLASKDRWEEAIQIIRSVNGNYGTEEDILMEIEDLREVVRIDHESKTVMVWDLFRKDSINRTMVGIWAQIWQQLTGMNVMMYYVVIIFKMAGYSGKSSVLVSSSIQYIINVVMTIPALLFIDKIGRRPLLIVGCLFMMTWLFAVGGMLGAYGTQMPGGLPANPEKNIAADPYTTIFIDDNHKTARKAIIACCYLFVASFAPTWGPGIWLYCSEIFPNKQRAMANSITAGANWAFNFALAMFVPTAFKNINWKTYIIFGVFCVVMCIHVFLLFPETKGKTLEEIDMMWDAKVPAWRTASWVPDHMPSRYAEKDLDEKPMDELAEEPSHEEDPHPQYTETV

SEQ ID NO: 22631 - protein, 246 aa, Prochlorococcus marinus str. NATL1A
MRKPVIAGNWKMNMTCTEAIEYMRVLIPLLKDIPKKDREVVIAPPFTALYPLSEFIRDKNDCLSLSSQNVHWEDSGAYTAEVSPLMLNELSVKCAIVGHSEPRKYFSESDEQINKRAKSAQDHQLIPIVCVGETFQQREMGEAERVIRRQIEQGLEGIEVKKLIVAYEPIWAIGTGKTCEANEANRICGLIRKWIGYEDVIIQYGGSVKSNNIDEIMSMSDIDGVLVGGASLDPTNFARIANYEKI

SEQ ID NO: 22632 - protein, 394 aa, Thiobacillus denitrificans ATCC 25259
MTTTHLMNTYARQPVAFVRGEGAYLWDEAGKRYLDAVAGVAVNALGHAHPRLVKAIAEQAATLIHSSNLYRVLRQEELADKLCALSGMDRAFFCNSGCEANEAAIKLARLYGHGKGIELPTIIVVEKAFHGRTMATLTATGSRKIQAGFEPLLSGFARVPFNDIEAIRHVAEHNKSVVAVLIETVQGEGGINILPAEYLAELRTLCDAQGWLLMLDEVQTGIGRTGTWFGFQHAGVVPDVIALAKGLGGGVPIGACLARGAAAEVFTPGTHGSTFGGNPLACAAALATLETIEAEHLLDNARLRGDAIRAGLRGALDGVHGVLDIRGEGLMIGIELDRPCAELVGVARDAGVLINVTADSVIRLVPPLIYGADEVDLLVATVADVVRNYLQQAA

SEQ ID NO: 22633 - protein, 465 aa, Ralstonia eutropha JMP134
MSLFRTKDIDAMLVNSHVGGLKKVLGPVDLVLMGIGAIIGTGIFVLTGTGALTAGPALTISFVIAAMACGFAALCYAEFASAIPVSGSIYTYSYATLGEIIAWMIGWDLLLEYGLATSAVSVGWSGYFQSLAAGFGLHLPAALTAAPGAVPGVQTLFNLPAFLIMLITTWVVSCGVRESARLNNVMVAIKVAVVVLFIAVGVWHVKPANWQPFAPFGVSGIFNAAALVFFAFIGFDAVTSAAEEVRNPHRDLPVGIIGSLAVCTVLYVIVAAIMTGVVPFAKFAGIDHPVSLVLQYAGQNWVAGFVDLGAILGMTTVILVMTFGQTRVIFAMSRDGLLPARLSSVHPVHATPFFATWTVGIVFAMIAAFVPLNVLAELINIGTLSAFTLISIAVLVLRRTRPELHRAFRCPGVPVVPLLSVGFCLFLMAHLQALTWIAFLTWLAIGLSVYFLYARRNAVLHEGSR

SEQ ID NO: 22634 - protein, 334 aa, Haemophilus ducreyi 35000HP
MKTLGEFIIEKQAEYPEAKGELSGILASIRLAAKIIHREINRAGLSQDILGFAGSENVQGETQMKLDIFANETMKKALLAREDVAGFASEEDDNFIAFDSERNRNAKYILMTDPLDGSSNIDVNVSVGTIFSIYKRISPIGSPVTIEDFLQEGRKQVAAGYVTYGSSTMLVYTTGNGVNGFTYDPSLGLFILSHPDMKMPAEGKYYSINEGQYVTFPLGVKKFIKYCQENDEASKRPYSSRYIGSLVSDFHRNLLKGGIYIYPTSTVYPQGKLRLLYEGNPMAFLAEQADGMATDGFQPILDIKPTELHQRVPFFIGSKTMVKQANTFMQTFTE

SEQ ID NO: 22635 - protein, 438 aa, Arabidopsis thaliana
MSCSSSSGSEGEEEGFDAYRKGGYHAVRVGDPFSGGRYIAQRKLGWGQFSTVWLAYDTLTSTYVALKIQKSAQQFAQAALHEIEFLSAAADGDLDKTKCVVRLIDHFKHSGPNGQHLCMVLEFLGDSLLRLIRYNQYKGLKLNKVREICRCILTGLDYLHRELGMIHSDLKPENILLCSTIDPAKDPVRSGLTPLLEKPEGNANGGASTMNLIEKKLKRRAKRAVAKISERRVSMVTGEEASSKTEKSLDGIDMRCKVVDFGNACWADKQFAEEIQTRQYRAPEVILKSGYSFSVDMWSFGCTAFELVTGDMLFAPKDGNGYGEDEDHLALMMELLGKMPRKIAIGGAKSKDYFDRHGDLKRIRRLKYWPLDRLLIDKYKLPEAEAKEFAEFLIPTLEFAPEKRPTAQQCLDHPWMNVTTQNDAENVDDQMNNLHIKG

SEQ ID NO: 22636 - protein, 327 aa, Haemophilus ducreyi 35000HP
MTAQLTLEQIQALAQQDMQAVDQEILAQLNSEVPLINQLGHYIISGGGKRIRPLIAVLAANALCYTGRKHLTCAAFIEFVHTATLLHDDVVDESALRRGRETANAIFGNAASVLVGDFIYTRSFQMMTSVDSLEVLKVMSAATNALAEGEVQQLMNINDPHTTEANYMRVIYNKTARLFEAATQCVAIVAGASQQIEQALKAYGCYLGTAFQLVDDILDYSAKAEQFGKNVGDDFVEGKPTLPLLHALQHANEAQASMIREAIEHGGERAKIPMVLAIMAEHKSLEYAMARAKQEAQKAVAALDILADTEYKKALISLAYLSVDRRY

SEQ ID NO: 22637 - protein, 552 aa, Xanthomonas campestris pv. campestris str. 8004
MSHVRPACQAGGWCGEPAKIGGYSRCVSPGAGCGRPDFLGDSMSADLLKALDLAPSNAGTYLGEGTWSQATGAGVLQPLNPTTNAVIADVQATTPQDYELIVARAQAAFKVWRTTPAPRRGEAVRLCGEALRAHKDALGSLVALEMGKSKPEGDGEVQEMIDIADFAVGQSRMLYGYTMHSERPGHRMYEQYQPLGLVGIISAFNFPVAVWAWNAFLAAICGDICIWKPSNKTPLTAIATMKICNAALKEAGFPDIFFLINDAGTSLSEKLVEDGRVPLISFTGSTQIGRVVAEKVARRLGRCLLELGGNNAIILDETADLKLAVPGIVFGAVGTAGQRCTTTRRLIVHESIYDNVLATLVKAYKQLDSKIGDPTDPANLMGPLNSRGAVEQFLESIAKAKAAGGTVEVGGTAIDRPGNFVLPAIVTGLKNSDAVVQHETFAPILYVMKYSTLDEAIDLQNGVPQGLSSSIFTQNLKAAEKFLSAAGSDCGIANVNIGTSGAEIGGAFGGEKETGGGRESGSDAWKVYMRRQTNTINYSDSLPLAQGIKFDL

SEQ ID NO: 22638 - protein, 1559 aa, Magnaporthe grisea 70-15
MDDRPTPKDTDIPGGFPESPPGPTPLTERNFPLVTSQLRASRSHVDAPTEQIRRPGPAIGGDIGSTSSSLTEKEGLNNETASQDDGSEKRFAPLRTDSQAVRATGSDARPGFERKATSYTEDDIFRALSRRRTGGTHASAPAESDEDEGQEIERLVSRMFGHERQRQSAEEKTRRSGVIFRDLTVKGVGLGATLQPTVGDIFLALPRKVGHLFTKGPRAAFAKPPVRELISHFDGCVRPGELLLVLGRPGSGCSTFLKTFCNQRAGFESVLGDVSYGGVDAKTMARDYRGDIIYNPEEDLNYATLSVKRTLHFALETRAPGKESRLEGETRQDYIREFMRVITKLFWIEHTLDTKVGNEYVRGVSGGERKRVSIAEAMIARASVQGWDNSSKGLDASTAVEYLRSIRAMTNMANTSTAVSLYQAGESLYELADKVLLIDAGKCLYFGPSEQAKQYFIDLGFHCPERWTTADFLISVTDPHERHVRQGWEDRFPRTPEQFAEAYRRSNIYRANLEDMSRFEAEQQQQVEARAAIEAGKPKRERTKNYEIPFHKQVIACTKRQFLVMIGDKASLLGKWGGLVFQGLIIGSLFFNLPETASGAFPRGGVLFLLLLFNALLALAEQTAAFESKPILLKHKSFSFYRPSAYAIAQTVVDVPLVFIQVVLFTVIIYFMSHLARTASQYFIANLILWLVTMTTYSFFRAISAWCGTLDVATRFTGLAVQILVVYTGYLIPPTSMPVWFGWLRWINWLQYGFECLMSNEFYRQELTCNGPFLVPQGPQAEPQYQGCTLAGSTPGDSTVSGANYIAESFSYTRAHLWRNFGFLWAFFIFFVLLTALGMERMKPNKGGGAITVFKRGQVPKQLESTIETGGKGKGGNEKDEEVGTTGSDSQAPVSPREGSTEEDDKRSNQVAENETIFTFRDVNYEISSKGGKRKLLSDVQGYVRPGKLTALMGASGAGKTTLLNTLAQRIQTGTVTGEFLVDGRPLPKSFQRATGFAEQMDIHEPTATVREALQFSALLRQPREVPKQEKLDYCETIIDLLEMRSIAGATIGNVGEGLNTEQRKRLTIGVELASKPELLMFLDEPTSGLDSGAAFNIVRFLRKLADAGQAVLCTIHQPSAILFENFDELLLLKAGGRVVYHGPLGHDSQDLLGYLEGNGAHKCPPNANPAEYMLDAIGAGDPDYKGQDWGDVWQNSKEREARTREIDDMISQRQQAEQTQSLRDEREYAMPLSAQMSAVVRRSFVSYWRNPGYLVGKFMLHILTGLFNCFTFFRIGFASIDYQNRLFSVFMTLTICPPLIQQLQPVFIDSRQIFQWRENKAKIYSWSAWVTGAVLAEIPVAVLAGAVYFNCWWWGIFGWRDIMPASSSAFAFLMVVLFELYYVSFGQAVAAFSPNKLLASLLVPLFFTFIISFCGVVVPPAQIPTFWREWMYWLSPFHYLLEALLGVAVHAQPLECSADELARFEPPPGSSCEEYAGPYVAQAGGRLRTGQGGMCELCQYADGDQFAASFSVYYYNRWRDVGIFCGFIVFNYAVVYLATWLKFKGRNPLKMFGKRKSG

SEQ ID NO: 22639 - protein, 524 aa, Aspergillus nidulans FGSC A4
MPSHTYPQRLYTTGYTVPPLKDKSLFIQKAFVNGEWVDAESGKTFEVHAHIDANGWYLDVLTDPATGKLIGTCPEFSASDTEKAIQAASAAFPKFRATLARERARMLRRWYQLMVDNAEDLATLITWENGKPLADAKGEVNYAASFFEWFSEEAPRTYGDTIPASVPGNRVITVKQPVGVCGLITPWNFPAAMITRKIGPALAAGCTVVTKSPGETPFTANALAELANRAGIPKGVVNIVTAMKNTPEVGEMITTHPDIRKVSFTGSTNVGRLLMKQSSSTIKKVSWELGGNAPFIVFDDVEDLDAAVTGAIASKFRSSGQTCVCANRIYVQKGIYDEFVQKFVEKVRNFKVGAGFEDGVTHGPVIHDRAVDKVDQHVQDAISKGAKLIAGGQRRSDLGPNFYDLTVLANMTKDMKIASEETFGPVAGLFPFETEKEVVELANKAEVGLAGYFFSGNIKRIFRVAEALEVGMVGVNTGLISDVASPFGGVKQSGFGREGSKYGIEEFMTIKSVTFGGMGEPLQS

SEQ ID NO: 22640 - protein, 379 aa, Xanthobacter autotrophicus Py2
MAKRDYYETLGCDRGADDTVLKASYRKLAMKWHPDRSQGNGEAEVMFKEVNEAYEVLKDPQKRAAYDRFGHAAFENGGGGGPGFGNDFASSFADIFDDLFGGAMNRGRGGGQQRGRGADLRYNMEITLEEAFSGKTAQIKIPTSVSCETCSGTGAKPGTQPKACRMCGGAGKIRHAQGFFTLERTCPNCQGRGSVIEDPCSDCGGAGRVTRERNLSVQIPAGVEDGTRIRLGGEGEAGVRGGAAGDLYIFLSIEPHTFFQREGADLYCRVPISMVTAALGGTVEVPTIDGDKSKVKIPEGTQSQKRFRLSGKGMPIMRARNHGDMYVQVVVETPQKLTKRQKELLAEFEKDSSGETHPESTGFFAKVKEFFQGAAGEGA

SEQ ID NO: 22641 - protein, 136 aa, Pseudomonas fluorescens PfO-1
MTPLRITFAALGLSAFSSLALAAGNPLSVHVLNLENGLPSPGINVTLERHVGQNWQPLAQGTTNEQGRIAELFPANKPFEAGEYRVVFKTGEYFEKTKHETFFPEIPVIFKVQQTDQHYHIPLLLSPYGFSTYRGS

SEQ ID NO: 22642 - protein, 1108 aa, Coprinopsis cinerea okayama7#130
MSALAAPSSFMNSDSLSSQSPPKPSSPIVVSPPYSTNRQPTRPFKNMGSVDLRGQLPFPTGPTISLDPPPGTTFAESLKAWTDNHVARWLSDMKCGMHAEVFRINDIRGDVLLELDQDTLKEMNIVSIGDRIRILNAVKLLRQRAAARTPSPIHVTRPTASHTRTGSENLSLEQGVASGRGHSRKESTRPPPITIHPNANKGDLPDLIREPPPDSASGRSMMAPPPVRPLPVPQNATPTASQVSTPGGSHRPNLPPLPPPPRGQPPPPPTTNRTPNRWNSSASEAPSQPLPPTPQNQGLLTPSNGSTWDSRSKPSRSTSPLPPPRGVRGPVAKASGAGVASPNNSPARRLGGHPYAMPSVQATLHPPTGLQNPNLSPIDEHFAAAGQNSSSTSTPSPPSQPYRSYTPANAYNTPSLDDIRKKIVKFVIPEEGTSYMIDVTNCSSGQEVIEKVLKKIGKGGFRGIDNDGHGDRDDGSLNVDGWAVYLASGEESPSEPLTETQLLNICNAPDHPARERGLAVRRLRRQEDRSGSPLARNLQPPTQPTSKATKRASSISILSGLGVRNPDKVLGDPPSPSNEAPSPPPPPLWQSGAGNAKRPSKLRNFFGQRPPSELITDHLPEFFPMAEKKVLRTARHSILLRSGTLKRQSALSGEKDEGEPIPRMSLSTDDGHSIDLHSDDDDDDIPLSASVAPRLLPPIETGSKRLSFMSELRSKRDRSDTASMMTVDEITAEVESRRVSKMPDMSNANDLEGWTKVENAASFDTAPTVPADEVEVDDDEATLATEDDEDEDEDDSDDDFGIAIPTRTNNKWIKGALIGAGSFGKVYLGMDASNGLLMAVKQVELPQGDGPSQERKKSMLSALEREIELLKVLQHENIVQYLYSSSDDEYLNIFLEYVPGGSVATLLSNYGAFEEPLVRNFVRQILQGLSYLHERDIIHRDIKGANILVDNKGGVKISDFGISKKVDDNLLGGNRLHRPSLQGSVFWMAPEVVKQTGHTKKADIWSVGCLVVEMLTGEHPWAQLTQMQAIFKIGSSARPTIPSDISAEAQDFLQKTFEINHELRPHAAELLQHPWLSKKGKKAAAAAAAAAAAASASAASSTNDSPSS

SEQ ID NO: 22643 - protein, 461 aa, Mycobacterium sp. JLS
MSHPGATPTDRHKVVIIGSGFGGLSAAKTLKRADVDIKLIARTTHHLFQPLLYQVATGIISEGEIAPATRVVLRKQKNVQVLLGDVTHVDLQNRLVHSELLGHDYATPYDSLVIAAGAGQSYFGNDHFAEWAPGMKSIDDALELRGRILGAFEQAERSSDPKRREKLLTFVVVGAGPTGVEMAGQIAELADYTLKGTFRHIDPTSARVILLDAAPAVLPPMGEKLGKRAAARLEKMGVEIQLNAMVTDVDRNGITVKDPDGKLRRIESACKVWSAGVSASPLGRDLANQCDVEVDRAGRVKVLPDLSIPGHPNVFVVGDMAAVEGVPGQAQGAIQGARYAAKLIKNEVKGANPAFRQPFEYFDKGSMATVSRFSAVAKVGPLEFGGFIAWLAWLALHLVYLVGFKTKIVTLISWTVTFLSTKRGQLTITEQQAYARTRIEELEEIAAAVTDTEREREQAAS

SEQ ID NO: 22644 - protein, 196 aa, Piper colubrinum
GNSITEGCLVASTNRGCKAIFVSGGATSILLRDGMTRAPVVRFATAKRAAEMKFFVEDPINFETLSLVFNKSSRFARLQSIQCAIAGKNLYMRYSCSTGDAMGMNMVSKGVQNVLDYLQNEYPDMDVMGISGNFCSDKKPAAVNWIEGRGKSVVCEAIIKEEVVKKVLKTEVAALVELNMLKNLTGSAMAGALGGF

SEQ ID NO: 22645 - protein, 221 aa, Triticum aestivum
  misc_feature (37)..(37): Xaa can be any naturally occurring amino acid
  misc_feature (48)..(48): Xaa can be any naturally occurring amino acid
  misc_feature (59)..(59): Xaa can be any naturally occurring amino acid
  unsure (1)..(221): unsure at all Xaa locations
MDSSSSSTASSSQAQAQPDFDYLFKLLLIGDSGVGKXSSLLLRFTSGXSEDLSPTIGVXDFKVKMVNIAGKKLKLAVWDTAGQERFRTLTSSYYRGAQGIIMVYDVTRRETFTNLSDIWAKEIDLYSTNQDCIKMLVGNKVDKESERAVTKKEGIDFAREYGCLFLECSAKTKVNVEQCFEELVLKILDTPSLLADASSGAKKNIFKQKAPEADAAASGCC

SEQ ID NO: 22646 - protein, 479 aa, Streptomyces sp.
MVPAAQQTATAPDAALTFPEGFLWGSATASYQIEGAAAEDGRTPSIWDTYARTPGRVRNGDTGDVATDHYHRWREDVALMAELGLGAYRFSLAWPRIQPTGRGPALQKGLDFYRRLADELLAKGIQPVATLYHWDLPQELENAGGWPERATAERFAEYAAIAADALGDRVKTWTTLNEPWCSAFLGYGSGVHAPGRTDPVAALRAAHHLNLGHGLAVQALRDRLPADAQCSVTLNIHHVRPLTDSDADADAVRRIDALANRVFTGPMLQGAYPEDLVKDTAGLTDWSFVRDGDLRLAHQKLDFLGVNYYSPTLVSEADGSGTHNSDGHGRSAHSPWPGADRVAFHQPPGETTAMGWAVDPSGLYELLRRLSSDFPALPLVITENGAAFHDYADPEGNVNDPERIAYVRDHLAAVHRAIKDGSDVRGYFLWSLLDNFEWAHGYSKRFGAVYVDYPTGTRIPKASARWYAEVARTGVLPTA

SEQ ID NO: 22647 - protein, 113 aa, Acidobacteria bacterium Ellin345
MSDCLFCKIVAGQIPSKKVYEDEKVFVFQDINPQAPIHFLIIPRQHIAGLKEASEADAEIIGYCHLIAAKLGKQYNVEDGYRTVLNVGPKSGQSVFHLHLHLLGGRDLTWPPG

SEQ ID NO: 22648 - protein, 385 aa, Yarrowia lipolytica CLIB122
MPSVSSTASSRQSNEGRFDTLTPDQQERLKQMWSVLLAAMEIAEPQAPAASPTFDPKPLVPKLLGDMTSKEIRLVLWNLSRTMTIDNMLLRFLRARQFDVAKSVEMLGRTLHWRLKESGLDELQFRGEIGALKSNDVEFMTQLRSKKAYIHGRDKCGRPVVRITPRLHSKDKQSPQCIEKFTLHLFESTLLMLDEKVDTIVFLFDMTGFSLFNMDYAYVKYVLKCFEAYYPESLGLVLIHNSPWVFSGVWNIIKGWIDPNVAQKIKFTKNVKALQEYIDIEQIPADIGGKDTFKYEYPEPRNSEGDKLQDHAGREQALNERSALCQQLEQNTIEWVQCSAGSEKQVLDTRRDLTNKLKVQYWNLDCYVRAPCVCDRLGQIHPVMA

SEQ ID NO: 22649 - protein, 655 aa, Gibberella zeae PH-1
MLRNAMLRPSARATMRCRPRALMAPPYRRLQSGGPFQTMRPPSPEELGAPRRAKEYQRGRRWARKFLIISAVGGIVYLGDRQIYASGFTRSLRTFGTGLLVAFDYKLNFRPQPITGGTVQDLHNRNAERLFHVLRSNGGLYLKIGQAIAMQSAVLPPEFQKMFSRMFDDAPQDDWADIEAVIRQDFGKSVEEVFGVSFIGKEGMGLMERKARASASVAQVHWARLPDGREVAIKIQKREIAKQISWDLWAFKTVAWIYSKWFDLPLYKMVPFITERLELETDFVNEAKNSEKMRELVNGEKSLRGRVYIPTVYPEFTTKRVLVTEWIEGIRLWDKKAMTSRWLGGHGNGSPGAGSPLPKIDLEAARRELRTRPYQENLKPERQEWRGRRGRGGLGLSSREVMTTMVDLFSAQIFKWGVVHCDPHPGNIFIRRLPNGRAELVLIDHGLYVYMSQKFRNEYATFWKALMTFDNKTISRVTDAWGIKAADLFASATLLRPYEGGDGRTRNGIMKGLEGKTPAERHYAMQQRMKQGIREILADEEKWPQELIFIGRNMRIVQGNNQYLGSPVNRVKMMGEWASRSLFEDPHLPLSQRFQNRWRHLIFKTVMAASDIAFYMFKLRQWLGLGGGMEDEMEKRMKDVASDFGIELQHDVFDG

SEQ ID NO: 22650 - protein, 469 aa, Candida glabrata CBS 138
MSALLRALPQVSRTALRGRLVTPMTLRLYASFPPHTVIGMPALSPTMSQGNLAVWSKKEGDSLAPGDVLAEIETDKAQMDFEFQDEGYLAKILVPAGTKDVAVSRPIAVYVEDEADVAAFKDFTVEDAGGSQSSSAPAAEEQKEEPKKEEVKEEKSEKKAAKSNSTPSSVASGDRIIASPLAKTIALEKGIALKSVKGTGPRGRITKADVEKYLESAPKSTSTAAPSATPSTTGGASYEDLEITNMRQIIGDRLLQSRQSIPSYIVSSDISVSKLLKLRKSLNATAKDQYKLSINDILIKAVTVAARRVPDANSYWLQNEGIIRQFKNVDVSVAVATPTGLLTPIVKNAESKGLIEISKEVKELASRAKINKLVPEEFQGGTICISNLGMNPAVSMFTSIINPPQSTILAIGTVKRVAVEDAGAENGIAFDDQVTITGTFDHRTIDGAKGADFMRELKTVIENPLQLLL

SEQ ID NO: 22651 - protein, 291 aa, Pyrobaculum aerophilum str. IM2
MSKVPGPIVLMEPLSGKTSLIIKINAIHVSKRSKYQGILIVDTDDYGRTLVLDDYIQSSYYDEIYYHESLVHPAVTTHPRPSDVLILGGGEGATLREVLKHNTVKRAVMVDIDGDVVELSKKYLPQMHQGAFDDPRSEVRIEDGFVYVENALKRGEKFDVVIMDLTDPYSSDIAKQLYTPEFFGKVKRLLREDGIVVTQAGNSFYFPEAYDYVLQGVKGNFPIIAEYSVWIPSFGYAVNFVLGSLKHDPHSLSAEEVDKRLSERGVRAEFYSGKTHIALMNMPVIKKILRV

SEQ ID NO: 22652 - protein, 283 aa, Glycine max
MQRFSNTVIGFLNFFTLLASIPIIGAGLWMARSTTTCENFFQTPLLVIGFVVLVISLAGFIGACFHVAWALWVYLVIMVFIIAALLGFAVFGFVVTEQGGGVEVPGRAYKEYRLDRYSPWLRNRIKDPQYWSTIRSCILGSNTCAKLAFWTPLDYVQRDMSPIQSGCCKPPTGCSYNEETVVVTQDPDCYRWNNAPTLLCYDCDSCKAGVLENIRRGWHNISVLNVVVLVFLIGIYSIAFCAFRNARRAQTDYPHGVNRMTKVKPRWDYYCWRWWYNKKEELF

SEQ ID NO: 22653 - protein, 542 aa, Haemophilus ducreyi 35000HP
MIFKNTRRSYQIIATFLRYGIDEIIPDIPFTYSARLTRKAFFWLQNEHKDQPFGVRLRLALQELGPVWIKLGQMLATRRDLFEPALADQLALLQDSVAPFDGKLARKIIEQALGNTLETWFDDFDEQALASASIAQVHTATFNKNQPLAGQNVVLKVIRPDIEHIIKADIALMYQLAKLIPYLSDDAKRLRATEVVREYEKTLLDELDLTREMANAIRLRNNFENSEMLYVPAMYPDFCHKNVIVMERIYGIPVSDIATLTENGTNMKLLAERGVQVFFTQVFRDSFFHADMHAGNIFVNPNHPEDPQYIGIDCGIVGTLNQNDKRYLAESFVAFFNRDYRRVALMHIESGWTPADTDVDAFEEAFRTVCEPIFAKPLAEISFGQVLLNLFNVARQFNMEVQPQLVLLQKTLLYIEGLGRQVYPALDLWQTAKPFLQKWLDQQVGFKAILRDLKQQAPQFREHFAQFPEAVFNALQQQKHINYRLAELNKTLQSQADNKTYNVKMIIMGSIILSLLWQFNSLPLWLSLPILTMLCLALCRRK

SEQ ID NO: 22654 - protein, 303 aa, Arabidopsis thaliana
MSHFGRSGPPDISDTYSLLVLNITFRTTADDLYPLFAKYGKVVDVFIPRDRRTGDSRGFAFVRYKYKDEAHKAVERLDGRVVDGREITVQFAKYGPNAEKISKGRVVEPPPKSRRSRSRSPRRSRSPRRSRSPPRRRSPRRSRSPRRRSRDDYREKDYRKRSRSRSYDRRERHEEKDRDHRRRTRSRSASPDEKRRVRGRYDNESRSHSRSLSASPARRSPRSSSPQKTSPAREVSPDKRSNERSPSPRRSLSPRSPALQKASPSKDMSPERRSNERSPSPGSPAPLRKVDAASRSQSPYAAE

SEQ ID NO: 22655 - protein, 103 aa, Coccidioides immitis RS
MTGRGKGGKGLGKGGAKRHRKILRDNIQGITKPAIRRLARRGGVKRISAMIYEETRTVLKSFLESVIRDAVTYTEHAKRKTVTSLDVVYALKRQGRTLYGFGG

SEQ ID NO: 22656 - protein, 609 aa, Glycine max
  misc_feature (251)..(251): Xaa can be any naturally occurring amino acid
  misc_feature (377)..(377): Xaa can be any naturally occurring amino acid
  misc_feature (390)..(390): Xaa can be any naturally occurring amino acid
  unsure (1)..(609): unsure at all Xaa locations
MAVRINCSIQNTLCLLNPPLFSLRYRASPLKLKPQLHFRQNPSRGALFCTCATTDITPHNTEPFVLTTPLYYVNAPPHMGSAYTTIAADAIARFQRLLGKKVIFITGTDEHGEKIATAAMAQGSTPPDHCNLISQSYMTLWKDLDISYDKFIRTTDSKHEAIVKEFYSRVLANGDIYRADYDGLYCVNCEEYKDEKELLDNNCCPVHLKPCVSRKEDNYFFALSKYQKALEDTLNKNPNFVQPSFRLNELXVQSWIKSGLRDFSISRASVEWGIPVPDDKTQTIYVWFDALLGYISALSDDQEQPDLLKTVSSGWPASLHLIGKDILRFHAVYWPAMLMSAGLSLPKMVFGHGFLTKDGMKMGKSLGNILEPNELVXKFGTDAVRYYLSXRECGIFGNDGDYSEERFINIVNAHLANTIGNLLNRTLGLLKKNCQSILVVDSTTAAEGNEFKDNVEKLVDKAHIHYENLSLSSACEAALEIGNVGNLYMDQRAPWSLFKQGGTAAEAAAKDLVIILETVRIIAIALFPVTPSLSWRIYAQLGYSRDQFDAATWRDTEWGGLKGGQVMAQPKPVFARIENQTEVEDKGVAVGKTKKSKAKPKQPQEVVGA

SEQ ID NO: 22657 - protein, 217 aa, Xanthobacter autotrophicus Py2
MTDTASDAPDPFLETGRLLFAGDWQFVTAAPTVEVLPPMVGMEIALAGRSNVGKSSLVNALTGRKALARTSVTPGRTQELIFFRVGPELSLVDMPGYGFAKAPKEKVEAWTHTIKAYLRGRVNLARVFVLIDSRHGIKPVDEEILDLLDKAAVSYAIILTKSDQVKPSALPHVIASVQEKIKRRPAAYPVVFPTSSQTGAGFPELRAAVARLLHEQG

SEQ ID NO: 22658 - protein, 59 aa, Triticum aestivum
KTDLAPAVGADLSVMERDALRMREGGPFVFAQVKHGVGVEGIVNHILQAWEIATGNKRR

SEQ ID NO: 22659 - protein, 360 aa, Gypsophila elegans
MVIATKVAPSRVETLASSGIECIPKEYVRPEEELTSIGDVFEEEKKDGGPQVPTMDLKDIASEDPEVRDKAIQELKKAAMEWGVMHIVNHGISEELITRVKVAGETFFEFPIEEKEKYANDQDSGNVQGYGSKLANNASGQLEWEDYFFHLAFPEAKRDMSIWPKAPADYIPAVSDYSKELRGLATRILSALSVGLGLEEGRLEKEVGGLEDLNLQMKINYYPKCPQPELALGVEAHTDVSALTFILHNMVPGLQLFYEGKWVTAKCVPNSIIMHIGDTIEILSNGKYKSILHRGLVNKEKVRISWAVFCEPPKEKIILKPLPDLVSDSDPARYPPRTFAQHIQHKLFRKAQDVQSPVTN

SEQ ID NO: 22660 - protein, 232 aa, Zingiber officinale
YHPNIVKLRAAYEDADAVHLVMELCEGGELFDRIVARGHYSERSAAAVLRTVAEVVRMCHANGVMHRDLKPENFLYANKKENSPLKAIDFGLSVFFRPGERFSEIVGSPYYMAPEVLKRNYGPEIDIWSAGVILFILLCGVPPFWAETEQGVVRAILRGMIDFQREPWPPISESAKSLLKQMLNPDPRRRLTAQQVLEHPWLQNAKKASNVPWGDIVRARLKQFSVMNRFKK

SEQ ID NO: 22661 - protein, 210 aa, Oryza sativa (japonica cultivar-group)
MASSPASSYDCSFKILLIGDSAVGKSSLLVSFVSASHIDDEIAPTIGVDFKIKFLTVNGKKLKLTIWDTAGQERFRGITSSYYRGAHGIILVYDVTKRESFTNLADVWAKEIELHSTNKECIKMLVGNKVDKNEERMVTREEGLAFAQESGCLFLESSAKTRENVEKCFEELALKILEVPSLLEEGSSVVKRNSLKQKHENKAKNGGCCQ

SEQ ID NO: 22662 - protein, 359 aa, Triticum aestivum
  misc_feature (44)..(44): Xaa can be any naturally occurring amino acid
  misc_feature (281)..(281): Xaa can be any naturally occurring amino acid
  misc_feature (306)..(306): Xaa can be any naturally occurring amino acid
  unsure (1)..(359): unsure at all Xaa locations
AGFAGDDAPRAVFPSIVGRPRHTGVMVGMGQKDAYVGDEAQSKXRGILTLKYPIEHGIVSNWDDMEKIWHHTFYNELRVAPEEHPVLLTEAPLNPKANREKMTQIMFETFSVPAMYVAIQAVLSLYASGRTTGIVLDSGDGVSHTVPIYEGYALPHAILRLDLAGRDLTDSLMKILTERGYSFTTTAEREIVRDIKEKLAYVALDYEQELETAKSSSSVEKSYELPDGQVITIGAERFRCPEVLFQPSIIGMEAPGIHETTYNSIMKCDVDIRKDLYGNIXLSGGSTMFPGIADRMSKEITALAPXSSMKIKVVAPPERKYSVWIGGSILASLSTFQQMWISRAEYEESGPAIVHRKCF

SEQ ID NO: 22663 - protein, 319 aa, Clostridium tetani E88
MRKIAVLTSGGDAPGMNAAIRAVVRTGLDKGITVLGIERGFDGLLNGEIFEMTRRSVADIIQRGGTILRTARSEEFKTEEGQKKATDILRVFGVEGLVVIGGDGSFQGAKSLSELGVKTIGIPGTIDNDLAYTDYTIGFDTAVNTVLDAINKLRDTSTSHGRASVVEVMGRNCGDIALYAGLAGGAESIIVPELRFDIDKLCKTILEGKKNGKMHNLIIVAEGAGKANDIAKTIEKVTGVGTRATVLGHIQRGGSPTANDRILASRMGNRAVELLLEEKSSRVVGINDNRIVDMDIHEALSIEGKFDEKLYEIAKALSY

SEQ ID NO: 22664 - protein, 508 aa, Chromobacterium violaceum ATCC 12472
MSKKQDAPELRRSLQARHLSMIAIGGSIGTGLFLASGATISGAGAGGALLAYALVGLMVYFLMTSLGEMAAFMPVSGSFQAYGSRFVDPAFGFAQGWNYWYNWAITVAVELAAAAIIMNYWYPGIPGVVWSGGFLAIIFALNYFSVKGFGEAEFWCSMLKVATIIAFIVIGFLMILGIMTEPNPSRIAPGLQVMMQGEGPFVGGLAAFVGVAMVVGFSFQGTELIGVAAGESANPGRTIPRAVRQIFWRILMFYMLSILIIGLILPHNDPSLLKNDMKDVGASPFTLVFNRAGLAFAASLMNAVILSAILSAGNSGMYASTRMLYAMAKNGMAPKVFGKLTDNGVPRNALYATTLVACLCFLTSLFQSNAVYMWLLNSSGMTGFIAWLGVAISHYRFRRAYVKQGYSLDDLPYKAKWFPLGPLFAFALCLLIMLGQNYTAFTAAKVDWNGVIATYLGIPLFLALWWGYRVKHNTRMVPLEKVELAEAHRNALMQREENRGGKPAAAQA

SEQ ID NO: 22665 - protein, 488 aa, Ralstonia eutropha JMP134
MIQTQLYIDGRWQSPLEGSTRDILSPADESVIAQAAEGTRADARIAIAAARRAFDGPWRQTTIRDRARLLNRIAALIDRDAEELARFESLNTGKTLTESRTDMGDIAATFRYFAGLVASESGAVNEAPHHVISRTLREPVGVCGLITPWNYPLLQAAWKIAPALGAGNTVIIKPSNLTPLTTHHFTKLIAELDLPAGVFNLVTGGAEVGAELAESRDVDLVSFTGGAFAGESIMKAATGNFKRIGLELGGKNPNIVFADADLDVAVDYALNAAFFHAGQVCSAGSRLMIEDSIYDAFVAKLAERLPRIAIGNGFHAETQMGPVQSAQQHEKILRMVQAGVAEGARLVYGGKRPEGDVYRKGYWLQPTLLADVTADMNIAKDEIFGPVVTAERFRSEDDALRAANDTPYGLAAAVWTRDLDKANRMSRALRFGTVWVNDYHPYFPEAPWGGYKASGIGRELARIGLDEYTELKHSYINLAPKAMGWFGA

SEQ ID NO: 22666 - protein, 222 aa, Yersinia pestis CO92
MNQIQCVMFDCDGTLVDSEVLCCQAYVLMFAHYNIHLSLEEVIKRFKGVKLYEIVGIVCKEYGLDQPIKVLEKLYREEVARLFDAELQPIAGVKALLEQIVLPVCVVSNGPVSKMQHSLGLTGLLPFFEDRLYSSYDIQRWKPDPALIYHAAEHMQVAAEHCILIEDSAAGAQAGIAAGIPVFYYCADPHNQPINHPLVTTFTDIQQLPHLWKERGWHITRD

SEQ ID NO: 22667 - protein, 454 aa, Haemophilus ducreyi 35000HP
MTITTPIKAVLASNQHFLDRQDKMESNVRSYPRKLPFAYAKAQGCWVTDVEGNEYLDFLAGAGTLALGHNHPILMQSIKDVLDSGLPLHTLDLTTPLKDAFTEELLSFFPKDEYILQFTGPSGADANEAAIKLAKTYTNRGNIIAFSGGFHGMTHGALSLTGNLGAKNAVQNLMPGVQFMPYPHEYRCPFGIGGEAGAKAVERYFENFIEDIESGVVKPAAVILEAIQGEGGMVPAPISFLQKVREVTQKHGILMIVDEVQAGFCRSGKMFAFEHAGIAPDIVVMSKAIGGSLPLAVLAIKKQFDAWQPAGHTGTFRGNQLAMATGYASLKIMRQENLAQNAQARGEYLTNALRELSKTFACIGNVRGKGLMMGIDIVDERQAQDATGAYPQDCELAIAIQKCCFNNKLLLERGGRGGNVVRVLCPVNINQAECEEFIKRFTQSVADAIKAVRG

SEQ ID NO: 22668 - protein, 506 aa, Xanthobacter autotrophicus Py2
MNIPAFLASQHASPFKPRYGNFIGGAFVEPVNGRYFENISPITGKVVCEVPRSDEADIERALDAAHAAKKAWGRTPAADRALVLLKIADRLEANLDLLARAETWDNGKPIRETTAADIPLAIDHFRYFAACVRAQEGALSEIDHDTVAYHYHEPLGVVGQIIPWNFPILMAAWKLAPALAAGNCVVLKPAEQTPASILVLAELIADILPPGTLNIVNGFGLEAGKPLASSTRISKIAFTGETGTGRLIMGYASQNLIPVTLELGGKSPNIFFDDVAAKDDDFLDKAVEGFVMFALNQGEVCTCPSRALVQESIFEKFMEKALARVAAIKQGSPLDPATMIGAQASSEQMHKILSYIDIGRAEGAQVLAGGERSLLDGDLSEGFYVKPTVFFGTNNMRVFQEEIFGPVVSVATFKDEEEALSIANDTLFGLGAGVWTRDGSRAYRMGREIQAGRVWTNCYHAYPAHAAFGGYKQSGIGRETHKMMLDHYQQTKNLLVSYSPKKLGFF

SEQ ID NO: 22669 - protein, 433 aa, Roseovarius nubinhibens ISM
MKMAEPGKTAKLEIDGKTYELPVFTPTAGPDVIDIRKLYGQAGVFTYDPGFTSTASCDSTITYIDGGKGELLHRGYPIDQLAEKSHYLEVCYLLLYGELPSTAQLEDFESRVTNHTMLHEQMHFLFRGFRRDAHPMAIMVGVVGALSAFYHDSTDINDPWQREVASIRMIAKMPTIAAMAYKYTIGQPFVYPRNDVDYASNFLRMCFAVPAEDYEVNPILSRAMDRIFTLHADHEQNASTSTVRLASSSGANPFACIAAGIACLWGPAHGGANQACLEMLREIGSVDRIPEFIARAKDKDDPFRLMGFGHRVYKNFDPRAKVMKQSADEVLDLLGVEDNPTLQVAKELEKQALADPYFAEKKLFPNVDFYSGIILEAMGFPTSMFTPIFALSRTVGWISQWKEMIADPQLKIGRPRQLYQGETFRDYVDMENR

SEQ ID NO: 22670 - protein, 163 aa, Coprinopsis cinerea okayama7#130
MVLLTTSDNEQFNADREVVERSVLIKNMLEDVGESDQAIPLPNVSSAVLKKVLEYCEHHRGEPLPSADAEQNQDETRKRTTDISEWDQKFISVDQEMLFEIILAANYLDIKSLLDVGCKTVANMIKGKTPEEIRKLFNIVNDFTPEEEAQIKKENASEWAEDR

SEQ ID NO: 22671 - protein, 253 aa, Zea mays
MGRKFFVGGNWKCNGTTDQVEKIVKTLNEGQVPPSDVVEVVVSPPYVFLPVVKSQLRQEFHVAAQNCWVKKGGAFTGEVSAEMLVNLGVPWVILGHSERRALLGESNEFVGDKVAYALSQGLKVIACVGETLEQREAGSTMEVVAAQTKAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 22672 - protein, 734 aa, Bacteroides fragilis YCH46
MDSILFWLVPFASVLALCFALYFHKQMMKESEGTPQMIKIAAAVRRGAMSYLKQQYKIVGWVFLGLVILFSVMAYGFQVQNAWVPIAFLTGGFFSGLSGFLGMKTATYASARTANAARTSLNAGLRIAFRSGAVMGLVVVGLGLLDISFWYLLLNWAIPADVLTPTHKLCIITTTMLTFGMGASTQALFARVGGGIYTKAADVGADLVGKVEAGIPEDDPRNPATIADNVGDNVGDVAGMGADLYESYCGSILATAALGAAAFIHTGDTVMQFKAVIAPMLIAAIGIILSIIGIFSVRTKENATMKDLLGSLAWGTNLSSALIVAATFFILWLLQLDNWMWISCAVVVGLVVGIVIGRSTEYYTSQSYRPTQKLSESGKTGPATVIISGIGLGMLSTAIPVVAVVIGIIASYLLASGFDFNNVGMGLYGIGIAAVGMLSTLGITLATDAYGPIADNAGGNAEMSSLGKEVRKRTDALDSLGNTTAATGKGFAIGSAALTGLALLASYIEEIRIGLTRLGNLVLTFPNGDTISTANATFVDFMNYYEVNLMNPKVLSGMFLGSMMAFLFCGLTMNAVGRAAGHMVDEVRRQFREMKGILTGETEPDYERCVAISTKGAQREMVVPSLIAIIAPILTGLIFGVPGVLGLLIGGLSSGFVLAIFMANAGGAWDNAKKYVEEGNFGGKGSEVHKATVVGDTVGDPFKDTSGPSLNILIKLMSMVAIVMAGLTVAWSLF

SEQ ID NO: 22673 - protein, 121 aa, Zingiber officinale
LSPMASSSATMVVSCARSSSGMVAPFSGLKSLSGVPFPTKRANAHLSHLPSNGCRVRCMQVWPIEGKKKFETLSYLPTLKDEALLKQIEYLLRSNWIPCLEFCKRGFVWRRTTKVLMAENT

SEQ ID NO: 22674 - protein, 294 aa, Helianthus annuus
MEQYEKVEKIGEGTYGVVYKARDKVTNETIALKKIRLEQEDEGVPSTAIREISLLKEMQHGNIVRLQDVVHSDKRLYLVFEYLDLDLKKHMDSCPEFSKDPRLVKTFLYQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRIMGTPNEETWPGVTSLPDFKSAFPKWSSKDLATVVPNLEKTGLDLLRKMLCLDPSKRITARTALEHEYFKDIGFVP

SEQ ID NO: 22675 - protein, 372 aa, Zea mays
MDSSGGGGGAQIKGMATHGGRYVLYNVYGNLFKVSSKYAPPIRPIGRGAYGIVCAAVNSQSGEEVAIKKVGNAFDNHIDAKRTLREIKLLRHMDHENIPALKDVIRPPTRENFNDVYIVTELMDTDLHQIVRSNQPLTDDHCQYFLYQLLRGLKYVHSANILHRDLKPSNLFLNANCDLKIADFWLARTTSETDLMTEYVVTRWYRAPELLLNCSQYTAAIDVWSVGCILGEIVTRQPLFPGRDYIQQLKLITELIGSPDDASLGFLRSDNAKRYMEQLPQFPRQDFRLRFRNMSPGAVDLLERMLVFDPSRRITVDEALHHPYLASLHEINDEPTCPAPFSFDFEHPSFTGAHIKELIWRESLAFNPEPPY

SEQ ID NO: 22676 - protein, 243 aa, Clostridium acetobutylicum ATCC 824
MRKLVLLRHGQSEWNKENRFTGWTDVDLSVDGVSEAAQAGRILKKNNYTFDAAYTSVLKRAIRTLQIVLYEMDLLWIPVYKSWKLNERHYGALQGLNKDETRDKYGEDQVHLWRRSVEVRPPALEKSDKRYPGNEKKYASLKEEELPVTENLEDTEKRVLQDWRELIAPNIKGGKNIIISAHGNTLRALVKYLDNIPSDGIANLNIPTGTPLVYELDENLEPITRYYLGMDGKIEDDKFPKKV

SEQ ID NO: 22677 - protein, 504 aa, Bacteroides fragilis YCH46
MSKKALLMILDGWGLGDHGKDDVIFNTATPYWDYLMETYPHSQLQASGENVGLPDGQMGNSEVGHLNIGAGRVVYQDLVKINLSCRDNSILKNPEIVSAFSYAKENGKNVHFMGLTSDGGVHSSLDHLFKLCDIAKEYNIENTFVHCFMDGRDTDPKSGKGFIEQLEAHCAKSAGKVASIIGRYYAMDRDKRWERVKEAYDLLVNGIGKKATDMVQAMQESYDEGVTDEFIKPIVNAGVDGTIKEGDVVIFFNYRNDRAKELTVVLTQQDMPEAGMHTIPGLQYYCMTPYDASFKGVHILFDKENVANTLGEYLAANGKKQLHIAETEKYAHVTFFFNGGRETPYDNEDRILVPSPKVATYDLKPEMSAYEVKDKLVAAINENKYDFIVVNYANGDMVGHTGIYEAIEKAVVAVDACVKDTIEAAKAQGYEAIIIADHGNADHALNEDGTPNTAHSLNPVPCVYVTENKEAKVADGRLADVAPTILHILDMVQPAEMTGCNLIK

SEQ ID NO: 22678 - protein, 601 aa, Oryza sativa (indica cultivar-group)
MEVRRRAPLPPPPGRVQAGDALPLPIRHTNLIFSALFAASLAYLMRRWREKIRSSTPLHVVGLAEMLAIFGLVASLIYLLSFFGIAFVQSIVSSSDDEEEDFLVGPARGSSAAAAVAPPPPPSSPAQLLAAGSPPTCLDDQARGLPAAAAGIRREAVRRITGRQIEGLPLDGFDYASILGQCCELPVGYVQLPVGIAGPLLLDGQRFYVPMATTEGCLVASTNRGCKAIAESGGAVSVVLRDGMTRAPVARLPTARRAAELKAFLEDSVNFNTLSMVFNRSSRFARLQGVQCAMAGRNLYMRFSCCTGDAMGMNMVSKGVQNVLDYLQDDFPDMDVISISGNFCSDKKPAAVNWIEGRGKSVVCEAVIKEDVVKKVLKTNVQSLVELNVIKNLAGSAVAGALGGFNAHASNIVTAIFIATGQDPAQNVESSHCITMLEAVNDGRDLHISVTMPSIEVGTVGGGTQLASQAACLDLLGVKGANRESPGSNARLLATVVAGGVLAGELSLLSALAAGQLVKSHMKYNRSSKDMSKRSRAHQTKVKDSEVYGDIVMAADADTNSSCSEAMVGRYWTTGGRRASLVASRSCPLSSFALVITFALF

SEQ ID NO: 22679 - protein, 220 aa, Acidovorax sp. JS42
MTTASIDELFAHNREWAERMERDRPGFFTGLLAQQKPRYMWIGCSDSRVPANQITGLEPGEVFVHRNIANVVVPTDLNCLSTIQYAVDQLKVEHLMVVGHYGCGGVLAALQDARIGLADNWIRHVKDVRDKHAALLEDMDVQWRHDALCELNAIEQVMNIAHSTVMQDAWARGQKVQLHGWCYSLNNGLITNLQMSVPDVAGLGEAHRQAVALVASRVRQ

SEQ ID NO: 22680 - protein, 495 aa, Zea mays
MRRATLSLALGLSLIALLAARGADASIHEYAGGGFAPRANSFFFHGGSEGLYASDLLSNSSSFIRFDSIVFRRTLESASRHEEMQQKTGLVEAIIVEIQDRDKIGGSYLHSDAICCTPELDKEKSCRVGEVIIRPNPENPDWPKRIQTFFDGKNEETTMVTQIVSINKTGMYYLYFMFCDPQLKGLKVTGRTVWRNPQGYLPGKMAPMMTFYGVMSLAYLALGLLWFIQFVRCWKDILQLHYHITTVIALGMCEMAFWVFEYANFNSTGTRPIGITLWAVTFTAVKKTVSRFLLLVVSMGYGVVLPTLGGITSRVAALGFIYFVASEALELVENLGNINDFSGKTRLFLVLPVAVLDATFIIWIFSSLSRTLEKLQLRRSMAKLELYRKFTNSLAVSVLISIAWIGYELYFNATDPLSELWQRAWIIPSFWNVLSYALLVIICILWSPSRNPTGFAYSEDAGEGADEEGLSLVGSAVKGTGDMVNMHIFPEDKRA

SEQ ID NO: 22681 - protein, 512 aa, Burkholderia xenovorans LB400
MSFVSAVLYDMRQESFSMTGHLPKLSMYIGGEWVEPASGEYFETVDPFTAKPWALIPRGNAEDADRAIRAADKAFRDGPWRAMHPSERGLVLQRFGQLIGQHADELAGIEVRDNGRLLAEMRHQIRGIPKWYYYYGGLADKIEGAVHPVEQPALSFTRHEPLGVCVGIVPWNAPLLLLSLKAAPALAAGNTIVLKPAEFTSASALKLMELVEQAGFPPGVVNVVTGFGKEVGEPLVAHPLTRHLGFTGSTATGSHLYALAAKDVKRASLELGGKSANLVFNDADLNNAVRGVVGGIFGAVGQTCIAGSRLLVQRRIHDEFVDKLAAFTKTARIGDPRKPETQIGPIANRMQYNKILGYIDIAREEGAELVMGGARPDIAECGEGFFIEPTIYTGIRNDMRIAREEVFGPVLATIPFDDPEEAIAIANDSDFGLGAGVWTSDMRLALRMSERLEAGSVWINTYRDISYTTPFGGYKKSGIGRENGIEGIREYLQTKAVWISTAEEIENPFVIG

SEQ ID NO: 22682 - protein, 197 aa, Brassica napus
  misc_feature (154)..(154): Xaa can be any naturally occurring amino acid
  unsure (1)..(197): unsure at all Xaa locations
MALLRLPPISLQYLGHKSEQKTPNPGVSLTNFSLTWSTPSLSRLHLAKPRNLTSYSFATTQEPILEPSSSSEEISKTRLIAQNVPWTSTPEDIRSLFEKSGSVVDVEMSMHKKERNRGLVFIEMASPEEAASALQALESYEYKGRRLKVAYAKXQKKKKTYAPREKPTPVPTFNLFVANLAFEARAKHLKEFFDADT

SEQ ID NO: 22683 - protein, 436 aa, Rickettsia typhi str. Wilmington
MTNGNNNNLEFAELKIRGKMFKLPILKASIGKDVIDISRVSAEADCFTYDPGFMSTASCQSTITYIDGDKGILWHRGYDIKDLAEKSDFLEVAYLMIYGELPSSEQYHNFTTKIAHHALVNERLHYLFQTFCSSSHPMAIMLAAVGSLSAFYPDLLNFNETDYELTAIRMIAKIPTIAAMSYKYSIGQPFIYPDNSLDFTENFLHMMFATPCTKYKVNPIIKNALNKIFILHADHEQNASTSTVRIAGSSGANPFACISTGIASLWGPAHGGANEAVINMLKEIGSSENIPKYVAKAKDKNDPFRLMGFGHRVYKSYDPRAAVLKETCKEVLNELGQLENNPLLQIAIELEALALKDEYFIERKLYPNVDFYSGIIYKAMGIPSQMFTVLFAIARTVGWMAQWKEMHEDPEQKISRPRQLYTGYVHREYKCIVERK

SEQ ID NO: 22684 - protein, 572 aa, Aspergillus fumigatus
MPFHSRYHVDIPNIHLASLLLKSPTHPLSSTHRCFSEAARPNTHYFTTHDFRLWSQRFAAGLRKAGLQPGDRVLLFSGNDLFFPVVFMGIIMAGGIFTGANPTFVARELAFQLQDSGASFLLCADVSLDVGIEAAQIAGLSRDRVFVFNNAIFDGQGEGRKGCRYWGQLVASVEEGREFVWDELSTPEEADRTLALNYSSGTTGRPKGVEITHKNYVANMLQYNYMFYLNPDWKERSARARWLCFLPMYHAMAQNIFIAAALSREVPVYIMPKFDFIKMLEYVEKFRISDLILVPPVVVALAKHPAVKSGKYVLSSVETIGSGAAPLGREVCEEVEALWPPGRINVKQGWGMTEYGFLDFDCEETTCSILGWNPTEKSYSASVGELNANCEAKIMADDGVTEYGHNQRGELWVRAPNIMKGYWKNPQATEETKTADGWLKTGDIAYVDDNGRFHVVDRKKVKGNQVAPAELEALLLEHPAVADVAVIGVQVYLNRNDDERPRAYIVLKPGHNAAANDIVAFMDGKVSAIKRITGGVVFVDAIPKNPSGKILRKVLRERAKEETQKNGVTAKL

SEQ ID NO: 22685 - protein, 1067 aa, Clostridium perfringens SM101
MPLNKDIKKVLVIGSGPIIIGQAAEFDYSGTQACQALKEEGIEVVLVNSNPATIMTDKEIADKVYLEPLTVEFVEKVIEKERPDSLLAGMGGQTGLNLAVELYEKGILDKYNVKVIGTSIESIKEGEDRELFRDMMNRINQPVIQSEIITDLDSGIAFARKIGYPVIVRPAYTLGGTGGGIANNEEELIETLTSGLQLSTIGQVLLEKSVKGWKEIEYEVMRDSFGNCITVCNMENIDPVGIHTGDSIVVAPSQTLSDKEYQMLRSASIDIINAVGIKGGCNVQFALNPHSFEYAVIEINPRVSRSSALASKATGYPIAKVAAKIALGYGLDEIKNAVTGMTYACFEPSLDYVVVKIPKWPFDKFQGADRVLGTKMMATGEIMAIGSNFEAAFLKGIRSLEIGKYSLEHKKFKDLSMYELRERVVSPDDERIFALAEMLRRGYRIDMVSKITGIDIFFLEKFRWLVEEEQKLKQSTIDDLNREWLLKLKRRGFSDKAIADMLKVSPDEIYRLRDIWHIKPSYKMVDTCGGEFEALSPYYYSTYEQYDEVVVSDNKKVVVIGSGPIRIGQGIEFDYASVHCVMALRKQGIETIVINNNPETVSTDFSISDKLYFEPLTEEDVLNIIDKENPDGVILQFGGQTAIKLAKFLKEKNIPTLGTTSDQIDLAEDREQFDDLLERLNIARPKGKGVWSLEEGLEEARRLGFPILVRPSFVLGGQGMEITHDEEELTYYLTNAFEKDSKNPILIDKYLMGREIEVDAISDGEDVLVPGIMEHLERAGVHSGDSITMYPAQNISDKIKEDVLDYTKKLALSIGIKGMINIQFIEFEGKLYVIEVNPRASRTVPYISKVSGVPIVDIATRIMLGEKLKDLGYGTGVYKEPELVSVKVPVFSTQKLPNVEVSLGPEMRSTGEVLGVGRNVFEALYKGFVGASMYTGDKGKTILATIKKHDKKEFMELSKDLDKLGYNFIATTGTANELREAGIDAKEVRRIGEESPNIMDLIKNKEIDLVVNTPTKANDSKRDGFHIRRAAIERNIGVMTSLDTLKALVELQKEGAHNRELEVFNLI

SEQ ID NO: 22686 - protein, 938 aa, Kluyveromyces lactis NRRL Y-1140
MTQSLPLLNGTEAYKLVTTQGLYDKTVKFYEKYLQLVHDKRVGTLTNSLITLKLVVDNSFKPLDVVNDKDWRAIVSSALVFSCTNIQHFRDLAAGETIQAYPNETNPIEIYLKDPNGYIIGITETKNAISIKPTLPKQSVEASLISSRSSRIDIASSGVSTDSSYPAIPKTAKAQKSIAVMTSGGDAPGMNANVRAIVRTAIFKGCNAFVVMEGYEGLVKGGPNYIKQVYWETVRNWSCEGGTNIGTARCKEFREREGRLLGALHLIEAGVDALIVCGGDGSLTGADLFRSEWPSLIRELLDQGRINKVQFDRYQHLNICGTVGSIDNDMSTTDATIGAYSALDRICQAIDYIEATANSHSRAFVVEVMGRNCGWLALLAGISTSADYILIPEKPASSREWQDQMCDIISKHRSRGKRTTIVIVAEGAISADLTPISSKDVHKVLVDRLGLDCRITTLGHVQRGGTAVAYDRILATLQGVEAVNAVLESTPDTPSPLIAINENKITRKPLVESVQLTKSVAEAIHSKDFKKAMQLRDSEFVEHLDNFMAINSADHIEPKLPEHTHMKIAIVNVGAPAGGMNSAVYSMATYCMSQGHKPYAIYNGWTGLTRHESVRSLNWKDLLGWQSRGGSEIGTNRHTPEEADIGLIAYYFQKYGFDGIIIVGGFEAFVSLHQLERARENYTAFRIPMVLIPATLSNNVPGTEYSLGSDTALNSLMQYCDIIKQSAASTRGRVFVVDVQGGNSGYLATHAAVAVGAQVSYVPEEGISLEQLTQDIENLTESFSEAEGRGKFGQLILKSTNASKVLTPEVLAEVITQEAEGHFDAKCAIPGHVQQGGLPSPIDRTRGTRFAIRAVGFIESQHKVLAAEANLDDDDFDFDTPKIIATASVLGVKGSDIVFSSIRQLYDFETELNKRTPKTIHWQSTRTIADHLVGRKKL

SEQ ID NO: 22687 - protein, 73 aa, Bacillus subtilis
LGHIQRGGSPSAADRVLASRSRAYAVELLLEGKGGPCVGIQNNKLVDHDIIEILETKHTVEQNMYQLSKELSI

SEQ ID NO: 22688 - protein, 898 aa, Coccidioides immitis RS
MSINTSGSGNWPDPPEQSSSRAAEQSNNDDASGYDVLNNTVRASPTTAAESLSEPSVIRLVQLVLLRLTIISRISFKRKQKTPVRFGLYNPFSWNSPPAARSPSRPGSSQNANEEALRDIPASSPPGSRQNGVDAGNKVGGPLDWYIEGPGRRVGYDNLTAIDWIFEYTKERQRIRHLRSGGKGVLGHLRQLLDAGHVWAVLIATGIVVGVLAACIDIASSWLGDLKVGFCQSGEEGGRFYLNKSFCCWGYEDLSQCRHWTPWSKALHVGSKGGGYVVEYIFFTFYSILFAGIASFLVTSYAIHAKHSGIPEIKTVLGGFVIENFMGIWTLMIKSLGLCLSVASGMWLGKEGPLVHVACCCANIIMKPLDSLNHNEARKREVLSAAAAAGISVAFGSPIGGVLFSLEQLSYYFPDKTMWQSFVCAMVAAVTLHALDPFRTGKIVLYQVEHSQGFHRFEIFPFIFLGILGGLYGGLFIKLNMRVARWRKSRRVSFPVLEVLIVALITAVVNFPNILMRVQLSELVYYLFADCKEIPNNPLGLCKTGVSSLGVVGLLLSAAALGFFLAIFTFGLDIPAGIILPSLAIGALYGRAVGIVFDVWQKKHPKFFLFANCEPDVPCVTPGMYAIIGAASALGGATRMTVSIVVIMFELTGALNYAIPIMIAVMLSKWCGDTFGKRGVYESWIHLNDYPFLDQKDDTPPPDIPVSQVMTNVNDLTLITAVGHTIESLTNLLKTTSYRGYPVVSDTANPLLLGYISRNELSYALKTATSRTSHNLTPETQAYFSHQPFADPLETLDLRPWMDQTPITMNSRASFQIVLNMFQRLGLRYVLFVNRGVLEGFLTKKDVWYILEGVRNRRNEGFEDVVLGEGQTEEQQGLLHASADHLPEYSHIERRTSL

SEQ ID NO: 22689 - protein, 356 aa, Solanum lycopersicum
  misc_feature (200)..(200): Xaa can be any naturally occurring amino acid
  unsure (1)..(356): unsure at all Xaa locations
GLWAGLIIGFVTEYYTSNAYSPVQDVADSCRTGAATNVIFGLALGYKSVIIPIFAIAISIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRXQFNTIPGLMERTAKPDYATCVKIFTDASIKEMIPPGALVMLTPLIVGILFGVETLSGVLAGSLVSGVQIAISASNTGGAWDNAKKYIEAGASEHARTLGPKGSDAHKAAVIGDTVGDPLKDTSGPSLNILIKLMAVESLVFAPFFATHGGLLFKLF

SEQ ID NO: 22690 - protein, 171 aa, Gloeobacter violaceus PCC 7421
MDLKDYIRTVPDFPEPGILFRDITTLLHEPKALRYTIDSLAEQTGSLGADYVVGIESRGFMFGTPLAIKLDCGFVPVRKPGKLPAAVFKEEYTLEYGKNALEIHQDAFAAPSRVLVVDDLLATGGTAVAAAQLVERAGGTVVGFGFIIELTFLNGRAKLPEGPSAVALVSY

SEQ ID NO: 22691 - protein, 140 aa, Solanum pimpinellifolium
ALFGAFVSRAAISTVDVLTPKVFIGLLVGAMLPYWFSAMTMKSVGSAALKMVEEVRRQFNTIPGLMEGTAKPDYATCVKISTDASIKEMIPPGALVMLTPLIVGILFGVETLSGVLAGSLVSGVQIAISASNTGGAWDNA

SEQ ID NO: 22692 - protein, 450 aa, Aspergillus nidulans FGSC A4
MVMAPTACVPAEVCMPKLYDKPDFYVNNIHQFSNHGADDLSQSRLAAKDLVLNVLKKRAAEVDTDRCAPGEEDAFYVADMGEVYRQHLRWKMNLSRVRPFYELAVKCNPDPEVLRLMAKLGNGFDCASKAEIDMALSTGVDPSRIIYAQPCKTKSYLRHAAKVGVKQMTFDNADELYKIKACYPEAELYLRILTDDSNSLCQFSMKFGASLDVARQLLELAHQLELKIVGVSFHVGSGAEDPKAFLKAVQDARLVFDQAAEIGHELHTLDVGGGFTGETFEKFAAVLDSALETYFPPNIRIIAEPGRYYVGGAFTLAANIIARRGVQDPENPSKDAYMIYLNDGVYGNFSNIIFDHQHPEARILSCASEINGRPVSEDVTYSIWGPTCDGIDVISQRSVLPGLLDVGDWLYFEEMGAYTRCSATRFNGFSDNHEVIYISSEAGASALLEY

SEQ ID NO: 22693 - protein, 130 aa, Idiomarina loihiensis L2TR
MSKVIISTDKAPAAIGTYSQAVKIGTTVYLSGQIPLVPESMELVSEDFTAQAEQVFKNLTAVCEASGGELQDMIKVQIYLTDLGQFAIVNEVMAKHFREPYPARAAIGVKQLPKGAQIEIDGIMELPSTY

SEQ ID NO: 22694 - protein, 223 aa, Zea mays
MGKGKVHPSPPPAAAAAAAGGGAGETTAEAVLMRLMPAAVLAAAAPLGAEGKEVLAYLVLASLRSSAPPTPARGDGHRPELGCGCFGCYTAYWSRWDGSPEGDREAIHRAIEAFEEHLAEEEKGRGKGGGPRRGRKKRAEGKGRWKVKKEKEVEVGVDPLPPPSDLPAPEEAPKAEDGAEYLTAEDEKEEDAPTAAAGAEDEKRRRWWGSVLSWKAWGLWGSH

SEQ ID NO: 22695 - protein, 301 aa, Heterosigma akashiwo
MKFVAVLVCLMVSAVVAFKTQRNVPSMVNGKQIAAAALAAGTALAPMSAFAITKAESNSLDYLQVKGTGLANRCSEVIGTDSITISGKKQLVDLCIEPKTFQVEEEKVAKSGSIQKAFVNTKLMTRQTYTLDGISGTISSKDGKIVFTEEDGIDYAASTVQKPGGERVPFLFTVKELVATASTSGDKIAPGFQMGGKFTVPSYRTGLFLDPKGRGMSTGYDMAVALPGKQSGVEGDAELFKENNKVFDVLGGQIEFEVNRVNAEEGEIGGVFVSTQASDTDMGGKEPQTILLKGIFYGRIE

SEQ ID NO: 22696 - protein, 486 aa, Azoarcus sp. EbN1
MTLALNDPDLFRSRCLVGGTWADADSGATIAIHNPATGEQLGTIPKMGAAETRRAIDAASRAWPAWRALTAGARARVLRKWFDLIVEHQEDLALLMTSEQGKPLGEARGEVLYAASFVEWFAEEAKRIYGDVIPGHQPDKRIVVTKEPVGVCAAITPWNFPLAMITRKAGPALAAGCTMVLKPATQTPYSALALAVLAERAGVPAGVFSVLTGSATEIGGELTANPIVRKLTFTGSTEVGIKLAAQCAPTIKKLSLELGGNAPFIVFDDADLDAAVDGALASKYRNTGQTCVCANRLLVQDSVYDAFAEKLTAAVAKLKVGNGVDEGVTQGPLIDMRAVEKVEEHIADALAKGARVVTGGGRHALGRTFFEPTILADVTPQMKVAREETFGPVAPLFRFKDEAEAIRMANDTEFGLAAYFYSVGMNRVWRVSGALEYGIVGINTGIISTEVAPFGGMKSSGLGREGSKYGIEDYLEIKYLCMGGVQ

SEQ ID NO: 22697 - protein, 356 aa, Verticillium fungicola
MSRANPPNNASASRKISFNVSEQYDIQDVVGEGAYGVVCSAIHKPSGQKVAIKKITPFDHSMFCLRTLREMKLLRYFNHENIISILDIQKPRGYDSFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 22698 - protein, 1477 aa, Debaryomyces hansenii CBS767
MGVDSISNANDGATISSSINEYYGADQEAVEQNDRLELVRSITSGNSRDVLDRLETLSREMSRRTTRDGRIEIDPNNFDLHKILLSFIETSKSQGIKLRNSGVSFKDLTVYGVDESFSVAVTVYDLMKGPIGGIQRAMAKRKIQDRKIVSNVNGYARSGEMVLVLGRPGAGCSSLLKAIGGTDLDLFTGVDGDIRYDGITQKEMLKNFKNDLVYVPELDVHFPHLTVEQTLRFAIACKTPELRVNDVSREKFIDALKEILATVFGLRHTYHTKVGNDFVRGVSGGERKRVSIAEALACRGSIYCWDNATRGLDASTALEYAHAIRTSTNLLKNTAFVAIYQASENIYETFDKVTVLYKGRQVYFGPVMEAKKYFEDMGYECPARQSTAEFLTAVTDPIGRYAKPGMGNKVPSTAEEFEDYWLKSEQYRILQQEIQEYNDSINEDETRKGYYHSLKQEKMKYLRTNSKFTINYLQQLKLCTTRGFQRLWGDKAYTITQLVAAISQGLIAGSLYYNTPDSVSGAFSRGGVIFFAALYVSLMGLAEVSASFNSRSILMKQKNYSMYHPSADALASVVTSIPVTLVVTFLFVLIIYFLSNLAADAGKFFTCVLFVFLLSLTMSGLFEAVASLNKTISGANAIAGVLVLASLMYSSYMIQRPSMHPWFKWISYINPVLYAFEAIIATEFHGRKMECDGMYLTPSGPGYENLSQGSQVCAFKGSVPGQSWVSGDNYLKVAFTYSFSHVWRNFGIMIGFLVFFTCVKALGVEFIRPISGGGDRLMFLRGKVPDSIVLPQDKGQTPGDLETSSSSSNTLEKTNVNSEDKLKIFKNLKSRDVFVWKDVNYVVKYDGGDRKLLDSVSGYCIPGTLTALMGESGAGKTTLLNTLAQRIDVGVVTGDMLVNGKPLDLSFRRRTGYVQQQDIHVELLTVRESLIFSARLRRINDADDAEKLDYVEKIIKALDMEDYADALVGKTGDGLNVEQKKKLSIGVELVAKPSLLLFLDEPTSGLDSQSAWAVVKLLRELSNAGQSILCTIHQPSATLFEEFDRLLLLKKGGQTVYFGDIGDHSNAIVSYFEGNGARKCDDHENPAEYILEAIGAGATASVTQDWFETWCNSPEKRASDIERDRLIEELSKQVEDVHDPKEIKQLRSTYAVPYWYQFIIVVRRNALTFWRNPEYIMSKIMLMTMAGLFIGFTFFGLKHSVTGMQNGMFAGFLAVVVSAPVINQIQEHAIKGRDLFEGREKLSNTYHWSLMVIAQCINELPYLIFGSTIMFVSLYFPTQADPSPSHSGMFYLTQGIFLQGFVVTFGLLILYIAPDLESAAVLTSFFYTFVVAFSGVVQPVNLMPGFWTFMNKASPYTYFIQNLITAFLHGRKVHCSDVELAYFNPPSGQTCQQFAGDFVKARGGYLSEPQATKECGYCTYSIADEYLSSVGAEFSNRWRNIGFYCVYIAFNLCFVLALYWLFRFRKGSIFSIFKRNN

SEQ ID NO: 22699 - protein, 502 aa, Clostridium tetani E88
MYMIIGDSFTTKEIDEYCINNLSVPGIVLMENAAIKILKHLDLHKNQCFLIIGGRGNNGGDAFALGRHLLAHGEKVEIFLIGGQKGMSEDCSINYNILKNLDVNINLIDNIKDIEDLRNSIKKSNIVVDGIFGTGLTRKVEGIYDDVISVINENSDYTVSIDVPSGLNCNTGEILGNCIIAQKTISLMTYKKGFLNYTTENYTGEIIVENISVPYNSIKNICKNEFILGEEFVRKNLKIRSKYGHKGNYGRTLIVAGNEGFTGAAYLATEGAVKSGAGLVTLSTHEKIKDILSCKLNEAMIASVENKDEFYRLLINSDSIAIGPGLRNNDDTFELVKEVINKSNCPIVIDADGINCLKNHLYLMKDKKNSIILTPHPGEMSRLTGLSIKEINERRIDIAKDFARKNEVIILLKGYNTVITDGDKTFINSTGNSAMASGGMGDTLTGIIASFLAQGYNPLEAASMGAFLHGYCGDKLSKNMYSVNAREVLNIFPCIMKKFQSN

SEQ ID NO: 22700 - protein, 105 aa, Triticum aestivum
IFLNNIIIITHFLSIFFLLFLKKWERRRAWAWDIVVDNCAICRNHITDLCIECQANQASATSEECTVAWGVCNHAFHFHCISRWLKTRQVCPLDNSEWEFQKYGH

SEQ ID NO: 22701 - protein, 331 aa, Matthiola incana
QKRSEIYTYEAPWHIYAMNWSVRRDKKYRLAITSLLEQYPNRVEIVQLDESNGEIRSDPNLSFEHPYPPTKTIFIPDKECQRPDLLATSSDFLRLWRIADDHSRVELKSCLNSNKNSEFCGPLTSFDWNEAEPRRIGTSSTDTTCTIWDIEREAVDTQLIAHDKEVFDIAWGGVGVFASVSADGSVRVFDLRDKEHSTIIYESSEPETPLVRLGWNKQDPRYMATIIMDSAKVVVLDIRFPALPVVELQRHQASVNAIAWAPHSSCHICTAGDDSQALIWDISSMGQHVEGGLDPILAYTAGAEIEQLQWSSSQPDWVAIAFSTKLQILRV

SEQ ID NO: 22702 - protein, 170 aa, Trichodesmium erythraeum IMS101
MELKNLIREIPNFPKSGIIFRDITTLLSNTDGLHYTIDILTEKCLEFKPDYVVGIESRGFIFGMPLAYQLNVGFIPVRKPGKLPAEVYSVSYDLEYGQDSLEVHQDAMPAGSRVLVIDDLLATGGTAGATTQLIEKAKCNLVGFAFVIELKELGGREKLPKVPIISLIEY

SEQ ID NO: 22703 - protein, 237 aa, Zea mays; identical to SEQ ID NO: 1335

SEQ ID NO: 22704 - protein, 196 aa, Candida glabrata CBS 138
MEMEEVSVVEECRRELRSALHQYPNFPTQGVLFEDFMTIFQNPSLFKTLINTLKSHLNEEFPNGEIDYIVGIESRGFLFGPTLALAMDVGFVPIRKAGKLPGELVRADCEKEYGSATYELQKEAIPKGSNVVLIDDVLATGGSATAATQLLMSVGSNILEYCFLMELDFLKGKLKLNDAPVFSLLHTQEEGLKRSP

SEQ ID NO: 22705 - protein, 111 aa, Oryza sativa
  misc_feature (88)..(88): Xaa can be any naturally occurring amino acid
  unsure (1)..(111): unsure at all Xaa locations
MSATRQGRQAVEQGSAKRHRKVLRDNIQGITKPAIRTLKRRRDGNRISALIYQETREGLKIFLENDVRDAVTYTEHARRKNVTAMHVXSVLKRQGRDLYGFKEMIPSFLPS

SEQ ID NO: 22706 - protein, 220 aa, Oryza sativa (indica cultivar-group)
MASTTAAAEDRKGKRPLPPEEADEAAAAPPPAAAEEEGEKLLLVSDDGVEVLASVAAARVSKTLRGMIEDECATGAIPIAGVHSDVLALLVEYCERHAPHYDPEASDRDRYPFPPFPVELPPTASSIKPVTFVDPDADPHGLKAFDKKFLDVDNSTLFEIIMAANYLNIEELLDDACTAVADKMRGKKPEEIRDIFEIENDYTPEQEAEVRRENAWAFED

SEQ ID NO: 22707 - protein, 404 aa, Mycobacterium tuberculosis H37Rv
MREVPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSLNLIYDEDPDYIVVFGADHVYRMDPEQMVRFHIDSGAGATVAGIRVPRENATAFGCIDADDSGRIRSFVEKPLEPPGTPDDPDTTFVSMGNYIFTTKVLIDAIRADADDDHSDHDMGGDIVPRLVADGMAAVYDFSDNEVPGATDRDRAYWRDVGTLDAFYDAHMDLVSVHPVFNLYNKRWPIRGESENLAPAKFVNGGSAQESVVGAGSIISAASVRNSVLSSNVVVDDGAIVEGSVIMPGTRVGRGAVVRHAILDKNVVVGPGEMVGVDLEKDRERFAISAGGVVAVGKGVWI

SEQ ID NO: 22708 - protein, 701 aa, Idiomarina loihiensis L2TR
MYLFEGLKAQVSEYLPSEQVERIRDAFVVANEAHSSQKRSSGEPYITHPVAVASLLADMRLDCETLMAALLHDVIEDTETSREDLAERFGATVASLVEGVSKLDKLQFNSKEEAQAENYRKMIMAMVQDIRVILIKLADRTHNMRTIQHLRPDKRRRIARETLEIYAPLAHRLGMHDIKNELEQLGFWALYPWRGKLLESEVKRARGNRREFTERVQSEISSRLDGNNIQARVSGREKHLHSIYRKMQAKEVKFEQVMDIYAFRVIVDSVDTCYRVLGALHNLYKPIETRFKDYIAIPKSNGYQSLHTSLKGPHGVPVEIQIRTEEMDLMADRGVAAHWMYKQSDDSSTTAQVRARKWMQSLLELQQSAGNSFEFIESVKSDLFPDEIYVFSPDGRITELPQGATAVDFAYAVHTDVGNTCIGARVNHRTYSLSKPLETGQTVEIKTAPNSRPNIAWLNFVVTGKARAKIRQYLKSQEADEAQQLGERLLRSALGQVSYDEIPEAEFKRVLQETKIDSRENLLKQIGLGNMMSVAIAKRLLGDLQPIKDDNASQKSLSIKGAEGLLVSFAKCCRPIPGDDIIAHVSPGKGLVIHRRECKNVRGHEDDPGRYFPVEWDNKPEAEFISEIRIEIVNNQGVLAKLTSAIATTGCNIDGLQTEEIDANIYFIDVALTIKNRKHLADVIRHIRKMPDVQRVTRLRK

SEQ ID NO: 22709 - protein, 996 aa, Gloeobacter violaceus PCC 7421
MELPPFQETRVLTVDPIESETQRIGQSLLAAPQQSRFSFFERSFWDEKLLEWAMADDELRVQLFRFIDCLPALKTNREVASHLQEYLGSVKLPGPLAKALDFADPGSPAAAVATLGLRQGISQMARRFICGENLKTAVKTIEKLRSQNMAVSLDLLGEAVVSEAEAEVYQRRYLELLSDLHAAQSRWPVIDQIDRADGQLLPRVHFALKLTSLYSQFDAIDPATTGRNVKARLRPILRKARELGAFVHIDMEQSQHKDLILQIFKEVMVEADFRDWIDTGICLQAYLRSAELDAANVIAWSKERGYPVTVRLVKGAYWDGEVIRAAQQRWPVPVFTRKADTDAQYEKVLHLLMENHRSVHIAVGSHNARTVALAIALARRNRVPRRAFEVQMLYGMADHLKAGVAQQGERLRVYAPYGELLPGMAYLIRRLLENTANTSFLRQSVRPGSDVVRLLAPPAASGEAAPSLMGSEFVNAPDRDFAVAAEREKLAAGLAEVRTCFGQTYWPVVGGKARRGLPTLSVPNPAEPGTVLGALGLADAELADEAVKVAHTAWLSWSKTTPEARARLLGRLAELMEQQRSALTAWIVYETGKPWRESDADVSEAIDFCRYYGRQILKLTAQAQHRDVPGETNGYHYRSRGVAAVIAPWNFPLAILTGMTTAALATGNTVIMKPAEQSSIVAAQLMRLCEQAGFAAGVVNYLPGRGEVVGAKLVAHPQVHLIAFTGSLAVGQRILAEASMVRPGQRHLKRVIAELGGKNAIIVDSDADLDQAVVGVVQSAFGYSGQKCSACSRLIVLEGIYDVFIERLVQATRSLIVGNPAQPATYTGPVIARDACERIRGVIEDAKGRHRLVLEVDVSHLGEGYFIGPTIFADVDPQSSLAQEEIFGPVLAVIKARDFEHAIEIANGTSFALTGGLFSRSPRHIAEARERFEVGNLYINRKITAALVDRQPFGGFRLSGVGSKAGGPDYLLQFVEPVTVTENIQRQGFAPLPGEL

SEQ ID NO: 22710 - protein, 379 aa, Alteromonadales bacterium TW-7
MSKRDYYEVLGVSKDASERDIKKAYKRLAMKYHPDRTAGDKELETKFKEVKEAYEILTDDQKRQMYDQYGHAAFEQGGGGGHGGFGGGHGDFGDVFGDVFGDIFGGGGGRRQSRQQRGSDLRYNMDLTLEEAVRGKEVEIKVPTWVSCDPCDGSGAKAGSKPKTCTTCHGAGQVQMRQGFFAVQQTCPTCQGQGQIISDPCNSCHGQGRVEKTKTLSVKIPAGVDTGDRIRLSGEGEAGVHGAPAGDLYVQVSVREHDIFVREGNNLYCEVPISFTTSGLGGEIQVPTLDGRAKLKIPSETQTGKMFRMRGKGVKSVRSGAQGDLICKVVIETPVNLNERQRELLKELEESMGTDSSKNRPKEQGFFDGVKKFFDDLTK

SEQ ID NO: 22711 - protein, 612 aa, Chlamydomonas reinhardtii
MHKYRLVAKKGEGTFSEVLKAQCIKNGKYVAIKCMKNHFDSLDQVNNLREIQALRRLSPHANIIKLLEVLYDQPTGRLALVFELMDMNIYELIRGRRHYVAEERIKNYMYQLMKSMDHMHRNGIFHRDIKPENILIMDDCLKLADFGSCRGIYSKQPYTEYISTRWYRAPECLLTDGYYNYKMDMWGVGCVFFEIVSLFPLFPGTNELDQITKIHNILGTPPPDLLAKMKKRSAHMDFNFPPKEGSGVAKLIPHVNPECVDLIVKLLMYNPDERLSARQALRHPYFRDLREAEKRQKALLAPDVSNHFTAMEADKARQQQTVSSTGSDHEHPTSAGGDGGAGTGAVGTHDGSAAAAAAAAALPSISGARGHAGPEGGHDNDMGGMDASGGGGGGGYGRLPGLAAQSSMASVDGDEASLPPIANLSLGKANMTGSTVGGAAHASTRRSTLNTYYEPGAGGGGGTGGAGGGGGGAGPGPAGYGKVAKAAAVGGAGSVAGGGGVVGGAGVGGGGAVGSGTVGRRQSVGVVVGKYGSVNKQASQGHGGGGPGVAGAAGMAVTGGHAGGGVGGGGGGAVGVGGVGVNKYKANVGKTNSKYISPYSLRQLAGQNAGQG

SEQ ID NO: 22712 - protein, 189 aa, Triticum aestivum
MTSVWKTKVLPGLNKIFDKDGKKAAAAEFLKSFNKEEIDKEIEDKKTDLEPKVVETIEASPPEIKGLMKDKKTSKIKKNSVAVTKFLDDLAKIDFPGAKLVSDAVAKSGTTPLSPAIVFILDKVAPFVPAPKEEPKAEPEDAAPAEETTTREVAVEEKKEEAEPSAATEEAAALKYPSRGPSLRVPQLS

SEQ ID NO: 22713 - protein, 439 aa, Arabidopsis thaliana
MASNLFTKIPSLSAIFSVYTSLSAFTILFKTILYEFIPVNIRDFIISKFTDYFSFYLNSNFTFIIEEQSDYVMNQTFRAAQVYLPTLLSRITTRSLLVSSSDLKNPMAKPKFGIPVKAKIIDEFEGIRLEWTLLSKEFRDKIMSDYFTYIAKSSVKILTHKENLNIYNYNPDCLRWESAIFQHHTTFETLAMEPELKNTLIRDLDAFSNGKDFFKTVGRAWKRGYLLYGPPGTGKSSLVAAIANFMNYSIYDLQIQSVKDDAMLRQILTSTENRSILLIEDLDCSGADTTCRKENKDETEYGENQNKKKKKDPKVTLSGLLNFVDGLWSSCVEERIIIFTTNHKEKLDPALLRPGRMDVHILMDYCTPIVFKKLAALYLEIEEHELFDPIEKMFLEVKATPAEITEKLMVSKDPDVTLKGLVEFLESKKMTKESVDSEI

SEQ ID NO: 22714 - protein, 447 aa, Ralstonia eutropha JMP134
MPASQTINISAFIDRQPLSPFQVMIVVLCFLIVAIDGFDTAAIGFIAPAIRAEWQLTPAHLAPLFGAGLGGLMAGAFLFGPLADRFGRKSVLVFSVLFFGVASLASAWSGGLWELIALRFLTGLGLGGAMPNTITLTSEFCPEKRRSFLVTTMFCGFTLGSALGGLASAGLIEAYGWRSVLVVGGVLPLVLSVLLALLLPESVRYLVMARRAPERIAATLRRIAPQANLDGATFTVSESRSTSSPVRHLFKPELVRGTLLFWLTFFMSLLVIYLLSSWLPTLLRGTGLSLRTAALVTTMFQVGGTLGAIVLGWLMDRFNPHYVLAISYALAGVFVAAIGSLADTPMLAGVAVFLAGFCVSGSQVGANALSAGFYPTDCRATGVSWANGVGRMGSVVGSVGGATMLSMDLGMPTLFLLIGIPALLAGGTMLSLGLARRAPVRQELAAS

SEQ ID NO: 22715 - protein, 408 aa, Burkholderia xenovorans LB400
MIDTIAIIGAGLAGSTAARALRAQGYEGRIHLLGDESHQAYDRTTLSKTVLAGEQPEPPAILDSAWYASAHVDVQLGRRVSCLDLANRQIQFESGAPLAYDRLLLATGARARRMAIRGGDLAGIHTLRDLADSQALRQALQPGQSLVIVGGGLIGCEVATTARKLSVHVTILEAGDELLVRVLGHRTGAWCRAELERMGVRVERNAQAARFEGQGQVRAVICADGRRVPADVVLVSIGAEPADELARAAGIACARGVLVDATGATSCPEVFAAGDVAAWPLRQGGQRSLETYLNSQMEAEIAASAMLSQPVPAPQVPTSWTEIAGHRIQMIGDAEGPGEIVVRGDAQSGQPIVLLRLLDGCVEAATAINATREFSVATRLVGTRVSVSAEQLQDVGSNLRDLLKAKPN

SEQ ID NO: 22716 - protein, 153 aa, Glycine max
MRHNFPSVVPSESETDGILGSMSEIQTLPGEIPSNERAGCEVIKSDDKLSHFENFCQSGLSHLGIKHSQDINLQGIWKEAEPFADLVGPYWSLRAALGPLLETLIILERVVFLQEQGSALEACLLPIFDPKISPRNVAIIAKKIDKDLRSSCC

SEQ ID NO: 22717 - protein, 528 aa, Oryza sativa
  misc_feature (267)..(267): Xaa can be any naturally occurring amino acid
  unsure (1)..(528): unsure at all Xaa locations
MASLARRRAAEAALLRRAPAAAWASAWRGYAAAAAGEESDVVVIGGGPGGYVAAIKAAQLGLKTTCIEKRGTLGGTCLNVGCIPSKEVMNHFDPFYLAVPSIYYELRSTMGALLHSSHMYHEAKASFAHHGIKFSNLEIDLPAMMSQKDKAVAGLTKGIEGLFKKNKVEYVKGFGKFVSPSEVSVDLLDGGSTTVKGKNIIIATGSDVKSLPGVTIDEKKIVSSTGALALSEIPKKLVVIGAGYIARGMGSVWNRLGSEVTVVEFAXLDIVPSMDGEIRKQFQRMLEKQKMKFMLKTKVVGVDTSGSGVKLTVEPAAGGEQSVLECDIVLVSAGRVPYTSGLGLNALGVETDKGGRILVDKRFMTNVKGVYAIGDAIPGPMLAHKAEEDGVACVEFIAGKEGHVDYDTVPGVVYTHPEVASVGKTEEQVKASGVAYQVGKFPLLANSRAKAIDDAEGLVKVVAEKETDRILGVHIMAPNAGEIIHEAVLALQYGASSEDIARTCHAHPTVSEALKEACLQTYLKAIHI

SEQ ID NO: 22718 - protein, 126 aa, Ralstonia eutropha JMP134
MEFLNSGKVLPAGLPFSEAVRIGNVVYLSGQMGIVPGSTRLVPGGIREEAKQALMNIRTTLEAHGLTMRDVAKCTIMLADISEWQVFNEVYKGFFEPPYPVRSALGANGLALGARVEIECLAIAGG

SEQ ID NO: 22719 - protein, 366 aa, Candida glabrata CBS 138
MYSAGVRVVNPWVLTKSMLIISLIMLIAGFLLTYTGLYCPSYQIESGTLYNRVFGNCSRRLFFSGGKSWYWNGNNGSATTDHTGGNSFVYKTAVAYQPKDREDVIYQKLKESLQSLTGEDNYFIQANAANDVYAGVADGVGGWAEHGYDSSAISRELCKALKEMAATLHKPLTPKQLLDNAYAKIKIDKIVKVGGTTANVAHLSSDGRLDVTNLGDSWCAVFRDSKLVFQTEPQTLGFNTPYQLAIIPDEIQQAAAKNGNRYIQNQPSDADEYNFQLSKGDIVILATDGVTDNIAIEDLELFLRDNNDQLNENLQKTADELVKKVVKISKDPEFPSVFAQEISRLTGKLYKGGKEDDITMVVVKVE

SEQ ID NO: 22720 - protein, 759 aa, Methanocaldococcus jannaschii DSM 2661
MVYDNIKREIIGMLKRMPNKQADWDNDLLPTLKAMFNPKSVSNAKSQLISEGVISQEIVDGKKIITLIKDPYELQAPNVFDEEMFLAYYTDKLKEYFKHKLSTEGPEWDIFDVKEFIMHFPESGDLNDKLIEHPYEVRKSITNVYIEAYEELFNETPNVEFIHIRNPIDCRISLSELSSAHKGKLVEFRAMILQATKLKLRYAKGFYYCPKCGATKTLDLGFWDKPKEVGKSLTCPADGCDCKGLIFDEDLSGKVDFQEIKVQTPLQESIYANKHSTTVFYEFNKPKKAVYSGYVKIVGVPIVKENKNGSVGELYIHAFYIEKDDEDIEEIAKNLNEKDLELINRIAKDKNVIQKLSDYAFREVTGYDMIKRAVLLQLVSSGTNIDMRTSIHILMISDPGVGKSTLMESLIQKFPFVKKVYAVTSSGPGLVGSVVREKAEFGDSWVLKAGVLTEADGGVVCIDEFSRNKEVYDYLLGVMEQQKIEINKAGVIDAVLPARVAILAACNPRFGRFNPDLTVWEQINLPKELLDRFDLIFVIKDKIDKKKDEDIADFSIDNYNSKVRERKGKSSGKKFVINGVELNDELLLKYVLYARQIEPEISDEARKIIKEYYVSVRKMSEAKGTFGISARQLGSIIRLAVAHAKLRLSEVVKAVDAEEAIRLVDTCLKQIAYDPESGSIDIDKIAGTPKSKRDKVEKVLNIIKEISNSRDDGLAPEEEIYERAERAGLSEKEVEDAINYLKRVGDIYSPKSGYWQLMS

SEQ ID NO: 22721 - protein, 414 aa, Xanthobacter autotrophicus Py2
MMSTPETATEATAPEAAPAPSLGADAPAPLPSLIGLDRDKLGAALDAIGVRGSDRRMRVNQLWHWIYLRGATDFAEMTNVSKHLRADLAAAYSLARPEIVMEQVSQDGTRKWLLRFPADHPGERPHDIETVYIPESDRGTLCVSSQVGCTLNCSFCHTGTQRLVRNLTAAEIVAQVMVARDRLGDYPGRDRATGPGLPTEGDRLVTNIVFMGMGEPLYAYDSVKEAIETLSDGDGLGLGKRRITVSTSGVVPEIERLGAEVGPMLAISLHAVRDKLRDELVPINKKYPIAELMEACRTYPAASNAKRITFEYVMLKGVNDSPADARALVKLLEGVPAKINLIPFNPWPGTQYECSDWETIERFSDIVFRAGYASPVRTPRGRDILAACGQLKSESEKLSARERLALRAMMAQDE

SEQ ID NO: 22722 - protein, 173 aa, Oryza sativa (indica cultivar-group)
MQDPEEEDDDQQQQHPAARRCAACRYLRRRCADDCVLAPFFPASRPHRYACVHRVFGASNVARLLQSLPMAERGNAANTMAMEAYWRVQDPVYGCTGIINRLQEEIRAVQCELARTQAHLAIDVASSQQPPPPPPPPPLPSPPPPQQQQQQQEEQSPPPLLDPADEFLNLDGL

SEQ ID NO: 22723 - protein, 672 aa, Trichodesmium erythraeum IMS101
MAVATQSLEELCINSIRFLAIDAVQKANSGHPGLPMGAAPMAFVLWDKLMRFNPKNPKWLNRDRFVLSAGHGCMLQYALMHLTGYDSVPIEEIKQFRQWNSKTPGHPENHITEGIEVTTGPLGQGIANAVGLAAAEAHLAAVFNKPDCNLIDHYTYVIVGDGCNMEGISGEACSLAGHWGLGKLIAFYDDNHISIDGHTDISFTEDVGKRFEAYGWHVQHVSDGNTNLEAIAEAIEKAKAVTDKPSLIKVTTIIGYGSPNKADTHDVHGAALGPDEVAATRKHLGWEYPEFEVPPDALSHFRKAVERGAKYEEEWNQLFSEYKSKYPEDAATLERMVSGKLPEGWADALPKYTPESKKDATRNQSGATLNAIAGVLPELIGGSADLAPSNKTLLKGLGDFQKGQYQNRNVRFGVREHGMGAICNGIALHGSGLISYGATFLVFTDYMRNSIRLSALAEAGVIWVMTHDSIALGEDGPTHQPVEHIASLRLIPQLIVIRPADGNETSGAYKIAVEKAKASHPQPTLLALSRQGLPNLAGSSIDAVAKGAYVLSDSEGTPDIILIGTGGETYQCVEAGEKLRAEGKKVRVVSMPCWELFEEQDAAYKESVFPASVKKRLAVEAGVSFGWHRYVTDEGATLSVDTFGASAPGGVVLEKFGFTVDNIVAKAKALLG

SEQ ID NO: 22724 - protein, 474 aa, Lactobacillus casei
MSKQLPQDFVMGGATAAYQVEGATKEDGKGRVLWDDFLDKQGRFKPDPAADFYHRYDEDLALAEKYGHQVIRVSIAWSRIFPDGAGEVEPRGVAFYHKLFADCAAHHIEPFVTLHHFDTPERLHEAGDWLSQEMLDDFVAYAKFCFEEFSEVKYWITINEPTSMAVQQYTTGTFPPAESGRFDKTFQAEHNQMVAHARIVNLYKSMQLGGQIGIVHALQTVYPYSDSAVDHHAAELQDALENRLYLDGTLAGEYHQETLALVKEILDANHQPMFQSTPQEMKAIDEAAHQLDFVGVNNYFSKWLRAYHGKSETIHNGDGTKGSSVARLQGVGEEKLPDGIETTDWDWSIYPRGMYDILMRIHNDYPLVPVTYVTENGIGLKESLPENATPDTVIEDPKRIDYVKKYLSAMADAIHDGANVKGYFIWSLQDQFSWTNGYSKRYGLFFVDFPTQNRYIKQSAEWFKSVSETHIIPD

SEQ ID NO: 22725 - protein, 468 aa, Lactococcus lactis subsp. lactis
MTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 22726 - protein, 588 aa, Ustilago maydis 521
MASQEDTDDLYADLYGAATSEAGDEAFPRGEGGDDKAHAGDEQDLTGYEDSNNKNGNSSEKAEEKPTVAASTGSFIPPASSAPAQQSDTGLQIKGSFIPPPVVNSPAAHSQSDVRDLTPASHNDASSNQQSLSHQTQVADDRGEGQNAGTERQGLDNRSAMPHEMPEEGKMFIGGLNWDTTEDSLRRYFSQFGEVGNCAIMRDNMTGRSRGFAFLNFVDPKAVNTVMVREHYLDGKVIDPKRAIPRPQHNQQGGGHHNNYNNGGGGGGGGGSYSASSQKLFVGGLPPSVTPATFRTFFEQFGTLSDCTCMMDRETGKPRGFGFLTYADDSSLNHVLNTRPIVFDGKEVDVKRAQSKNDPQSLQIRRQQRMDNPEMAYGMQQGGAGARFNNYNTGASGGGGGMGGNAWQMNPMMMGMMGQGGDMSQMYQNMGWGNQNWNPQMAWQQMMASMAGNTGGGMDMGAMMNNMGMMGSMGGTMGSMGGMGSMSPPSMKQSMSPTVNAASAVPTGASAGGDDRTERSGSASAPSSSRQQRGGSVHNGASRPPPMGPRHDRERSPGRGGDGGYRRERSPDRRDDNRRYDSGQRNRY

SEQ ID NO: 22727 - protein, 484 aa, Oryza sativa (japonica cultivar-group)
MAEEQSKAQAGAKALSEPVRVGGSAAEATLSGGELAWRPTGGGGGGGEAGRLELESEVLGVRVDGRALRVATFARGDDAAAAAARPATCGGGERRREREREREVVVEMESEEAAAAWGDAMRDRLASLGRPKRLFIIVNPYGGKRGGRKIFQTEVLPLIEAAGILYTMQETKHRLHAQEIAHSLDLRKYDGIVCVSGDGVLVEVVNGLLQREDWNTAIKIPLGIIPAGHKRPLDVTSVVQGKTRFFSVLMLTWGLVADIDIESEKYRWMGSARLDFYSLLRVVSLRRYNGRVLFVPAPGYEGLGDLVEQISSCKSNGASTGVQEDRSNDFNDETCAYAGPSIDETDHEWRSLDGPFVSVWVSGVPFASENVMTAPEAKFGDGYLDVAIIKDCPRSALAGLMFQMKDGSYVKSPYVEYFKVKALRIEPGMRVGSTTKGGIIDSDGEVIARGDGSHTGDEIEHLMAYGPPIQLTVDQGLATIFSPR

SEQ ID NO: 22728 - protein, 713 aa, Candida glabrata CBS 138
MSHLVTLATCSLNQWALDFEGNRDRILESIRIAKERGARLRVGPELEISGYGCLDHFLENDVCLHSWEMYAQILKNPETHGLILDIGMPLLHKNVRYNCRLLSLDGKILFIRPKIWLANDGNYREMRFFTPWMKPGVVEELTLPPMIQKITGQKKVPFGDAVINTLDTCIGAETCEEVFTPQSPHIAMSLDGVEIITNSSGSHHELRKLNKRLELILNGTGRCGGVYLYANQKGCDGDRLYYDGCALIAINGKILAQGKQFSLDDVEVVTATVDLEEVRNHRANVMSRGLQSSLADLKYEHIDVEIELAPRGSRFNPKITPTKSRDVTYHTPEEEIALGPACWLWDYIRRCNGTGYFLPLSGGIDSCATAMIIHSMCRLVHKACHEGNDLVLKDIRRITRSPDDWIPENPQEIANKMFHTCFMGTENSSVETRSRSKQLAEKIGSYHVDLNMDGLVSSVVSLFEVATGRKPIFKIFGGSQIENLALQNIQARLRMVLAYLFAQLLPWVRGIPNSGGLLVLGSANVDECLRGYLTKYDCSSADVNPIGGISKTDLKGFIKYASEEYDMPILDEFLNATPTAELEPITKDYVQSDERDMGMTYEELSVFGYLRKVEKCGPYSMFLKLLHEWTPRLTPAQVAEKVKRFFFFYAINRHKQTVLTPSYHAEQYSPDDNRFDLRPFLINPRFPWASKKIDEVVKQCEGHSSEIDFMTID

SEQ ID NO: 22729 - protein, 480 aa, Ralstonia eutropha JMP134
MSTPATSNIRHEALRIAGEKVYRDRVIEVTYPYTGEVIATVPKANIEDVRRALRIAHQYRSTLTRYERYRILMRAGEIIAKRKEEIATLITLESGLSLKDTLYEVGRASDVLLFAANQALVDDGQVFSCDLTPHGKSRKVYTLKEPLLGAISAITPFNHPLNQVIHKVAPAVATNNRMVLKPSEKTPLAAFALADILYEAGLPPQMLSVVTGDPREIADELLTSQYVDLVTFTGGVSIGKYIAAKAAYKRQVLELGGNDPIIVMEDADLEEAATLAAGGSYKNSGQRCTAVKRMLVQESVADRFVELLVAKTQEVKYGDPLDPATDMGTVIDEAAAIQFESVVNAAIAGGARLLAGHTRDGALYAPTVLDHVDPEMAVVRHETFGPVSPVIRFKDIDDAIRISNGTAYGLSSSVCTNRLDYITRFIRELQVGTVNVREVPGYRLEMTPFGGIKDSGLGYKEGVLEAMKSFCNTKTYSLPW

SEQ ID NO: 22730 - protein, 285 aa, Caulobacter crescentus CB15
MTNAITGAAIVGGVCGQPIKHSMSPVIHNAWIAAAGLDAAYVPFAPAADRFETFVDGLRGGAVRGLNVTIPFKERALAVADTASDLARMAGAANLLVFNEDGSVHADNTDGPGLLGAIAIQAPGFDVTAAPVVILGAGGAARGAVAALLLAGAPRIAVVNRTVARAQDLADTFGEKVVAKGEDALPALLPEAGLIINATSLGLGGGAGPSADLTLTPKTAVVMDMVYKPLRTEFLRRAEAAGRRTVDGLEMLLRQAIPTFETIYGQAPSPKIDVRVLALKLLGEV

SEQ ID NO: 22731 - protein, 171 aa, Oryza sativa
  misc_feature (55)..(55): Xaa can be any naturally occurring amino acid
  misc_feature (96)..(96): Xaa can be any naturally occurring amino acid
  misc_feature (118)..(118): Xaa can be any naturally occurring amino acid
  unsure (1)..(171): unsure at all Xaa locations
MALVEGNNGVSGGAVSFSEEQEALVLKSWAIMKKDSANIGLRFFLKIFEVAPSAXQMFSFLRNSDVPLEKNPKLKTHAMSVFVMTCEAAAQLRKAXGKVTVRDTTLKRLGATHFKYGXVGDAHFEVTRFALLETIKEAVPVDMWSPAMKSAWSEAYNQLVAAIKQEMKPAE

SEQ ID NO: 22732 - protein, 267 aa, Bacillus anthracis str. Ames
MWNYEAEEAKAVIVIVHGAMEYHGRYEAVAEMWNHIGYHVVMGDLPSHGTTSRNRGHIDSFDEYIEEVKLWVKEARKYRLPIFLFGHSMGGLIVIRMMQETKREDVDGIILSSPCLGVLAGPSAPLQAASKILNIIAPKLQFATNLTVEMSTRNHEVRDAMENDSLFLRKVSVRWYSELIKSIEIAHKKIDDFPDVPLLLMQACEDKLVDKTRVRTWFNNVKISDKAFKEWPNCYHELLNEYERDEILNYIQSFTEIRINNIIETNK

SEQ ID NO: 22733 - protein, 605 aa, Roseovarius nubinhibens ISM
MDLRNIAIIAHVDHGKTTLVDELLKQSGAFRANQAVDERAMDSNDLERERGITIFAKPTSVEWKGKRVNIVDTPGHADFGGEVERILSMVDGVVLLVDAAEGPMPQTKFVTSKALALGLRPIVVLNKVDKPDAEPDRALDECFDLFASLGADDDQLDFPHMYASGRNGWADHELDGPRKDLTALFDLIVNHVPAPRQVARAGEDFRMLATTLGSDTFVGRQLTGRVESGRLKVGATVQALSRVGQKIEQFRVTKIQAFRGLQTQDIEEAVAGDIVTIAGMAKATVADTICALAVDEPLEAQPIDPPTITVTFGINDSPLAGRDGKKVQSRVIRERLHKEAESNVAIKIADTPGGEAFEVSGRGELQMGVLIENMRREGFELSISRPQVIMKDVDGKRMEPVEEATIDVDDEYSGAVIEKLTGARKGELVEMKPAGAGKTRIIAHVPSRGLIGYHGEFLTDTRGTGVLNRVFHGWTEHKGSIPGRRAGVLISMENGEAVAYALWNLEDRGKMFIGAQAKVYTGMIIGEHSRENDLEVNPLKGKKLTNVRASGTDEAVRLTTPITLSLEEAIAYINDDELVEVTPNAIRLRKRYLDPHERKRMAKTA

SEQ ID NO: 22734 - protein, 212 aa, Oceanicola granulosus HTCC2516
MTQANGPLRVGIGGPVGAGKTTLTAALARALHPEVSLGVVTNDIYTREDAEALMRMQILPGERILGVETGGCPHTAIREDASINLAAIAQLEARLPGLELVLIESGGDNLSATFSPELADLTIYVIDVAAGEEIPRKGGPALTRSDLLVINKTDLAPHVGASLEVMRRDAERMRGGRPFLFTSLRAGREVGEIVAFIREAGGLVAREGAGAR

SEQ ID NO: 22735 - protein, 934 aa, Debaryomyces hansenii CBS767
MLSSKNDHSVDENSDLLELSDSISPSDISNHSFYGNFKRSSSLPIQSNLPTLFNNLRANDRKELSNSGTSPGRSWLRKLMSPSNKLNDLGSMENTKPGWAGKNANSKSLGDNTNSEEDSYDISLDNERETSAYPFKDIDQVKIPPVFFKEGLSLLKVSHKSKKRTFFQIGEKDFQFSLKNAYASASTTASSGLYRLLTPTSSYQPKNKSYEFSIDDIKAISYQKDASNYRKELHVSKEFESQWLTIIYFDKKKKKLKTIHVIADTEHDLKKLLSVLSGLKKLRNNLAKNYLLDLNDIDETQRNMFIGRSQEENEKEIRKFLSFNDILKYSKRLNINMNPTYLRTIFNFVCADSSVDRGLDFDQFKQFVSILKTRHDITHIWNSTCGENKSMTFDIFKNFMTDVQKESFTEEYLRKIFRKFCIEDKNYWIPENFNNFLLSKYSTSMYNAATNESYFDHPLNEYFISSSHNTYLMGRQVAGDSSIEGYIKALQRGCRCVEVDIWDGYIDGMDDNDKTNNEPIVSHGRTFTSSISLNNVFKTIKKYAFITSPFPLIISLEINCSIDNQLKVVRTLKEVLGDTLITQPIDDKFTLPTPLQLKHKILLKVKKTSPFSDLIASENGNYVSSTTTTTTSFSEDNGSGGVKRRSSFSIRRRKARKITDTLSDLGIYLQGVKFRNFSLPESKTFNHCFSLSEKSINTMLKDDIKCTSIDKHNRKYFMRVYPSNIRLKSSNFLPMKYWSHGVQMVATNWQTYDLGQQINESLFESTNRRGYVLKPEDLRKPLLKSSNRSIVAKRTIKTKFDIEIISAHQLPKPKGSVSAINPFINFDITGASDIVWDRGSAPLRTSIIPENGFNPIWNEKFSGTITTFDDFVFVRFLINASSSISEVEEIQPIGILVCKLFDLKKGYRYLPINDLLGEELIYSTLFVKINYYEL

SEQ ID NO: 22736 - protein, 451 aa, Debaryomyces hansenii CBS767
MGKITVSETKGKVRHNPLYKDIESQGGNLKSAPTSSRSNQKNTEKNEEHFLDAAASRRILQLAKEQQEELEDEENAGKTRPSFLDTYRSQKDEEDEEEDEEEEEEYSEFEEDEIAEEEIEVDEKDAALFEKYFASNGPGNGSINLADKIMAKIQEKETIKENNSRPVDAVLLPPKVISAYEKIGQILSTYTHGKLPKLFKVLPSLRNWEDVLFVTNPEKWTPHAVYEATKLFVSNLQANEAQKFVEMVLLERFRTSIEDSEDHSLNYHIYRALKKSLYKPGAFFKGFLFPLVDSHCSVREATIAASVLAKISVPVLHSSVALTQLVQRDFKPSTTVFIRVLIEKKYALPYQTLDELVFYFMRFRKAAQANDSMIDEEKEEPQLPVVWHKAFLSFAQRYKNDITDDQRDFLLETVRQRFHHAIGLEIRRELLAGKPRTPPQPVKEAIMIDAF

SEQ ID NO: 22737 - protein, 368 aa, Burkholderia sp. 383
MKTKAAIAWKAGAPLTIEEVDLEGPRAGEVLIEVKATGICHTDYYTLSGADPEGIFPAILGHEGAGVVVDVGPGVGTLRKGDHVIPLYTPECRECKFCLSRKTNLCQKIRATQGKGLMPDATSRFSLDGKPLFHYMGTSTFSNYIVVPEIAVAKVREDAPFDKICYIGCGVTTGVGAVVYSAKVEAGANVVVFGLGGIGLNVIQGAKMVGADKIIGVDINPKRVELAKKFGMTHFINPNEVENVVDHIVQLTDGGADYSFECVGNVKLMRQALECTHKGWGQSFIIGVAAAGEEISTRPFQLVTGREWKGSAFGGARGRTDVPKIVDWYMEGKINIDDLITHTLPLERINEGFDLMKAGESIRSVVLY

SEQ ID NO: 22738 - protein, 458 aa, Burkholderia sp. 383
MQSNTVHPCDEVLPTGKLVTLGLQHVLVMYAGAVAVPLIVGAALKLPKDQIAFLISADLFSCGIATLIQTLGLWVFGIRLPVIMGCTFAAVGPMIAIGTNPGLGILDIFGSTIAAGIIGIVLAPMIGKLLRFFPPVVVGTVIAVIGLSLMEVGINWAAGGVGNPEYGSPVYLGLSLLVLTLILLINKYGRGFIANISVLLGIVAGFAIAFAIGRVNTDGVAHAPWVGFVMPFHFGLPHFDPLSIVTMVTVMFVTFIESTGMFLAVGDMVDRPVNQERLVRGLRVDGLGTLIGGIFNSFPHTSFSQNVGLIGVTGVKSRFVCATGGVILVLLGLFPKMAQVVASVPPFVLGGAGIVMFGMVAANGIKVLSKVDFVNNTHNLFIVAVSVGMGLVPVVSPHFFSKLPPALAPILHSGILLASATAVILNIVFNGVKGEKDARCDIRRAGHDFDGRPADVHH

SEQ ID NO: 22739 - protein, 86 aa, Triticum aestivum
GRVGLSIQDLLALVYFGSLFYVKSPDEFITTMVARKHERSSCITYGYVWDDTVDLLTENDLDAVSAVAALATARPAFGGGVSHHDA

SEQ ID NO: 22740 - protein, 285 aa, Sinorhizobium meliloti 1021
MEKFPHPPFPRQTQEMPGTTDRMQPLPDHGENSYQGSGRLKDKRAIITGGDSGIGRAVAIAYAREGADVLISYLSEHDDAMATKALVEEAGRKAVLAAGDIQSSDHCRRIVETAVRELGGIDILVNNAAHQATFKNIEDISDEEWELTFRVNMHAMFYLTKAAVPHMKKGSAIINTASINADVPNPILLAYATTKGAIHNFSAGLAQMLAERGIRVNVVAPGPIWTPLIPSTMPEDTVADFGKQVPMKRPGQPVELASAYVMLADPMSSYVSGATIAVTGGKPFL

SEQ ID NO: 22741 - protein, 456 aa, Oryza sativa (japonica cultivar-group)
MTPPASTGKCTGAAAGEVEEPLLPEFSGGGHGASVSGAVFNVSTSIIGAGIMSIPAAMRVLGVLPALLLIATVAALSDASVEFMLRYTGWDSGPPSYAGIMGDAFGRAGAKALNVCIAFTTTGTLVVYLIIIGDVLSGSAGAGDEHAGVLQELFGAQWWTARELVILVTAIVVLLPLVLRRRVDSLKFTSAVSILLAVVFMFISLGIAVYALFTGTAKMPRMLPDFSRLSSPFELFTAVPIVVVAFTFHFNVHPIRTELSKTSDMKAAVRISLVLCAAIYAAVGFFGFLLFGDATMADVLANFDRSSGAGVPQALNDAARLSYALHLVLVFPLLHFSLRVNVDELLFPGRRPLATDTRRFVALTAVLMAVLYALAIAIPSIWTLFEYSGSTFAVCISLIFPGAIVLRDAHGIAKTKDKALAATMIALAVITSSIAIASNVMSSISGKVEGGHAAGR

SEQ ID NO: 22742 - protein, 385 aa, Caulobacter crescentus CB15
MRDYYEILGVTRTIDEAGLKSAFRKLAMEHHPDRNGGCENAAGRFKEINEAYSVLSDPQKRAAYDRFGHAGVNGPQGGPGGFGGQGFDASDIFNDVFGDVFGEMFGGGRRQSNAPQRGQDLRYDLEITLEQAYAGAEVEITVPAAMTCEVCEGSGAKPGTSPSVCGTCGGAGRVRATQGFFAVERGCPRCGGSGRLVLDPCSNCHGHGQVRRERILSVRIPAGVDDGARIRLAGEGDAGARGGPRGDLYIFLSVTPHELFERDGLDLLCTVPVPMTTAALGGEIDAPCLLGGESCDGECKVKVHVPEGAQTGKTVRLKGKGMPSLRSRQRGDLVVELFVETPTHLSARQKELMRELAGLCGEKQNPKSANFVGKAKRFWEEVTGS

SEQ ID NO: 22743 - protein, 411 aa, Sinorhizobium meliloti 1021
MKGRAARPVLFFFFQRSTRSSDVKALTWHGKGDIRCESVPDPKIEDDRDAVIKVTACAICGSDVHIFHGLIPSMENGDILGHETMGEVVEVGKGARGLEVGDRVVVPFTIACGECFFCRKGFYSACERTNPDREKAAKLWGNSPAGLFGYSHLLGGYSGGQAEYLRVPHADVGPIKVPDELTDEQALFLSDIFPTGYMAAEFCNIEPGQTIAIWGCGPVGQMAIRSAFLLGAERVIAIDSIPERLRLAESAGAMTLDYMAEDIYDRIMEITHGRGADACIDAVGTEADSRASLDSLVDRVKVATFMGTDRPHVLRQAIHCCRNFGTVSVVGVYGGYLDKVPLGSAINRGLTLRMAQTPVQRYLPSLLDRIRKGEIDPSFVVTHRGGLDDGPELYKTFAERKDGCIKVVLRP

SEQ ID NO: 22744 - protein, 112 aa, Brassica napus
  misc_feature (69)..(69): Xaa can be any naturally occurring amino acid
  unsure (1)..(112): unsure at all Xaa locations
MTLAETYACIPSTERGRGILISGDSKSDTMLYTNARSVVILDLNNPLKGSIYGEHAYPATVARYSPNGXWIASGDVSATARIWGARDDHVLKKESKVLAGRIDDLHWSADGM

SEQ ID NO: 22745 - protein, 276 aa, Mycobacterium tuberculosis H37Rv
MEGFAGKVAVVTGAGSGIGQALAIELARSGAKVAISDVDTDGLADTEHRLKAISTPVKTDRLDVTEREAFLAYADAVNEHFGTVNQIYNNAGIAFTGDIEVSQFKDIERVMDVDFWGVVNGTKAFLPHLIASGDGHVINISSVFGLFSAPGQAAYNSAKFAVRGFTEALRQEMALAGHPVKVTTVHPGGVKTAIARNATAAEGLDQAELAETFDKRVAHLSPQRAAQIILTGVAKNKARVLVGVDAKVLDLVVRLTGSGYQRIFPIITGRLIPRPR

SEQ ID NO: 22746 - protein, 379 aa, Pseudomonas putida GB-1
MLCIGTAAHPKDDQTVVLGTAVHAQSTRRHSLETLGHVLHQYLHALRQPWLPSRPVTLSGCLWQLPGVTGRTRAVVQHLGILCSLCAENRQEHTDSKQPFRHAERPSGLGAALRSVARAIVRHPMPVLLRWENEHTKTGALYTSAIQTETTPLARLGPTESGNTHIGYPMQVKNPILGLCQKATFALSAAKVEQCPDDQGYEVAFAGRSNAGKSSALNTLTHASLARTSKTPGRTQLLNFFSLDDERRLVDLPGYGYAKVPIPLKQHWQKHLEAYLGSRECLRGVILMMDVRHPMTDFDKMMLDWAKASGMPMHILLTKADKLTHGAGKNTLLKVQSEIRKGWGDGVTIQLFSAPKRLGVEDAYRVLAGWMELEDKPVA

SEQ ID NO: 22747 - protein, 501 aa, Coprinopsis cinerea okayama7#130
MYQRPQPTVRTKTGSMSTSSPRVSPLLPSAAVAYSEKHGYGPTANGATPQLDNQAMPTILGMPLKYVSLVTLAVQNASLSIVMHYSRVSTPAHLAYSPASAVLFNEILKGTISFFMAVSNSPLLKDNPSTRQTHRSLSSYVRLWLSAVQDVWAEILSPDCWKLSIPAILYVIQNSLQFVAISNLPVATFQVTYQMKILTTAAFSVALLRKKLSGVKWLSLFFLAVGVGIVQIQSTGSSRSSGSHGVGSAHEFHAHVMNPWKGFGAVTAACFTSGLAGVYFEMVLKNSKADLWVRNVQLSLFSLIPALLPILYAPTPVGSRGFILDLFRNFGPWAWATVAIQVLGGLITAIVIKYSDNIMKGFATSLSIVLSFLASVILFDFKITFSFLIGATTVLCATWMYNQPAGKEPKFSLTGNSTASPIIQKAPLSSPIIGETGFSRKSGGGKRSHSRGNSISTATPMLNQAEGYFGDSATVDSGLIGGSPLAGTRAGSPRYSLIGKS

SEQ ID NO: 22748 - protein, 700 aa, Arabidopsis thaliana
MRQNNLFSLIFWLVPVSLIIVVSAQLCSEKFGTFTPGGTFDKNRRIILSSLPSEVTAQDGFYNASIGTDPDQLYAMGMCIPGAKQKLCRDCIMDVTRQLIQTCPNQTAAIHWSGGGKTVCMARYYNQPSSRPLDLESVSIGYNVGNLSTNLTDFDRLWERLIAHMVTKASSASIKYLSFDNSRFYAADETNLTNSQMVYALMQCTPDVSPSNCNTCLKQSVDDYVGCCHGKQGGYVYRPSCIFRWDLYPFNGAFDLLTLAPPPSSQLQSPPPVTNKDEKTIHTGTIIGIVIVVAMVIIMALLALGVSVCRSRKKYQAFASETADDITTVGYLQFDIKDIEAATSNFLASNKIGQGGFGEVYKGTLSNGTEVAVKRLSRTSDQGELEFKNEVLLVAKLQHRNLVRLLGFALQGEEKILVFEFVPNKSLDYFLFGSTNPTKKGQLDWTRRYNIIGGITRGLLYLHQDSRLTIIHRDIKASNILLDADMNPKIADFGMARNFRDHQTEDSTGRVVGTFGYMPPEYVAHGQFSTKSDVYSFGVLILEIVSGRKNSSFYQMDGSVCNLVTYVWRLWNTDSSLELVDPAISGSYEKDEVTRCIHIGLLCVQENPVNRPALSTIFQMLTNSSITLNVPQPPGFFFRNRPESDTLRRGLEPDQYNNESVTCSIDNATITTLLGKTLASALCCITSTLFSKSMYRNTED

SEQ ID NO: 22749 - protein, 175 aa, Triticum aestivum
MAPTVMAASVTSVAPFQGLKSTAGLPVSRRSSSAGLGSVSNGGRIRCMQVWPIEGIKNFETLCDLPPLSTEALLNQVEYLIRSKWVPCLEFSKVGFVFREHNSSPGYYDGRYWTMWKLPMCGCTDTTQVLKEVEEVKKEYPDAYVRVIGFDNLRQVQCVSFIAFRPPGCEESDKV

SEQ ID NO: 22750 - protein, 108 aa, Triticum aestivum
MAALSTFYHPLCAHHNHCTTRHGVRSLTVMSCQKQKSPEESGGVVQRTVIRMISEAGKIGKNLKPEKKGDMKDLMLMSLSFAVYVYISQLMVCAYFSWTHVALPNPSW

SEQ ID NO: 22751 - protein, 557 aa, Oceanicola granulosus HTCC2516
MYTYSEFDEAFVRERVAQFRGQVERRVDGSLTEDEFKPLRLMNGLYLQLHAYMLRVAIPYGTLNPDQMRQLAMIAERWDRGYGHFTTRQNIQYNWPKLADVPDMLDALADVGMHAIQTSGNTIRNVTADHFAGAAADELLDPRPVAELLRQWSTDHPEFQFLPRKFKIAVTGAPNDRAVVKSHDIGLQMVERDGETGVQVIVGGGLGRTPMIGKVVREFLPLEDLLPYCEAIVSVWNLIGRRDNKYKARIKITVHEHGIDEIRRMVEERFAEIRPGFTGVDQQLLAELTGAFAPPAFKTAPTDAYEAARAADPVFRAWADTNLAAHKAEGYAIVTVSLKAHGATPGDASAEQMRLLADLAERFGHQELRISHEQNVILPHVHKADLPELHAALKSAGLATANIGLVSDIIACPGMDYCALATARSIPIAQEIATRIDELKIEHEVGHMKIKISGCINACGHHHVGHIGILGLDRAGVENYQITLGGDGTETASIGERAGPGFPAEGVVPAIERLIFAYLDVRESADETFLQAYRRLGPDPFKAALYPADDKGRANAA

SEQ ID NO: 22752 - protein, 508 aa, Saccharomyces cerevisiae
MASLFRPPESAKCNPNSPRLKLPLLRNNQVDENNIYLTSNGSSTTAYSSHTPEPLTSSTSTLFSQTRLHPSDSSMTLNTMKKRPAPPSLPSLSINSQSKCKTLPELVPIADVSDGKHDLGLKQRVIAENELSGNSDLTPSSMASPFSHTNTSSPYLRNDLSNSVGSDFSNLISAYEQSSSPIKSSSQPKSSSESYIDLNSVRDVDQLDENGWKYANLKDRIETLGILGEGAGGSVSKCKLKNGSKIFALKVINTLNTDPEYQKQIFRELQFNRSFQSEYIVRYYGMFTDDENSSIYIAMEYMGGRSLDAIYKNLLERGGRISEKVLGKIAEAVLRGLSYLHEKKVIHRDIKPQNILLNENGQVKLCDFGVSGEAVNSLATTFTGTSFYMAPERIQGQPYSVTSDVWSLGLTILEVANGKFPCSSEKMAANIAPFELLMWILTFTPELKDEPESNIIWSPSFKSFIDYCLKKDSRERPSPRQMINHPWIKGQMKKNVNMEKFVRKCWKD

SEQ ID NO: 22753 - protein, 800 aa, Saccharomyces cerevisiae
MASVPKRHTYGGNVVTDRDRHSLQRNNEILHPIHKNQRKHATFGPYIIGSTLGEGEFGKVKLGWTKASSSNEVPKQVAIKLIRRDTIKKDADKEIKIYREINALKHLTHPNIIYLEEVLQNSKYIGIVLEFVSGGEFYKYIQRKRRLKESSACRLFAQLISGVNYMHYKGLVHRDLKLENLLLDKHENLVITDFGFVNEFFEDNELMKTSCGSPCYAAPELVVSTKAYEARKADVWSCGVILYAMLAGYLPWDDDHENPTGDDIARLYKYITQTPLKFPEYITPIPRDLLRRILVPNPRRRINLQTIKRHVWLKPHEAFLSIQPNYWDEHLQKERPKPPNKGDVGRHSTYSSSASSYSKSRDRNSLIIESTLEQHRMSPQLATSRPASPTFSTGSKVVLNDTKNDMKESNINGERTSASCRYTRDSKGNGQTQIEQVSARHSSRGNKHTSVAGLVTIPGSPTTARTRNAPSSKLTEHVKDSSQTSFTQEEFHRIGNYHVPRSRPRPTSYYPGLSRNTADNSLADIPVNKLGSNGRLTDAKDPVPLNAIHDTNKATISNNSIMLLSEGPAAKTSPVDYHYAIGDLNHGDKPITEVIDKINKDLTHKAAENGFPRESIDPESTSTILVTKEPTNSTDEDHVESQLENVGHSSNKSDASSDKDSKKIYEKKRFSFMSLYSSLNGSRSTVESRTSKGNAPPVSSRNPSGQSNRSNIKITQQQPRNLSDRVPNPDKKINDNRIRDNAPSYAESENPGRSVRASVMVSTLREENRSELSNEGNNVEAQTSTARKVLNFFKRRSMRV

SEQ ID NO: 22754 - protein, 689 aa, Aspergillus fumigatus
MGYTDLDQLAINTIRLLAVDATFKANSGHPGAPMGMAPVAHVLFNKFMNFNPKNPNWLNRDRISLLMLFISNGHGCMLQYALLHLFGYDVTMDDLKNFRQLDSITPGHPEAHDTPGVEVTTGPLGQGFANAVGLAIAQAHTAAVFNKPGYDLINNYTYCFFGDGCAMEGIASEAASMAGHLKLGNLIAIYDDNHISIDGDTKCAFTEDVMKRFEAYGWHTVWVKDGDNDLEGIEAAIHEAKKVTDKPTVIRLTTTIGFGSKLQGTGGVHGNPLKADDCESVKQKFGFDPKQSFVVPQQVYDLYHKHAAEGAAKEQAWNQLLEKYATEYKAEHADLVRRLSGKLPEGWEKSLPTYKPTDAAVASRKLSEAVLEKIHAVVPELMSGSADLTGSNNTRWKNAVDFQPPEYGIGEWSGRYIRYGVREHAMAAVMNGLAAYGTIIPAGGTFLNFVSYAAGALRLSALSRVRVIHIATHDSIGLGEDGPTHQPIETLAHFRALPNCMVWRPADGNETSAAYYSAITAKHTPSVLALTRQNLPQLENSTIEAALKGAYPVVEAPNAAITLISTGSEVSICIEAATYLKEKHNIVARVVSVPCFEVFDAQPKDYRLKVLPDGIPVLSVEALSTMGWERYSHEQFGLNRFGASGPYKEVYKKFEFTPEGISKRALATIDFYKGQPVRSPINRAFEQIL

SEQ ID NO: 22755 - protein, 489 aa, Clostridium perfringens SM101
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNVPAIVWSALFLVIILTLNLLSAKAYGESEFWFAAVKVATVIIFLIVGVLMIFGILGGDNVGFKNFYENGGLFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMNRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 22756 - protein, 301 aa, Prochlorococcus marinus str. MIT 9312
MTVQRILIVAGTHGNEINPIWAVKQFNRNENSLKHGIEYEYIIGNPIAYEKGCRYIDADLNRSFKKSKNYDQNENSFYEISRANFLVDQFGINGSKPCQIAIDLHTTTANMGTSIVMYGRRFKDFCLAALLQNKFGLPIYLHEKDKSQTGFLVEAWPCGLVIEIGAVAQNFYDPKIINRFLIIISSLRDEIDKLKKNLIELPKDLVVHVHQGSVDYPRDEKGDIDGLIHPKRINRDWKMIKKGDPLFLNSQGIIYKYDGDQFIWPVFIGEVAYKEKQIAMSYTNKEVICSKNEWVQEFHRL

SEQ ID NO: 22757 - protein, 264 aa, Prochlorococcus marinus str. MIT 9312
MRIRSFLAFVISICITFAFVPVETFAFSERGNAQFTDVVNTGKANDCPTLDSSLVGSISIGNGDTLKGICMHPTEVYVKVPGTKRKAAEFVSTKIISPRNNTTVTEVYGDIDKGTFTEKGGIDFQLITVLTPGGLEVPFAFSAKELTADLPSSIEPGTEFSGSTFTPNYRTGDFLDPKARAKNTGVEYAQGLVALGGDDEELAKENIKVDVNGTGIITLSINNVDSDTDEFTGTFEAIQPSDTDMGSKDPLDVKIIGELYGRKA

SEQ ID NO: 22758 - protein, 671 aa, Candidatus Desulfococcus oleovorans Hxd3
MATRKTAGNKPIDERCINTIRCLAMDAIQQANSGHPGAPMGLAPAGYVLWTKVMKHNPKNPQWFNRDRFVLSGGHASMLLYSLLHLTGYELSLKDIQQFRQLGSKTPGHPEYGHTPGVETTTGPLGQGFANAVGMAMAERHMAARFNRKGATIVDHFTYVMCGDGDLMEGLSYESASLAGHLGLGKLICLYDDNDISIEGHTDITFTENVAARFKACNWHVVPVKDGSSVDQILDALKAAQAETEKPSLIILKTHIAHGSPNKQDSADAHGAPLGKEEIVLTKRNLGFPEDVVCHITEDALKVFRKCMEKGEKAQGKWRAIVDRYAEKFPDLAAQWTAAITHRLPKGWDKNLSGFLPSDKPMATRSASGKVLNKLAEAIPAIIGGSADLAPSNNTFLACSGEFQKGTYDQRNIRFGVREHAMASIMAGMYLHGGLRPYGGTFLIFSDYMRPAIRVASLMKLPLIYVFTHDSVAVGEDGPTHQPVEQLASLRAMPGLTVIRPADATETVDAWKVAVTNTAGPVALALSRQNLPVLDAAITAGKLAKGAYVLEECSGRPDIILISTGAEVHVTLEAAKLLAQKNIAARVVSMPSWELFEKTDATYRESVLIPGVPCFAVEAGSPMGWERYTKDSHAILGIDRFGTSAPGGTVLKEYGFTPENIVKKVTAVLGK

SEQ ID NO: 22759 - protein, 552 aa, Uromyces viciae-fabae
MSSDDVKALGGDLEKAHSIMDQEFVTEKGNGTITEDKQDGQMQRHLKPRHMSMIAIGGTIGTGLFIGSGQGLNQGGPVGLLLGYSTMGIVVYSVMVSLGEMVTMFPITGSFVHYASRFVDPALGFALGWNYWYCYAITLPTEITAAGIVIQYWTKSVNVAVWITIFLVASCGVNLFGVRWYGEAEFWCSAVKVIAIVCLIILGIIIDLGGGPNHDRIGFRYWISPGPFNQLNGIPGSTGRFLAFWSVFIQASFSYQGTEIVALAAGEALNPRKTIPKAINRVFYRILLFYVGGVTVIGLLVPYNSPDLLGGTGDATSSPFVIAIKSAGISVLPDVLNAVILAVVFSAANSDLYAASRMTFGLATDGMAPAIFSRCTSNGLPIAGLILTIGFGLLAYMNVNSSTGTVFQWLANFSSVTGLLTWWSISLAYIRFYHGLIHHKIDRNTFAYKAPYQPWLSYFSITMSTLIIFFNGFEVFMSGSWSTSKFVSAYLSIPMFIVFFITWKIYHKTAFVKIDQMDFVTGKREFDSMEQIESEKEVEPVGKFAQFLEWLM

SEQ ID NO: 22760 - protein, 337 aa, Sinorhizobium fredii
MMGLRHVKGEGHSPSAILDSIGRTLATATNGIKALAEHLATDESFARSLVEAVELVGDGHGRVVVSGVGKSGHIGRKIAATLASTGTSAYFVHPTEASHGDLGMVTSDDVLILLSWSGETAELANMLTYAKRFKVPIVSISSNRDSILARNSEIALVLPKVPEACPHGLAPTTSAMLQLAVGDALAIALLERRGFSAEDFKTFHPGGKLGAQLRLVHELAHVAEQMPLLAVGRPMSEAVIEMSSKGFGVVGIIDGSGVLVGVITDGDLRRHMAGDLLGQPVEEVMSCHPKVIHADVLASAAMEFMQEHKVTVLFLVDEAGMPEGILHIHDLLRAGVA

SEQ ID NO: 22761 - protein, 337 aa, Triticum aestivum
  misc_feature (297)..(297): Xaa can be any naturally occurring amino acid
  unsure (1)..(337): unsure at all Xaa locations
MASPPRHLLPLLLLLALLGTSSAAAPGVIRLPRAGACAAPADPAVYDRPVIGIVTHPGDGAAGRIDNGTSTSYIGASYVKFVEAGGARVIPLIYNEPDERLLEKLSLVNGVLFTGGSVKRGPYFETIKKVFQYVLDKNDAGVPFPLFAQCLGFELVSMIVSKDNNILESFHASDQASTLQFPNYSSLQGSVFGRFHPDLIKKLSTSCLVMQNHKYGISPKRLRENDALSSFFKILTISPDENGEVYVSTVEAQKYPITCTQWHPEKAIFEWRKPMIPHSEDAVQVTQNFANYFISQXARKSPNRPPADKVLDNLIYNYIPTFSGKTSKSFELVYLFS

SEQ ID NO: 22762 - protein, 398 aa, Burkholderia sp. 383
MSQVKRLTDLIAAGQLAGKRVFIRADLNVPQDDQGNITEDTRVRASVPAIQAALDAGAAVMVTSHLGRPTEGEFKPEDSLAPVAKRLAELLGRDVPLVSNWVENGVNVAPGQVVLLENCRVNKGEKKNSDELAQKMAKLCDVYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVNEAKAIIDEARERGASVPIPTDVVTAKEFSPTAVATVKQVADIEADDMILDIGPDTAKALASQLEKAGTIVWNGPVGVFEFDQFGNGTKTLAEAIAKSSAFSIAGGGDTLAAIAKYGIHDQVSYISTGGGAFLEFLEGKKLPAVEVLETRAA

SEQ ID NO: 22763 - protein, 391 aa, Trichodesmium erythraeum IMS101
MEFAKKLEKISPYPLTEINRKKNELIDRGVDIINFGAGDPDQPTPNHIVQAMHEAIKDSTNHHYPPIKGLKEYRQAAADWMKRRFGIEDLNSETEVISSIGSKESIHNLFLAFVNPGDYAIIPDPGYPVYRTSTIFTLGQPYSMQLRAENGFLPILSNIPQEVAEKAKLLWINYPNNPTGATASLEFFEELVGFCKHYDILLCHDNAYSEIAYDNYKPPSILQVPNAKDIAIEFHSLSKTYNMSGWRIGFVAGNSLGIKGLSQVKSNIDSGVFQAIQKAATEAFVSTTEKHLQSLVAVYQKRRDILIKGLQSLGYPIKANLASLYAWVPVPKNYTSQEFATLLLEKCGIIVVPGNAYGTSGEGFIRIALTVEDKRISQALQRIKDSGLNYI

SEQ ID NO: 22764 - protein, 292 aa, Synechococcus sp. WH 5701
MAEAGARLAIRLLQDAAERGEIDPWDVDVIAVVDGFLDQLRQRIGAPRLVSRPGEGGSFENDLAATSEAFLAASVLVSLKAEILEQQTLPPEPALELDAFGFDDEDTGSFELLSFQLPRRPERHLLRRAVAPPPLQRPVTLGELIRQLEDIAERLEQGEASGRTRQRGRRYSERAAIEQVAALAHREKLPETTAALSHFLMEWQAARDWVNFEVLVEAWAQAAPADLDQDRVGVFWALLFLCSQGRVDLQQEGDLFGPLFLKGCWEGMGAGPSVLPHGLVPAPSPAREAQAA

SEQ ID NO: 22765 - protein, 394 aa, Synechococcus sp. WH 5701
MKAMILAAGKGTRVQPITHTIPKPMIPILQKPVMEFLLELLRQHGFTEVMVNVSHLAAEIENYFRDGQRFGVEIAYSFEGRIEDGELIGAALGSAGGLKKIQTFQPFFDDTFVVLCGDALIDLDLTEAVRLHKEKGAMASLVTKRVPKDQVSSYGVVVTDQDSRVLSFQEKPSVAEAASDMINTGIYIFEPEVLDHIPAGVPFDIGADLFPRLVAAGAPFYALPMDFEWVDIGKVPDYWQAIRSVLEGKVRQVSVPGREVRPGIFTGLNVAADWDKINVTGPIYVGGMSRIDPGVTIVGPAMIGPSCHICEGATIDNSIIFDYSRIGAGVRLVEKLVFGRYCVDRNGDHFDLQEASLDWLITDVRRQDVVQPSPQQKAMADLLGTDLALSAGEN

SEQ ID NO: 22766 - protein, 316 aa, Ustilago maydis 521
MAGRIREVWAENLEVEMALLRDTIEKYPYVAMDTEFPGIVARPIGTFKGSSDYHYQTLRCNVDLLKLIQLGITLCDENGNLPPDVCTWQFNFRFSINDDMCAPDSLDLLTKAGLDFDRHERMGIDVEHFGELLITSGLALFDDVKWVSFHSGYDFGYLLKVVTCSPLPAQESDFFALLRVWFPCIYDIKFLMRSCKTLKGGLQDVADDLQVSRIGQQHQAGSDSLLTATTFFKMRQKYFDGSIDDSKYLGCLYGFSSSSSHVNGMVHYSQGRPVSVQSFHDASAVPRSVSGGYAAGGYGSNFGSPFKSTLSASTER

SEQ ID NO: 22767 - protein, 159 aa, Lagarostrobos franklinii
ILCVLPLFHILSLNSVLLCALRVGAAILIMQKFNITTLLELIEKYKVTVAPFVPPIVLEIAKNPIVANYDVSSIRMITAGGAPLGEDLEDALRARFPSAKFGQGYGMTEAGPGLARNLGFAKEPFPVKSGSGGTVVRNAQMKIIDTETGASLPHNQAGE

SEQ ID NO: 22768 - protein, 288 aa, Zea mays
  misc_feature (197)..(197): Xaa can be any naturally occurring amino acid
  misc_feature (219)..(219): Xaa can be any naturally occurring amino acid
  misc_feature (249)..(249): Xaa can be any naturally occurring amino acid
  misc_feature (261)..(261): Xaa can be any naturally occurring amino acid
  unsure (1)..(288): unsure at all Xaa locations
ERAVQAASRRQGEMGKGAQGSDAAAAGGEVEENMAAWLVAKNTLKIMPFKLPPVGNGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGGXGPETGVLVVGGRPPSALGVAAXRARALRRAPALWVVDVDNHRPWAGASSLGXPDPALRVSPRAXDLADEVERIRAAMGLRIDVSLDCAGFY

SEQ ID NO: 22769 - protein, 220 aa, Bradyrhizobium sp. BTAi1
MTTSHDTDERLIEKGRKLFAQAWRFTHASPSIASLPPMSGQIEIAFAGRSNVGKSSLINALTGQNALARTSHTPGRTQELIFFEGPDYAPLRLVDMPGYGYAAAAKTKVASWTKLIHQFLLGRASLARVYVLIDARHGLKEVDQEIFKTLDRSAVSYQLVLTKADQVKPPELAARIAETEAALAKHPAAFPQVLATSSRSGTGMPELRAAMARLLEERGA

SEQ ID NO: 22770 - protein, 440 aa, Mycobacterium sp. JLS
MTSVVIVGSGFTGFECARHLARKLRKSEGTGSEPVEITIISPVDYMLYTPLLPDVAGGLVDARFVTIPLANSLRGVRAVRGRVDDVDFDQRTVTFTDPEQRVRSMPWDRLVLTPGSVTRLFDVPGLAEHARGLKSTAEALYLRDHVLEQLELADFDEDPTLAAARRTIVVVGASYSGTELAVQLRALADAAAQQMGFDPDSVRFVLLDLAEQVMPEVGEKLGAAAHRVLRGRGVDVRLGVTLKEVHDDHVLLTDDTRIDTRTVAWVTGVTGAPLIEKLGLPTEKGRLKVDADLQVPGHPHVFAAGDAAAVPDLTQSGAITPPTAQHATRQGKVLARNVAASLGHGTKKLYKHRNMGLVVDLGPRYAVANPLGVRLSGLPAKAVTRAYHLYAIPRFVNRWAVSLAYLTDVFFARSVVSIGLSSADDARFSASEGIPMPKGD

SEQ ID NO: 22771 - protein, 448 aa, Fulvimarina pelagi HTCC2506
MTQTFDLIIVGTGTAARVAAMRAHAASWSVAVIDSKPFGGTCALRGCDPKKMLVGGVSAIDHAKRMQDKGVVGTLNIDWPELVAFKRSFTDPVPDKHEASYADKGIAAFHGQARFTGPNSVQVDGTELEGAHILIATGAKPVTLGIPGEKYLIDNEGFLALEDLPKRIVMVGGGYIASEFSQIAALAGSQVTVLQRGERMLTHFEPELVGWLIESFKAVGIDVRTSTEVTAVEKAGTEYRVTASSNGQSETIEADLVVHAAGRIPNLSDLDLDIAGVAVSDGRLQLNEYLQSTSNPAVYAAGDAAQAGPPLTPVSSHDAKVVVGNLLDGNTHKPDYRGVPSVAFSLPPITAVGLSEADARMQGLKFNIKSQKASNWFTSRQAAEPVYGFKVMVEEGSDRVLGAHLVGPHADEVINLFALAIRHNLTATALKQTMFAYPTGASDIGYML

SEQ ID NO: 22772 - protein, 453 aa, Debaryomyces hansenii CBS767
MFVRLLKSNRKFNIRTKTTMSNFDPATLHNPYFNQKLGQKDIWTLINETAAEAQKESGKSIVNLGQGFFSYNPPDFAIEAVNKATSQPQFNQYASARGNPNLLNELSSLYTKEFNRKVGTDEIQITTGANEGMFSIFFGYLTPGDEVIVFQPFFDQYIPNIEMCGGKVKYVQLKFPEKFNGESVSGDDWEVDWEGLTNAITDKTKLIVINTPHNPIGKVFTEEELYKIGKIAIGNNLILVSDEVYENLYYSKSFTRPATLSSLPELAERTLTIGSAGKSFAATGWRVGWVHGPASLIKYVTAAHTRICFSTPAPLQQAVADGLKQAASNKYFEITRQEYVKKYELFTKVFDELNLPYTSAQGGYFLLVNLLKVKIPNDFEYPADISDKGTNDFKLAYWLIKEIGVVGIPPTEFLYPADRQGNGLENCLRFAVCKDNSILEEAVEKLRLLKEYL

SEQ ID NO: 22773 - protein, 350 aa, Mycobacterium sp. JLS
MIPAALRCVPAGQVDVTAPVTIDGLSYIAPDDPAMPMYRVIANNRQPVALRDLMIQPVRSGYIGDGHQPDPALVPPTGAQAVPDVDVDQVYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEALAKPFRR

SEQ ID NO: 22774 - protein, 390 aa, Arabidopsis thaliana
MKETKPLSSLTSQLLLSLALSLSFLAMATGSTTDSARSPSSGVLQKLLLLFSVCIATSTYKAIQPPPSKLCGSPDGPSITGPRIKLRDGRQLAYKEHGVPRDEATHKIIVVHGSDSCRHDNAFAALLSPDIREGLGVYMVSFDRPGYAESDPDPNRTPKSLALDIEELADQLSLGSKFYVIGYSMGGQATWACLKYIPHRLAGVTLVAPVVNYWWKNFPSEISTEAFNQQGRNDQWAVRVAHYAPWLTHWWNSQSWFPGSSVVARNLGMLSRADKEIMFKLGAARSQHEAQIRQQGTHETLHRDMIVGFGTWEFDPMELENLFPNNEGSVHLWQGDDDVLVPVTLQRYIAKKLPWIHYHEIPGAGHLFPFAPGMVNNIVKTLLTNDGVKK

SEQ ID NO: 22775 - protein, 357 aa, Azoarcus sp. EbN1
MTTMKAAVFKAPGRIELVDKPLPQVGPNDALVRITTTTICGTDVHILKGEYPVATGLTIGHEPVGVIEQLGSNVQGYVEGQRVIAGAICPSFTSYGCQDGVPSQDGGHVGHGYKPMGGWRFGNTIDGTQADYVLVPDAIANLAPVPDGLTDEQVLMCPDIMSTGFAGAEAANIRIGDIVAVFAQGPIGLCATAGAKLRGASLIIAVDGVDERLRISRNMGADVTLNFREVDVVSEILRITGGRGVDAAVEALGLQSTFESALRVLKPGGTLSSLGVYSSDLTIPLGAFHAGLGDNKIVTSLCPGGKERMRRLMNVVASGRDDFGALVTHTYKLDDIVAAYDLFANQRDGVLKIAIKP

SEQ ID NO: 22776 - protein, 209 aa, Oceanicola granulosus HTCC2516
MPDTTQMTDALNELGGHIEARRPDCVAAWQVDHGELTVTVALANLPGFVEFIKTDATCRFSTLVDITAVDHPGRAKRFDVVYHFLSMYQNQRIRLRTLVREEDLVPSITGIHPSANWFEREIFDMFGILFSGHPDLRRLLTDYGFRGHPLRKDFPTTGYTEVRYDEVQKRVVYEPVKLVQEYRQFDFLSPWEGANYILPGDDKADEAKG

SEQ ID NO: 22777 - protein, 404 aa, Oceanicola granulosus HTCC2516
MDGAKGFQDAQTGEQKIRNFNINFGPQHPAAHGVLRLVLELDGEIVERCDPHIGLLHRGTEKLMETRTYLQNLPYFDRLDYVAPMNQEHAWCLAIEKLTGTEVPRRAQLIRVLYSEIGRVLNHLLNVTTQAMDVGALTPPLWGFEEREKLMIFYERACGARLHAAYFRPGGVHQDLPDELVEDIDAWAKTFPEVLDDIDGLLTENRIFKQRNVDIGIVNEQEILDWGFSGVMVRGSGLAWDLRRAQPYECYDEFEFQVPVGKNGDCFDRYLVRMEEMRQSTHIIRQACEKLRRERGDVLARGKVTPPSRADMKTSMESLIHHFKLYTEGFHVPEGEVYCAVEAPKGEFGVYLVADGTNRPYRAKLRAPGFLHLQAMDHISKGHQLADVSAIIGTLDIVFGEVDR

SEQ ID NO: 22778 - protein, 183 aa, Ostreococcus tauri
MSSNPEEEIIKQRIIEQTATLKPGQDYPLKRLVKTFFALMKALDAGADVDEAKETFLIELDTYEFNMLRYGTVVDAQRVQTLAYDDEEIELEQTTKRLKGQCKNLRSELAASERERAFREARDEAASACREYPTRAESEDANAQLERALAEAKIVLTGLDEKVAARKAKYALLLAVVDSLDTE

SEQ ID NO: 22779 - protein, 351 aa, Triticum aestivum
PRVRVFPAGGDGLYLVVDENGKFREDSFQKSLNVLAPATGSDKKRENGKRQKGLVSAGKTNEESDIFKMVKMIIQRQYDPVILFSFSKRECEFLAMQMAKMDLNGDDEKVNIETIFWSAMDLLSDDDKKLPQVSNMLPLLKRGIGVHHSGLLPILKEVIEILFQEGLIKCLFATETFSIGLNMPAKTVVFTNVRKFDGDRFRWLSSGEYIQMSGRAGRRGIDQRGICILMVDEKMEPSTAKMMLKGGADSLNSAFHLSYNMLLNQLRSEDGDPEKLLRHSFYQFQADRALPDLEKQVRELEIERSSMVIEDEESVKDYYDLLQQYRTLKKDVRDIVLSPKYILPFLQSEGL

SEQ ID NO: 22780 - protein, 436 aa, Arabidopsis thaliana
MDRFSNLPDDVIYHIVSFLSAKEATCLKFVSKNFQNLVTIKRNVVFHHWESFKNFVDGLLAEPASYRIKRFSLKLVSMDFAQYNIVNDCLCNVLKRGVLDLELDINVKEDYILPSDVFTCKTVVRLKLGCGFVIDILPKNALLPALKTLILDSVRFYASDGCAFTRLLSASPVLEELVIDRLNWEHWKGSRFVSSPTLKRLTLRRKEWEPEPETWTDFESVSFDTPSLAYLKYKDVIPYGYPIVNLNSIVEARLTLPREVEYDYWLNRSADPSNLIRGLKNVEILSIKVLHTMDLLFYNFKEAVPVFENLIHLSVTSEADFCWDPLQILLEKSPNLKTLTIEGPLHYNFYEKLDLEAVCECLLGYSFLLSCPIKVLKITEFVGDIGEIVQMKHVLGKLPCLELLEVHVQARRDDKKLQIMADLLMLPRTSSKCKVK

SEQ ID NO: 22781 - protein, 203 aa, Synechococcus sp. WH 5701
MFGFLQKVGDYTKDAVGAANYITQGLSVTFDHLRRRPITVQYPYEKLIPSERYRGRIHYEFDKCISCEVCVRVCPINLPVVDWVMNKETKKKELKNYSIDFGVCIFCGNCVEYCPTNCLSMTEEYELAAFDRHSLNYDSVALGRLPTSVTSDPAVVPLRELAYLPKGEMDPHGVDPSRPRAGKLPEQVQAEMAASAAKPAENA

SEQ ID NO: 22782 - protein, 188 aa, Sesbania rostrata
TGVMALQVQSEFQKAYEGGITKSRYWEPTYEDSMNLIARLPAIAAYIYRRKYKDGKIIPLDDSLDYGANYAHMLGFDDPEMLEFMRLYVSIHSDHEGGNVSSHTAHLVASPLSDPYLAFAAALNGLAGPLHGLANQEVLRWIRSIVKEFGTPNISTEQLSDYIHKTLSSGQVVPGYGHGVLRKTVQDT

SEQ ID NO: 22783 - protein, 600 aa, Sinorhizobium meliloti 1021
MLEESPGTRVDTVLAKLGKALEQGDIDAAVNLFQADCYWRDLVAFTWNLKTMEGQDQIRDMLTTQLAAIKPARLRQDEKEPASAGAGVTEGWFEFETEVARGHGHIRLRNGLIWTLLTTMTELKGHEEPKGLRRPLGAEHGHDPDRKTWKEKREAEAAELGYTTQPYAVIIGGGQGGIALGARLRQLGVPTIIIEKNERPGDSWRKRYKSLCLHDPVWYDHLPYIPFPENWPVFAPKDKIGDWLEMYTRVMELNYWSSTLCKSARYDEATEEWTVIVERNGEEVVLRPKQLVLATGMSGKPNVPKLEGQDIFKGEQQHSSQHPGPDAYRGKKVVVIGSNNSAHDICAALWEGGADVTMVQRSSTHIVRSDTLMEIGLGDLYSERALAAGVTTRKADLIFASLPYRIMHEFQIPLYEKMRERDAKFYADLEKAGFMLDWGADGSGLFMKYLRRGSGYYIDVGACDLVIDGSIKLKSGSDVSHLTEDAVVLKDGTVLPADLVVYATGYGSMNGWAADLISKDVADKVGKVWGLGSDTPKDPGPWEGEQRNMWKPTQQEALWFHGGNLHQSRHYSQYLSLQLKARCEGISTPVYGLQERHHLS

SEQ ID NO: 22784 - protein, 396 aa, Synechococcus sp. WH 5701
MRMVVDANRVAAEAAPVFRPGLEGVPATQSAICDIDGLQGLLTYRGYPLEELAAYSTFLETAHLLIWGELPTVEHLRAFEHNVQMHRRVSFRIRDMMKCFPADGHPMDALQSSAASLGLFYSRRALDDPAYIEAAVVRLIAKIPTMVAAYQLIRLGQDPIQPRDDLSYSANFLYMLTEREPDPLAARIFDACLILHAEHSLNASTFSARVTASTLTDPYAVVASAVGTLAGPLHGGANEDVLAMLEQIGSEDQAEAWLDRAIAEKQKIMGFGHREYKVKDPRAVILQGLAEQLFDRFGHDAMYDVARRVEEVASDRLGPKGIYPNVDFYSGLVYRKLGIPRDLFTPIFAIARVAGWLAHWKEQLGANRIYRPTQIYTGYGRRSWLPQDARNALPGV

SEQ ID NO: 22785 - protein, 851 aa, Magnetospirillum magnetotacticum MS-1
MPEIIRTTCPYCGVGCGVIAARLDQSAPWTVKGDPEHPANYGKLCVKGSALAETLDLDGRLLHPLISGNRASWDEALDLVAETFSTAVREHGPDSVAFYVSGQLLTEDYYAANKLMKGFIGSGNIDTNSRLCMSSTVAGHVRAFGSDTVPGCYEDLDLADLVVLVGSNAAWCHPVAFQRTLAAKARRPEMRIVVVDPRRTATAECADLHLAIRPGSDAILFNGLLAHLKGEETQLDVGVPLDQIVQFFSWFADTEKTVTVWSQGINQSSSGTDKVDAIINCHLQTGRIGRPGMGPFSLTGQPNAMGGREVGGLANMLAAHMGFDEASIDRVGRFWNATQMAGKPGLKAVDMFKAVAEGKIKALWIMCTNPAVSMPEADLVKSAIAACPFVVISECEANTDTARLAHVKLPALTWGEKDGTVTNSERRISRQRPFLPAPGEAKGDWWIITQVARRMGFGPAFAWNGPGEIFDEFCRLTAFENASTRDLDLSGLVGADYAAIEPIQWPVRAPGQGTARLFADGRFYHADGKARMLDITPRPPARAADLAFPLILNTGRMRDQWHTMTRTGRAARLAAHAPEPVLLVHPKDALRFRLSDGGLARVSGNRTSVVLRVALDPGQRIGEVFAPIHWNDQTASSAVIGSLIDAATDPHSGQPELKQAPVLVEPLEAAWHGVLLSRNPVDLPRSFYWAKASGAAHSIWRLAGEAGEDWPITAKQWLGTDGEWIEFLDPNRGHYRGARLVEGRLDAVLFVFPWAMDFSPDWVAAAFGRAAIAGDERATLVAGAPPGGDRGRDKTVCACFNVGLSAIRAAIRDHRLSSAAEVGAMLKAGTNCGSCVPEIRAILTEAAPKVA

SEQ ID NO: 22786 - protein, 480 aa, Kineococcus radiotolerans SRS30216
MIAAHSVADVRAAERAVMALLPPGTLMHRAAAALDVECARVLREATGGVSGRRAVVLAGSGDNGGDALLAAARLARRGVAVTALTTSEHVHPEGLAAARAAGVRTRPWQAGDEDVCAAADLVLDGIAGIGGRGGLRPVHEGLSALDGPVVVAVDLPSGLDADTGAVTGELMAADVTVTFGTAKPAHLLAPAAARCGRLVVVDIGTTDHLPAPAVERVELADVAARWRRAAPGDDKYSRGVVGVVAGGPDYTGAAVLAVEAAVRAGAGMVRYLGPQHPAELVRQRRPEVVVGEGRVQAWVLGPGVSPDDPEQQDRIRRALASGEPAVVDAGALAGLPAALGPHHVLTPHAGELARLLGAERRAVEADPLTHARRVHESTGATVLLKGSVTTVVGERGVLTAAAAPTWLSTAGAGDVLAGVLGAALAARPDEDPAQVAADAAVLHGWAATLASAGGPLAALDVADAVPAALTSLPGWAGTGG

SEQ ID NO: 22787 - protein, 1054 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIEKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVKLEFRIIHPAPGLP

SEQ ID NO: 22788 - protein, 1054 aa, Arabidopsis thaliana
MSSNTSRSCSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALEKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVKINKEAESAVLLKEKRILQTQSVLCDMLFRNAPIGIVTQSPNIMDLVKCDGAALYYRDNLWSLGVTPTETQIRDLIDWVLKSHGGNTGFTTESLMESGYPDASVLGESICGMAAVYISEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKTLTENYSRVKGDYARIMWSPSTLIPPIFITNENGVCSEWNNAMQKLSGIKREEVVNKILLGEVFTTDDYGCCLKDHDTLTKLRIGFNAVISGQKNIEKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPALRGLCVSFKVIARIEAIGKRMKRVKLEFRIIHPAPGLP

SEQ ID NO: 22789 - protein, 166 aa, Gloeobacter violaceus PCC 7421
MVIIVLGVSGAGKSRFGSALAAALAWRFADGDDFHTPEAVAKMRRAQPLDDADRAPWLVQMRLGIEGWLARGENVVLACSALKENYRRLLRGGDKPIEFVYLKITPRLAAERVNRRAASTGHFMPPELLKSQFEDLEEPEQAVVIDMDKLETTSQQIDQVQCALNI

SEQ ID NO: 22790 - protein, 577 aa, Candidatus Desulfococcus oleovorans Hxd3
MSIQPWPTTNWPKGVSREIADFEHPLFSFLDDAARDYPDNVYTIFNGGTRTFAQVKQAADRVANFLAASGIKKGDRVAIFLPNLPHYPEIYFGILKAGAVCVTCNPLYTPSELNYQLKDSGSKVVFCMDHPQFYPTTVQAIQETGVETVVICNVKAFLPPVKRILGALLNKIPKAESHEPGHVMYDEIMASYPAQAPDVEINPSEDLALIIYTGGTTGVPKGAALTHANFVFDVKAMDEWVYLSQEPGAPPEKIRKGGFHCYIGVLPWYHSFGMTMCMLTSCASGSRLICVPDPRAGNPPFTEVLKLVQTYRPTILVGVPTIFSAFENHPLLDKYDLSSLICCASGGAPLPVELAKNFEAKTGSIIFEGYGLSETSPVITGNPSDKDLRLFGSVGFPVSNTDIKIVDSETGITVLPQGEDGEIAVNGPQVMKGYWQKPDADKEVFREIDGKRYFLTGDIGHIDENGYILITDRKKDLILVGGFNCYPREVEEVLFQHPKVAQAAVVGVPDPRSGEAVKAYVQLREGMTATEQEILDFCKEKLAGYKRPRAIEFRDALPTSPVGKVLRRVLKEEAKQK

SEQ ID NO: 22791 - protein, 525 aa, Zea mays
MDDAQSRSHELATGWPLLPQLLVVPLLLLLCLLSSGRRSREQGAAERRRAPPGPPKQLPVLGNLLQIGSRPHRYFQAVARRYGPIVEVQLGRVRTVVVSSPDAAKEVLRTNDLHCCSRPNSPGPRMLSYDFLDVAFSPYSDYWREMRKLFILELLSMRRVQSFAYARAAEVDRLVSSLASTPPGAAVDLSEKLYALSDGVVGTVAFGKMYGSAQFERSSFQRVMDETLRVLGSFTFEDFFPASRLARFADVLTGAAGRRSRIFRQIDRFFDSVIDKHLEPERLQAGVQEDMVDALVKMWREEQADGYEAPHGLTRDHIKGILMNTFAGGIDTCAVTMIWIMAELMRNPRVMQKAQAEVRTLVGNKPRVDEEDVKSLSYLKMVVKENFRIHPPGTLLIPRETMRSCVIGGYDVLPGTRIFVNVWAMGRDPSIWDRPEEFSPERFEGSHVDFRGSSFELLPFGSGRRSCPAIAMGVANVELVLANLLHCFDWQLPEGMVEEDIDMEETGQLAFRKMVPLCLVPIKRV

SEQ ID NO: 22792 - protein, 389 aa, Triticum aestivum
MASGTDEKAKMESLTSPAAFVEGGVQDACDDACSICLEAFCESDPSTLTGCKHEFHLQCILEWCQRSSQCPMCWQPVSMKDPTSQELLEAVERERNIRTNQTRNTTIFHHSALGDFEVRHLPVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVNESNSNTTTSTSNTSTPCVTTSGSN

SEQ ID NO: 22793 - protein, 426 aa, Candidatus Desulfococcus oleovorans Hxd3
MIEIIEVQAREILDSRGNPTVEVDVTLSGGATGRAAVPSGASTGTREALELRDTRKKRYLGKGVEKAVENVNTLIGPVLYGMPADEQFMVDSTMIGLDGTANKSKLGANAILGVSMAVARAAADAYELPLYRYLGGIHAKHLPMPMMNIVNGGAHAANSLDIQEFMIIPVGGKTIAECVRMGAEVFHTLKKLLKAKGFATAVGDEGGFAPDLESNEAAIGFIMEAIKKAGYRPGRDVGIALDAAASEFYEKGKYVLKGEGKKLSSKQMVDYYENLIDKYPILSIEDGLAEQDWDNWVMMTDRLGNTTQIVGDDVFVTNPAIFEKGIREGLANSILIKLNQIGTVSETLQAIDMAKQAGYTTVISHRSGETEDAFIADLAVGVNGGQIKTGSLSRSDRIAKYNQLIRIEEALGAGAVLSNDFTAVVR

SEQ ID NO: 22794 - protein, 341 aa, Methanococcoides burtonii DSM 6242
MNNIIIWILIALCLIQSGIFSGLTIGLFGLSRLRLEIEAEANNIHAQKVLKLRHDPHLLLSTLLWGNVCVNVLITLLTDSVMVGSAAFIFSTVFITCFGEIMPQAYFTRNALKMGASLTPLVKLYILLLYPFTKPSAMILDRWLGKEKLEYFKETSLRIMLQKHMKSDASDIDKMEGLGALNFLSLDDLSIKQEGSLIDEKTIIEIDTINNRPVFPEVGTPDFEILLHKIAVPAKKWIIAVDKNRYPVVAIDSTSFIRDAIYKKNNFHPLIYCHTPLIVKSPNVKIGDVLHKLKVYPVDSEDDVIDNDLILYWNDDDPEKIVITGSDILGRLFRGIVYRVR

SEQ ID NO: 22795 - protein, 71 aa, Oryza sativa
  misc_feature (28)..(28): Xaa can be any naturally occurring amino acid
  unsure (1)..(71): unsure at all Xaa locations
FTQRYQDVKKVLADTGLAPSEVRVYSPXVQNTLYLMGKAEFNLFAAISYVQLRMPNLQFITFNLGNKVSSR

SEQ ID NO: 22796 - protein, 249 aa, Phytophthora infestans
MDRDSLVFLAKLAEQAERYDEMVDHMKAVANNHNVELTVEERNLLSVAYKNVIGSRRASWRVISSIENKGDSERSEHIKAYRQKIEGELVDICNDILTIIENNLIPNSSSEEGKVFYYKMKGDYHRYLAEFQVDDERKESSDKALESYKQASTIAMAELPPTHPIRLGLALNFSVFYYEILNSPDRACNLAKQAFDDAIAELDTLSEESYKDSTLIMQLLRDNLTLWTSDQEPDNADANQGDMNVQDVE

SEQ ID NO: 22797 - protein, 454 aa, Pseudomonas fluorescens Pf-5
MTHKNPQTREWQTLSSDHHLAPFSDFKQLKEKGPRIITHAKGVYLWDSEGNQILDGMAGLWCVAIGYGRDELAEAASKQMRELPYYNLFFQTAHPPVLELSKAIADIAPEGMNHVFFTGSGSEGNDTMLRMVRHYWAIKGQPNKKTIISRVNGYHGSTVAGASLGGMTYMHEQGDLPIPGIVHIPQPYWFAEGGDMSPEEFGIWAANQLEEKILELGVDNVGAFIAEPIQGAGGVIVPPDSYWPRIKEILAKYDILFVADEVICGFGRTGEWFGSDFYDLKPDMMTIAKGLTSGYIPMGGLIVRDEVVAVLNEGGDFNHGFTYSGHPVAAAVALENIRIMREEKIIQRAHEKAAPYLQKRLRELSDHPLVGEVRGVGLLGAIELVKDKATRARYEGRGVGMICRQFCFDNGLIMRAVGDTMIIAPPLVISEAEIDELVAKARKCLDLTLSVLEG

SEQ ID NO: 22798 - protein, 168 aa, Triticum aestivum
MKGGRKNLRRACEEGTAVTLAEGESIMQVVTLRGSNLIEVTDGEGVKSLALFPAKFQKSFWIKNGNFVVVDASGRDEALESGSKIACVVSRVLFHDQVRALEKSGQWPAIFKSTPNGWATGPQGTTSQAEEEQNSDEDDDDDMPPLEANTNRNRPFDVHSDTESDSDS

SEQ ID NO: 22799 - protein, 679 aa, Ostreococcus tauri
MRDDTVEKEGTWEELDDLRRRARDEDWLIDVEASCSFERSLGKGSSGEAFLARWRGARVVVKRIEALKTTLAKRAFARECAIMARVRHPNVLAFYGAALSESRCDVVVEHAAGGTLKAWLHESGRQKRSLSERLDVGMDVARAFAYLESRTPSVMHRDLKPSNVFVAADGRAMVADFGLSRFVAANGEELTGETGTYIYMAPEVIRSEHYDNRADVFSYGVLLHELVTGIEPYQPHNSTAIQIATAVADQGLRPNIPEDTHAGLAAIIEMCWQQNASDRPSFAVILESMETMVPDILKEQEAKAAARRENPSVQAKAFQNLSHTFATWSSKMAELGGVWNPHVWSTSCEHSPHYTSSSRDHVHFDDAVRIRCRVLSERSVRAGRPRPRGHTACWRTQSAGGSLSRRFRKCCSSNHRRTRGNEYFRCGGTLITDTHVLSAAHCFFDDAGVSNVDDYSAVHVRLGAQEDVYAGVTSYVTQINGHPQFDGSSFDNDVAVLTLASPVDVQMYVPVTLSWDPSDVVAEGQIMGKIVGWGTREDGRLSSQLIEGDVPIVSRAQCTSAGSYNPADILPSHICAGYVEGGIDSCQGDSGGPLSVNSKQVGIVSWGDGCALARKYGVYFHVAASEGFIGLATDSRVYEWSPTDGSIPSPPPTPSPPSTPPPLGLFPFPMLSLFSLFSF

SEQ ID NO: 22800 - protein, 147 aa, Phytophthora infestans
MALKRINKELQDLGRDPPANCSAGPVGDDLFHWQATIMGPEDSPYAGGVYFLNIYFPADYPFKPPKVNFTTRIYHCNINANGGICLDILKDQWSPALTISKVLLSICSLLTDANPDDPLVPEIAQIYRTDRARHDATAREWTAKYAT

SEQ ID NO: 22801 - protein, 417 aa, Oryza sativa
MATCRSRGVERGGAPHVLAVDDSSVDRAVISGILRSSQFRVTAVDSGKRALELLGSEPNVSMIITDYWMPEMTGYELLKKVKESSRLKEIPVVIMSSENVSTRINRCLEEGAEDFLLKPVQPSDVSRLCSRVLRIAYDDRNQKMRANDIISDSKTEFSGRVEAAAAGSGGGDDDDDYEEAEFGPTARVQMKVLRLAAARGVSLPADMMEAAKDAGIREVLLLRYFDLQAGPWPLAAMIRAFSMLRNRMLADPSFLFKVGTEVVIDSCCATFAEVQKRGEDFWAEFELYAADLLVGVDGWIFAKQGVLYGSVGFVCGIIGQGIANMIMTAKRSVKKSDEDIPVPPLIKSAALWGVFLAVSSNTRYQIINGLERVVETSPIAKRVPPVAMAFTVGKKQQQQQLCGTVEARNSFACLKSV

SEQ ID NO: 22802 - protein, 292 aa, Phytophthora infestans
MTPNLQGAFTALVTPFTEDGSAVDYAKLRELVEWQIQEGINGLVPMGTTGECPTVSHEEHDRVVSEVVATVNGRVPVIAGTGSNNTAEALRLTRAAKDAGADACLVVCPYYNKPTQKGLYAHFKAVAEVGLPVVVYNIPGRTNVNLTPQTIAELAKLPNIVAIKESTGSLDQAMEIAALCDITILSGDDNLTLPLMAMGAKGVISVLSNASPKKVLAVTDPMLKGDYAAARKAALENIFLVKSLFSEANPQPIKKVLQLMGKCTATVRAPLVECEPSTVENLTKLAKEHKFI

SEQ ID NO: 22803 - protein, 475 aa, Arabidopsis thaliana
MKERIRFLQVLWILWIEYWHCKAILLSKHRRRWIHKSFKLFVNRLMALQGNAPLNRFSLKCKVRCDSACVDGWIINVLDRGVLDLDLNISSESDYKLPSEVFLNKTLVRLKLGGKDEFIIDVEEVFLPKLKTLYLHGFVCFEDSGVACAKLISGCPVLEELVMINLMWGLMDVCSVSNPTLKRVTICSEIIDYNPQSVSFDTPNLVYLEFTDVVAIKYPKVNLDSLVDARLGLRLTPCQTTKARRSVKSVGQGMMGNAADFLMGISNVKILYLSFDTLEVLNFCCKTIPLFNNLTYLTIETNEDVGWESLSNILENCPNLETIIFKGLHYRDTNQCWDERYRFKDTNKCFEEDADMCMCKPWEATPICLSSSSVKILEVLKFGEVTSYKDDMDRQTEVIKFFLETMPNLEQVILYYDTPFDDDLSILSTELQMLEKVASPKCKIQVISDNISYSSTVHSSSSTSGLVFLNNTFPV

SEQ ID NO: 22804 - protein, 1054 aa, Arabidopsis thaliana
MSSNTSRSYSTRSRQNSRVSSQVLVDAKLHGNFEESERLFDYSASVNLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSDTLLSSIRFTPAWKGLCVSFKVIARIEAIGKRMKRVELEFRIIHPAPGLP

SEQ ID NO: 22805 - protein, 1193 aa, Gloeobacter violaceus PCC 7421
MGSLRPPSRRNRGVALSKRGMTTLEEARAALETKNNYGASYTLEQLSEITGLSCPTITKVLDGEEGVDKRTLERFFKAFDLKLTKSDYEAAGNLSENPDGGIRATQQDWAEAVDVRNFHGRAEELAALTSWIVHDKCRLVALLGMGGIGKTSLSVKLAETVKENFDYVIWRSLRNAPPLQEILVDVFQFVGLTQSSVSYRVPNVKQSQLIDLFRRHRCLLVFDNVETVMDSARKAGYYREGYEDYGELFKSVGSSAHNSCLVLTSREKPKDLGPLEGKTLPVRSLRLTGLQENDGLELLKERGLDVATGDSKELLRYYGGNPLAIKMVASTIRTLFGNNISNFVTQGTSIFGDVRDLLSQHFNRLSELERQVMYWLSIHCEPIALTELHEVVLLPVTLPELLEAMESLSRRSLVEENKLYFSLQPVITEYTLDRLIYHAWMEIQTRKLSLLKQCFLLKAQGPDYIRSAQLRLIINPLVGRLRSFFKTLEAIEKHCEHIFSDLRREALGNQGYAAGNLLNILCAAKIDLRGWDLSGLAIWQADLRNVNLQQCNLFQCDLSQSMFTEPLGNISSVQFSPNRNVLATGDADGKVCLWQLPHGIQINICEGHTAWVWSVGFSPDGSIVASGSSDQTVRLWETTTGQCLRILQGHANSIWSVGFSPDGSIMASGSSDQTVRLWETTTGQCLRILQGHGGWVLSLAFSPDGSIVASGSSDQTVRLWETTTGQCLRILRGHTDWIHSVVFSPDGRSIASGGADRTVRLWEAATGECRKSFPGHSSLIWSVAFSPDGQSLASGGQDALIKLWDVATAQCRRILQGHTNLVYAVAFSPDGQTLASGSADQAVRLWKTDTGQCRKTIQGYTSGIYSVAFSPDGRTLASASTDHTVRLWDTATGECRQTLEGHHSWVFAVAFSPDGQTLASGSVDHTVLLWETVTGRCRKILEGHHSWVWSVVFSPDGTTIATGSADRTVRIWNAATGRLSTVLQAHTGWVSAVAFSADGRILASASADGTVRLWNVSNGLCVALLAEHSNWVHSVVFSPDGSLLASGSADGTVRLWDLQSNRCTRVIEGHTSPVWSVAFSADGTLLASAGEDRIIRIWRTSTGGIHRAFPGHSRPVWSVAFSPDGQTLASGSQDESIALWETHSAERSRVLRNPKPYEGMNLRAVSGLTEARKATLKALGAVVDISGQVRPET

SEQ ID NO: 22806 - protein, 142 aa, Bradyrhizobium sp. BTAi1
MSSSSAEREEGVAFLPKFDAGGLVTCVTTDAATGDVLMVAHMNDEALRRTVATGEAWYFSRSRNALWRKGESSGQTQRVIEMRTDCDQDAVWLRVEQTGAACHTGRRSCFYRRVERTEADGGARLVFVDADRLFDPDAVYRK

SEQ ID NO: 22807 - protein, 122 aa, Synechocystis sp. PCC 6803
MTMNAQAIINSIEAEFLKEDLPTIHVGDTIKVGVKIVEGGKERIQPYEGTVIAKRNGGISETITVRKIFQGVGVERVFLLHSPRVASIKVLRRGKVRRAKLYYLRDRVGKATRIKQRFDRAL

SEQ ID NO: 22808 - protein, 1055 aa, Arabidopsis lyrata
MSSNTSRSCSTRSRKNSRVSSQVLVDAKLHTNFEESERLFDYSASINLNMPSSSSCEIPSSAVSTYLQKIQRGMLIQPFGCLIVVDEKNLKVIAFSENTQEMLGLTPHTVPSMEQREALSIGTDVKSLFQSPGCSALQKAVDFGEISILNPITLHCRSSSKPFYAILHRIEEGLVIDLEPVSPDEVPVTAAGALRSYKLAAISISRLQALPGGNMLLLCDALVKEVSELTGYDRVMVYKFHEDGHGEVIAECCREDLEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFLPFPLRYACEFLTQVFGVQVNKEAESAVLLKEKRILQTQSVLCDMLFRNAPIGIVTQSPNIMDLVKCDGAALYYREKLWSLGVTPTETQIRDLIDWVLKSHGGNTGFTTESLMESGYPDASVLGESICGMAAVYITDKDFLFWFRSGTAKQIQWGGARHDPNDRDGKRMHPRSSFKAFMEIVRWKSMPWDDMEMDAINSLQLIIKGSLQDEHSKTVVNVPFVDNRVQKVDELCVIVNEMVRLIDTAAVPIFAVDASGVINGWNSKAAEVSGLAIEQAIGKPVSDLVEDDSAETVKNMLALALEGSEERGAAIRIRAFGPKRKSSPIELVVNTCCSRDRTNNVLGVCFIGQDVTGQKTLIENYSRVQGDYARIMWSPSTLIPPIFMTNENGLCSEWNNAMQKLSGIKREEVVNKLILGEVFTSDDYGCRLKDHDTLTKLRIGFNAVISGQKNIEKLLFGFYHRDGSFIEALLSANKRTDIEGKVTGVLCFLQVPSPELQYALQVQQVSEQVIACAFNKLAYLRQEVKNPEQAISFLQDLLHSSGLSEDQKKLLRTSVLCREQLAKVIRDSDIDGIEEGYVELDCSEFNLEESLEAVVKQVMELSIERKVQIICDYPQEVLSMRLYGDNLRLQQILSETLLSSIRFTPALKGLCVSFKVIARIEAIGKRMKRVELEFRIIHPAPGLP

SEQ ID NO: 22809 - protein, 385 aa, Guillardia theta
MAFLPVRSLLLIGVIASSSAFVPSVSLRGASPARSSLPAASRVARHGAVVATKMNTETKPEGFGASHTSFYTSAKAKDSYATLDEVLNQKMKDEGVRQVTREMLDAAVKITEALRVNLVTVADAQNSVFGDVQLGVDVIADNIMWDAAKASKVVKEAASEEEPVLVETNPNGRFTICWDPLDGSSIVDNNWAVGTMIGIWDKKTGMLGATGRDQVTSIVVLYGPRTTALVACDDGVYEFTCGAGNKWIASREKIQIKKDSKIFSPANLRCCQEDAGYDALVKHWMEKRYTLRYSGGLVPDVYQHFTKEMGVFANPTSPKSPAKLRVAFEIAPFSLLVEKAGGKTSDGVTGNSCLDIKIEAVDQRTPACLGSANEVDLFNKMVLGK

SEQ ID NO: 22810 - protein, 590 aa, Zea mays
  misc_feature (94)..(94): Xaa can be any naturally occurring amino acid
  misc_feature (116)..(116): Xaa can be any naturally occurring amino acid
  misc_feature (130)..(130): Xaa can be any naturally occurring amino acid
  unsure (1)..(590): unsure at all Xaa locations
MAGAERAEAVALEQGLLDPEESNQVVYTGDGSVDFSGNPVVKERTGRWKACPFILGNECCERLAYYGISTNLVTYLTKKLHAGNASAASSVTIXWSGTCYLTPLIGAILADAYWGXRYWTIATFSTVYFXIGMTLLTLSASVPMLMPPSCEGSFCPAASPFQYTVFFLGLYLIALGTGGIKPCVSSFGADQFDDTDPAERVQKGSFFNWFYFSINIGALISSSFLVWVQDNVGWGLGFGIPTVFMGLAVISFFSGTSLYRFQKPGGSPITRVCQVIVASFRKWNVPVPEDSSLLYELPNGVSTIEGSRQIEHTDELRCLDKAATVTEVDVKTADFNNPWRICTVTQVEELKILVRMFPVWATTIVFSAVYAQMSTMFVEQGMVLDPSLGSFKIPPASLSTFDTLSVIICVPMYDYIVVPIARRFTGNERGFTELQRMGIGLVISIIAMSVAAVLEIKRLAVAREAHLVDQNVPVPLSIFWQIPQYFLIGLAEIFTFIGALEFFYDQSPDAMRSLCSALNLLTTAFGNYLSAFILTMVAYFTTRGGNPGWIPDNLNEGHLDYFFLLIAGISFLNLIVYVLCAGKYKSKKAA

SEQ ID NO: 22811 - protein, 363 aa, Bacillus subtilis subsp. subtilis str. 168
MTKQTIRVELTSTKKPKPDPNQLSFGRVFTDHMFVMDYAADKGWYDPRIIPYQPLSMDPTAMVYHYGQTVFEGLKAYVSEDDHVLLFRPEKNMERLNQSNDRLCIPQIDEEQVLEGLKQLVAIDKDWIPNAEGTSLYIRPFIIATEPFLGVAASHTYKLLIILSPVGSYYKEGIKPVKIAVESEFVRAVKGGTGNAKTAGNYASSLKAQQVAEEKGFSQVLWLDGIEKKYIEEVGSMNIFFKINGEIVTPMLNGSILEGITRNSVIALLKHWGLQVSERKIAIDEVIQAHKDGILEEAFGTGTAAVISPVGELIWQDETLSINNGETGEIAKKLYDTITGIQKGAVADEFGWTTEVAALTESK

SEQ ID NO: 22812 - protein, 144 aa, Fulvimarina pelagi HTCC2506
MTIKRILEEKGRDVVTLTPSVTLAEVAQVLSEKRIGAIILVEDNGRLAGIVSERDIVRVVAARGPDVLTQLVKEAMTPKVVTVREDMSIDEAMRLMTEKRFRHLPVVDETEQLVGFVSIGDVVKRKISEAEAEASMMRDYINTN

SEQ ID NO: 22813 - protein, 378 aa, Triticum aestivum
  misc_feature (108)..(108): Xaa can be any naturally occurring amino acid
  misc_feature (114)..(114): Xaa can be any naturally occurring amino acid
  misc_feature (187)..(187): Xaa can be any naturally occurring amino acid
  misc_feature (214)..(214): Xaa can be any naturally occurring amino acid
  misc_feature (229)..(229): Xaa can be any naturally occurring amino acid
  unsure (1)..(378): unsure at all Xaa locations
MGRDQQAGVGAGAAAAHREKVKLFMGVLALQFLLAGFHIVSRAALNMGISKLVFIVYRNVISLALLAPFAYFLEKKDRPPLTFSLLAEFFVLALIGITANQGFYLLGXLYHLSXPTYASAIQNMVPAITFVLAAVLRLEQVDLGRRHGVAKVVGTVVSIGGATVITLYKGLPLFSHNLHVQAGPSLXSGSPFFHWTLGLRLHSSAPASTWSGWXMCSRCPVLKRYPARXLSPISLTCVFGLLQFLVIAAFTEEDMSRWKVQSVGELFTILYAGLVASGVAFALQIWCIDRGGPLFTAVFQPVQTVAVAVMAAIILGDQLYTGGIIGAVLIVIGLYFVLWGKSEEKKTRSQDPEMARHLLGEDGGEADKDQQVSTAVLA

SEQ ID NO: 22814 - protein, 429 aa, Methanococcoides burtonii DSM 6242
MTLMEDARKGLITPEIRSVAELEGIDVELVRSCVAKGLVTIPKNIKGKSRAFGIGKYMSVKVNANIGTSRDFVNIDEEVDKAKAAVKYGADTIMDLSTGGDLDLIRSRIMDAVDVPIGTVPIYQAAASHKTVVDMTSDDMFNAVRKHAEDGVDFVTIHSGVNYNALERLKKGDRITNVVSRGGSFTIAWMIHNEQENPFYSEYDYLVEIAKEYDLTISLGDGMRPGCIHDASDAPKFMEFITLGELVSKARESDVQTFVEGPGHVPLNEVELSVKAMKELCHGAPLYLLGPLVTDIAPGYDHITGAIGGTLAGMYGADFLCMTTPAEHLALPTVDDIREGAIVTNIAAHAADLTREGQKEKARELDDRMAHARAELDWETQFEVAIDSEKARKIRESRNTGTDACSMCGELCAMKIVKSALEESRQKDN

SEQ ID NO: 22815 - protein, 436 aa, Arabidopsis thaliana
MFSSSFLRLILLLCLVSSSFSSTTSSSNSTAADQTLRPQEELQKLTLIRQELDKINKPAVKTIQSSDGDKIDCVSTHQQPAFDHPLLQGQKPLDPPEIPKGYSEDDGSYENSQLWSLSGESCPEGTIPIRRTTEQDMLRASSVQRFGRKIRRVKRDSTNNGHEHAVGYVTGRQYYGAKASINVWSPRVTSQYEFGLSQIWVIAGSFTHDLNTIEAGWQISPELYGDTYPRFFTYWTSDAYRTTGCYNLLCSGFVQTNRRIAIGAAISPRSSYKGGQFDISLLIWKDPKHGHWWLQFGSGALVGYWPAFLFTHLKQHGSMVQFGGEIVNNRPGGSHTTTQMGSGHFAGEGFGKASYFRNLQIVDWDNTLIPASNLKILADHPNCYDIRGGTNRVWGNYFYYGGPGKNPRCPLKNQENKSRKRLLIIILTCSAHEFWD

SEQ ID NO: 22816 - protein, 486 aa, Delftia tsuruhatensis
MKEFLNFINGEYVRNASGKTFQDINPVNGSVIGNIYEAGQAEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNQVGMPKGVYNVVHGFGPGSAGEFLTQHPGVNGITFTGETRTGTAIMKAAADGVRPVSLEMGGKNAAVVFADCDFQVTIDTLTRSCFENAGQVCLGTERVYVERPIFEKVVAALKERAEAMKPGLPFDHDTKIGPLISKKHQAKVLGLYKTAKDEGATIVTGGGVPDMPDALKDGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 22817 - protein, 215 aa, Phytophthora infestans
MGAMLPYWFTAMTMKSVGVAAMEMVKEVKHQFATIPGLLEGLPGHGPPDHARCIKISTDASLREMIPPGLLVMLSPIIAGTFFGVHAVSGLLVGSLTSGVQLAISQSNTGGAWDNAKKFVEKGCVSIEDKEGKLIVQGKGSAIHKAAVIGDTVGDPLKDTSGPALNILMKLMAIISLVFGDFFKSINNGRGLLNVPADVSAAAAPVVEVTAAPQL

SEQ ID NO: 22818 - protein, 401 aa, Glycine max
MEGAGMEENNIINDDDNNNKSEAHLTSAAAFVEGGIQDACDDACSICLEAFCDSDPSTVTSCKHEFHLQCILEWCQRSSQCPMCWQPISLKDPTSQELLEAVERERNFRFNPSRNATIFHHPTLGDFELQHLPVGASDADLEERIIQHLAAAAAMGRARHIARREGQRNRSSAQGRPHFLVFSTNPNSPPMAPASSSPSQRGDDEPIPTIAVANLSPTPATGEESSQLTLVPPIQAEQVSASGSGSTALATDHQGSSYNNRRSPNQSSPSSQDRAGPSELQSFSESLKSKLNAVSTRYKESISKSTRGWKERWFSRNNTMSDLGSEVRREVNAGIATVSRMMERLETSDNNRSNSNSAPSNIEDGSVQEYNGQTLTPGNEGDGLLRDNNTKASCAAGSSSN

SEQ ID NO: 22819 - protein, 333 aa, Phytophthora infestans
MANQVDHSNPITLSRFILAEKEIQGNADLSVLFTSIELACKVIASSVRRAGLTGLYGLDGSENSTGDQVKKLDVLANDIFINSLKFSTKIEVMVSEEEEKPIVVQNDSSGTKYCIAFDPLDGSSNIDCNVSTGTIFAIYQRDASSEGGYKDILQPGSKLVSAGYCMYGSSTQLVLTWGKGVHCFTLDPTIGAFMLSHQDIRIPDEPKAIYSCNEGNYAQWDSATKAFVDECKTGSKAYAARYVGSMVSDIHRTILYGGIYLYPGSTKAKDGKLRLLYECNPMSFIVEQAGGMATTGTERILDLVPTDIHQRSPIFLGCKRDVERVIALYKEHN

SEQ ID NO: 22820 - protein, 460 aa, Saccharomyces cerevisiae
MTEDKSQVKIRFFTREKDELLHVQDTPMYAPISLKRYGLSEIVNHLLGSEKPVPFDFLIEGELLRTSLHDYLTKKGLSSEASLNVEYTRAILPPSYLNSFSNEDWVSSLDVGDGSKHIISGSYDGIVRTWDLSGNVQKQYSGHSGPIRAVKYISNTRLVSAGNDRTLRLWKTKNDDLKLTSQQQAQEDDDDEVNIEDGKTLAILEGHKAPVVSIDVSDNSRILSASYDNSIGFWSTIYKEMTVVDPLEDINNPNNKISTAARKRRKLTMKDGTIRRRAPLSLLESHTAPVEQVIFDSTDNTVGYSVSQDHTIKTWDLVTARCIDTRTTSYSLLSIAQLSTLNLLACGSSARHITLHDPRVGASSKVTQQQLIGHKNFVSSLDTCPENEYILCSGSHDGTVKVWDVRSTSPMYTITREDKSVQKGVNDKVFAVKWAEKVGIISAGQDKKIQINKGDNIFKN

SEQ ID NO: 22821 - protein, 357 aa, Ostreococcus tauri
MDSVPNFFGGNDGSDGGFTLNRVDGVSTGTNGEVILSEIKCGLLRRDGTTMRADVRKGTLRIIQAALDDTLKQIQWGPREANTGFEAEEDFIILPDEAVLKTMKQPGCFALSFLEERDRDMYFWFQEPKDADKEAMLMKCNRLINTNVMAALGRGEERSNAEATMEDAPDEGTETTPSIPGTTPALVNAAAMAAPSPVEPTPAPNMPPAETPAAPAKDGEGMRTPASAANFTPIVTSDALKGVFANLGGATPRTPPVGLPEILTPELVGPLLRDESIRGRLLEYLPEEHRETEDLEELIRTPQFRSQLEAFSHAIQSGEMDMTQFGLKESGVADLEKFLRAIQAEMDDQEANDAMES

SEQ ID NO: 22822 - protein, 414 aa, Phytophthora infestans
MAKLSIKNVDVKGKRVLIRVDFNVPFAQDGSISNTQRIDAALPTVQYVLDQGAKAVVLMSHLGRPEGKPKAKDSLAPVAVAVEQKLGRKVTFLKDCVGPEVEAACANPTEGSIILLENLRFHVEEEGKGKDAEGNKTKASSEAVAAFRASLSKLGDVYVNDAFGTAHRAHSSMVGVDLPIKAAGFLLDKELVYFAKALDAPQRPFVSILGGAKVADKIQLIMNMLDKVDEMVIGGGMAYTFKKVINNMEIGGSLYDEEGAKIVPQIVEKAKAKGVTLHLPVDFVIADKFAADAATKISTEEEGIPAGWMGLDVGPKSQEAFSAAVAKAKTVVWNGPMGVFEFDAFADGTKVVMDAVVKATESGATTIIGGGDTATCCVKFNTEDKVSHVSTGGGASLELLEGKILPGVDALSSA

SEQ ID NO: 22823 - protein, 1054 aa, Arabidopsis thaliana
MSSNTSRSYSTRSRQNSRVSSQVLVDAKLHGNFEESERLFDYSASVNLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPIDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELDCSEFGLQESLEAVVKQVMELSIERKVQISCDYPQEVSSMRLYGDNLRLQQILSETLLSSIRFTPAWKGLCVSFKVIARIEAIGKRMKRVELEFRIIHPAPGLP

SEQ ID NO: 22824 - protein, 1054 aa, Arabidopsis thaliana
MSSNTSRSYSTRSRQNSRVSSQVLVDAKLHGNFEESERLFDYSASINLNMPSSSCEIPSSAVSTYLQKIQRGMLIQPFGCLIVVDEKNLKVIAFSENTQEMLGLIPHTVPSMEQREALTIGTDVKSLFLSPGCSALQKAVDFGEISILNPITLHCRSSSKPFYAILHRIEEGLVIDLEPVSPDEVPVTAAGALRSYKLAAKSISRLQALPSGNMLLLCDALVKEVSELTGYDRVMVYKFHEDGHGEVIAECCREDMEPYLGLHYSATDIPQASRFLFMRNKVRMICDCSAVPVKVVQDKSLSQPISLSGSTLRAPHGCHAQYMSNMGSVASLVMSVTINGSDSDEMNRDLQTGRHLWGLVVCHHASPRFVPFPLRYACEFLTQVFGVQINKEAESAVLLKEKRILQTQSVLCDMLFRNAPIGIVTQSPNIMDLVKCDGAALYYRDKLWSLGVTPTETQIRDLIDWVLKSHGGNTGFTTESLMESGYPDASVLGESICGMAAVYITEKDFLFWFRSSTAKQIKWGGARHDPNDRDGKRMHPRSSFKAFMEIVRWKSVPWDDMEMDAINSLQLIIKGSLQEEHSKTVVDVPLVDNRVQKVDELCVIVNEMVRLIDTAAVPIFAVDASGVINGWNSKAAEVTGLAVEQAIGKPVSDLVEDDSVETVKNMLALALEGSEERGAEIRIRAFGPKRKSSPVELVVNTCCSRDMTNNVLGVCFIGQDVTGQKKLTENYSRVQGDYARIMWSPSTLIPPIFMTNENGVCSEWNNAMQKLSGIKREEVVNKILLGEVFTTDDYGCCLKDHDTLTKLRIGFNAVISGQKNIKKLLFGFYHRDGSFIEALLSANKRTDIEGKVTGVLCFLQVPSPELQYALQVQQISEHAIACALNKLAYLRHEVKDPEKAISFLQDLLHSSGLSEDQKRLLRTSVLCREQLAKVISDSDIEGIEEGYVELGCSEFGLQESLEAVVKQVMELSIERKVQISCDYPQEVSSMRLYGDNLRLQQILSESLLSSIRFTPAWKGLCVSFKVIARIEAIGKRMKRVELEFRIIHPAPGLP

SEQ ID NO: 22825 - protein, 422 aa, Oryza sativa (indica cultivar-group)
MSSHHRYALLLDDPFFPFPPPSSSSCPFLSPPAASSTCPFFALDSPFAADPFHLHPFLPTPPTSSLLDPFLLHTLTDRVSQLELALAARAPHPRPTSRKCTYVTESTGRKVKWTTEDKPRAGERVLKWEAELDSPYDDGFDRKWKWEAKAKTASAAATKLKWATHLKGKGCLEPWSHSYTWEEDFSATDDDDDEEIEDQLHHKALQDHSKLKTKAKDDKKKKKKDNNTVVVNKEQKKCPFSVKIEEIPPEEDNTAGCVAIRKAFALGNGKAKKKELSPQDAALLIQLNYRAHLAHRSQVLRCLRDLAVAKAKLKEIRSLFYNISYRHRMAHDHEERQRFTEKIIVLLLTVDALEGPDYMVRTAKKSMLDELEGMLEIVDPQPPGKQRSLTRRKFDLPEGGPITDEKMAGVNNAVKVIQKGKK

SEQ ID NO: 22826 - protein, 134 aa, Fulvimarina pelagi HTCC2506
MAATFADPAEAREQEEGLVFRPRFDAHGLVTAVVTDHETGRPLMVAHMNAEALATTIETGFAHYWSRSRQTLWKKGETSGALQSVRGIRVDCDQDAIWLSVTSAKPEDTCHTSRITCFYRKFDFESRTLVHSSS

SEQ ID NO: 22827 - protein, 328 aa, Zea mays
MSDLSRTVPQEQLVSQDLLHLSPTPVINLGHLSLDDSVTRSGVINQIARACHDLGYFQVTNHGISQSVMDCAVEAASDFFQLPSEAKEQFASQDLRKPVRYDTSSKDSISMSRAFLKHYAHPPRDWIQYWPDKPPIYREYMGKYAVEVRRVALHLMQAILEGLGLGKEYMNEKFQQGSQLLSVNCYPKASQDAMTIGLAPHSDYGFLTILLTSCQGLQVVDRSSDDSWKTVQQLPHALHVHVGDHMEVLSNGQIKTVVHRAVLNPEEARISIASIHGFELHEKVACAKELVDEQNPPKYKESSFTDFLDHLTANMDNKNRNFLESLRM

SEQ ID NO: 22828 - protein, 435 aa, Arabidopsis thaliana
MNNSTSVKRLVSSKAMKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAVKQLSRRGLQGHKEWVTEVNVLGVVEHPNLVKLIGYCAEDDERGIQRLLVYEYVQNRSVQDHLSNRFIVTPLPWSTRLKIARDTARGLAYLHQGMEFQIIFRDFKSSNILLDENWNAKLSDFGLARMGPSDGITHVSTAVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLVTSI

SEQ ID NO: 22829 - protein, 657 aa, Oryza sativa (japonica cultivar-group)
MRRRSSLVHAVLLAVAAVALPLAAGQPWPSCGTGGTYAANSTYETNLLDLISALQGNASSSPTLYASGAVGSGGRDAVYGVMLCRGDLSTSDCNDCGTRAGQDVGRVCNRTRDAALVYNQCYVRVSDADFLAAATNNSGEVALMSSTNITRAADVRAYDAAVVSLLNATVRYAVENSTRMFATGQRVGSDPGFSDIYSMAQCSPALSRPLCRSCLDGLVGQWWDTFPVNVEGARIAGTRCNLRSELNQGTFYTGQPMVVLRADGLAPAQGPAPAATTGGKNNSASKVLVIVVPIVAVAIVAATSFCIWNVRRKRRSRKAEHFSELDASEDLESVKSTLITLASLQVATDNFHESKKLGEGGFGAVYKGLLFGQEVAVKRLAKGSNQGLEELKNELVLVAKLHHKNLVRLVGFCLEEGERLLVYKYIPNKSLDIFLFDSEQSRQLDWATRFKIIEGIARGLQYLHQDSQKKIIHRDMKASNVLLDADMNPKIGDFGLARLFGQDQTRDVTNRIVGTFGYMSPEYVIRGQYSTKSDVFSFGILVIEIVTGRRNSGPHFLEQNEDLISIVRRHWEEGNIVEMTDHSLGRNYPEAELLKCVSIGLLCVQQNPVDRPTMADVMVLLNSDATSTLPAFATHSPTISIEGNSGYSQTVTQLSPR

SEQ ID NO: 22830 - protein, 285 aa, Triticum turgidum subsp. durum
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEQAARPQGYTEGEHVTGLPAPVAPASVQTHHDTDVVVEKIDGDVKTEAAPAVPEEEKKGFLEKIKEKLPGGHKKPEDAAPVPVTHAAPAPVHAPAPSAEEVTIPDPKEKKGLLGKIMDKLPGYHKTGEEDKSAAAAGRAQSQRLNAAVPETRDRTPIELLACVVFALR

SEQ ID NO: 22831 - protein, 175 aa, Nicotiana langsdorffii x Nicotiana sanderae
DFRWFALGNCIAILSSLATPEQASAIMDLIEARWDELVAEMPLKISYPALENHEWRLITGCDPKNTRWSYHNGGSWPVLLWLLTAACIKTGRPQIARRAIDLAESRLSKDVWPEYYDGKVGRYIGKQARKYQTWSIAGYLVAKMLLEDPSHLGMIALEEDKQMKPVIKRSASWTC

SEQ ID NO: 22832 - protein, 484 aa, Burkholderia sp. 383
MSFESLGLAEPLVKAVNELGYTSPTPIQQQAIPAVLGGGDLLAGAQTGTGKTAGFTLPILQRLHTFYADNRGAKRAVRALILTPTRELAAQVEESVRAYSKYLKLRSTVMFGGVSINPQIDALKRGVDIVVATPGRLLDHMQQKTIDLSNLDILVLDEADRMLDMGFIHDIKRVLAKLPPQRQNLLFSATFSDEIKALADSLLDSPALIEVARRNTTAESVAQKIHPVDRDRKRELLTHLIREHNWFQVLVFTRTKHGANRLAEQLTKDGISAMAIHGNKSQSARTRALAEFKNSTLQVLVATDIAARGIDIDQLPHVVNFDLPNVPEDYVHRIGRTGRAGATGEAVSLVCVDEKQLLRDIERLIKREIPQEVIAGFEPDPHAKPEPIQQRRGQQQPRSGGGGGGNRQPRAGGSGQPAAKRDGNAQPKASPQKAAKPRAQGQGQGGAGGSGGRPAGGGNSARPANGNAAHPNRNRSSRSGQRGH

SEQ ID NO: 22833 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELETAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKSEYDESGPSIVHRKCF

SEQ ID NO: 22834 - protein, 285 aa, Oryza sativa (japonica cultivar-group)
MAAPESAARVAEAAAEWGLFQVVNQGVPAAAVAELQRVGREFFALPQEEKARYAMDASSGKMEGYGSKLQKDLEGKKAWADFFFHNVAPPAMVNHDIWPSHPAGYREANEEYCKHMQRLARKLFEHLSTALGLDGGAMWEAFGGDELVFLHKINFYPPCPEPELTLGVAPHTDMSTFTVLVPNDVQGLQVFKDGHWYDVKYVPDALIIHIGDQIEILSNGRYKAVLHRTTVDKDRTRMSWPVFVEPPPEHVVGPHPQLVTDGSPAKYKAKKFKDYRHCKINKLPM

SEQ ID NO: 22835 - protein, 312 aa, Nicotiana langsdorffii x Nicotiana sanderae
LGDARRVLNKTSDSLEEAQLRLADIKQAAGIPEHCNDDIVEVPKRPKGDNVWRELIFSPTPAVRHILLTGVGIHFFQQASGIDAVVLYSPRIFEKAGIKTDRNKLLATVAVGFVKTIFILVATFMLDKSGRRKLLLTSVAGMVLSLMLLATGLTIIDQSEQKVIWAIALSITMVLAYVALFSIGMGPITWVYSSEIFPLRLRATGCSIGVAVNRVTSGVVSMTFLTLVKRITIGGAFFLYFGLAAAAFVFFFTLMPETQGKTLEEMEALFGTFWNWRKTARELKEAKITEKTEKNSNDNGQIQMGTAPAISS

SEQ ID NO: 22836 - protein, 211 aa, Phytophthora infestans
MNVMVLRRSAAAVAAKQSLSRTAPAAVAGSTRGFANIPAPGKQDPKPTWGEVIEKMSDTFFLSDVFRATWLAWEVHVERKVTINYPYEKGMLSPRFRGEHALRRYPSGEERCIACKLCEAICPAQAITIEAEPRADGARRTTRYDIDMTKCIYCGFCQEACPVDAIVEGPNFEFATESHEELLYDKAKLLANGDKWEFEIAKNLSVEQLYR

SEQ ID NO: 22837 - protein, 463 aa, Sinorhizobium meliloti 1021
MNTDSKCDAIEAMFPAPKLAALGLQHVLVMYAGAIAVPLIIGSALNLSKDQIAMLISADLFCCGIVTLIQCLGVWNVGARLPIMMGIGFTAVPPIIATGTDPDLGMPGVLGAVIASGVFTLLAAPYFSRWVRFFPAVVTGTVMLVIGLSLMRVGVNWAAGGQPMIKGPDGLIPNPAYGEPFALAVAAIVLVSILLMTRFLKGFLANLAVLFGIGIGFAIAVAFGKVDFQGVADASWVTVVTPFAFGMPIFDLWATVALCTVMIVMMIEATGQILAVGDMAGRTISEADLARGLRTDGLGNIIGGIFNTFTYTTYAQNVGLLQITGVMSRWAVAAGGVVLILLGCLPKIAFITASIPSYVVGGAAIVMFGMVSATGVKILARVNFVDNRRNLYIVAVSVGLAMIPVVADKIFAQLPEFIDRFFHSGVLVGTFSAVLLNLLFNGVPPREEVQPDLLGEGAMRHPG

SEQ ID NO: 22838 - protein, 638 aa, Ostreococcus tauri
  misc_feature (1)..(2): Xaa can be any naturally occurring amino acid
  unsure (1)..(638): unsure at all Xaa locations
XXQKIGIPATLAAIYLGFLDRLKTRGELDACGDIRVTLRVSRGADPTPRRPMGITADESCPNGSVVVTGDDVVRMQLMALKRAFWPWEWDDARDSGFLLAIEAAAYGKDDRMNTAAGVVGIIQPTGRPFGDLPMALLVTERLAELDGNVGYEQRDMGVLLYHSGYRRDARDALVAFEQWKATAKLAAVEVDDATDAPRPDFQWVAGDPVEAARLSLREDEALNKLLLELDRDSLEHIFDSEASSPSTPSTRAVSRASFTPMCVAFIAISGRTADADASNATARENVQLVIAFNRDEDYERPTSSVRTWSDTARDGTENIVGARDDLGGGTWMAVCKRTGRWALLTNATDGSGSKGETKTTNESSSGVNRARVTRGELVTTYLRRDVDGEAYALEVFAKRFNYDGFNLVVGDSTRRSAFWVGNRGSANAKTPMKLMEGRVYGLANDVLDAPWPKVVRGKAKMEEILRAFTELAPEARGTRALEERILRDVLHAPVESVHPVSRTSASTRVVVGPASLSRPRRVSDIEVDADVDGDRIEVDCSDDEEEYIDLPVEQIEPHESESSFVRPGELPGRPNCGTRTSQVVVVSADGRCSWLEHHFVPNVEKPKRGDLFYSPVVAQDHERCEFAFGARGAAAGAA

SEQ ID NO: 22839 - protein, 454 aa, Phytophthora infestans
MVSIVSIKARQIFDSRGNPTVEVDLVTELGEYRAAVPSGASTGEFEALEMRDGGKDYMGKGVLNAVKNVNEIIAPALIGKDVTKQAEIDRFMVEKLDGTQNEWGWYKKKLGANAILGVSLALCRAGAAAKKQPLWQHIADLAGNPTPCLPVPSFNIINGGSHAGNKLAMQEFMILPVGAKNFTEAMKIGSEVYHNLKKVIKGRYGLDATAVGDEGGFAPNIQSNGEAIDLIEEAIKAAGYTNQVRLGMDVAASEFYTGAEDARYNLDFKNENAAESEKIPADKLLEVYEGFIAKCADSSKIVSIEDPFDQDDWESWVKITGKVGKDVQIVGDDLTVTNPTRVKKAIEQKACNALLLKVNQIGSITESIEAVTMAKKAGWGIMASHRSGETEDTFIADLAVGLSAGQIKTGAPCRSERLAKYNQLLRIEEELGNKARYAGEDFRDVEKLGKYSTF

SEQ ID NO: 22840 - protein, 511 aa, Oryza sativa (indica cultivar-group)
MALLLRHSPKRLPVAAVSSSNLHPEYAKKIGGSDFSHDRQSGKELQNFKVSPQEASRASNFMRASKYGMPITANGIHSLFSCIVYCPDLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNRLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 22841 - protein, 293 aa, Sinorhizobium meliloti 1021
MSKKAFVALVTCFNEDETINYDATRAQVRRQVAAGNNIMCAGTNGDFTALTHEEKIRLTEEVVDEVGGRVDVIVNAGMPATFETLQLARAFDRIGVSGIAVITPFFIACTQDGLIRHFSTVADAVETPVYLYDIPSRTQNHIEPETALKLSAHGNIAGIKDSGGAQDTLEAYLQVARDVPGFEVYSGPDHLVLWSLQNGAAGCISGLGNAMPEVLAGILSAFNSGNIAEAERRQAIYTAFRTELYALGFPPALVKRSLYLQDPSVGASRQPALLPSEEQDAKIREILVRHRLL

SEQ ID NO: 22842 - protein, 427 aa, Frankia sp. EAN1pec
MPSIEAVGAREILDSRGNPTVEVEVVLEDGTLGRAAVPSGASTGAFEAVELRDGGDRYGGKGVTKAVEAVIGRIGPAIMELEATEQRLLDATLIDLDGTPGKSALGANALLGVSLAVAKAAAASSGLPLFRYLGGPSAHLLPVPMMNILNGGAHADTNVDIQEFMIAPIGAGTFAESLRWGAEIYQALKSVLKGRGLATGVGDEGGFAPSLPTNREALDLIAEAIDKAGFGLGDDIALALDVASTEFFADGSYTFEGSGRSAEQMIDYYADLVDSYPIVSIEDPLAEDDWAGWTSITTRLGARVQLVGDDLFVTNPERLARGIAEGAANALLVKVNQIGTLTETLDAVNLAHRSGYRCMMSHRSGETEDTTIADLAVAVDCGQIKTGAPARSERVAKYNQLLRIEEELDDAARYAGAGAFPRRTTTG

SEQ ID NO: 22843 - protein, 276 aa, Bacillus subtilis subsp. subtilis str. 168
MNVPFWTEEHVRATLPERDAESHKGTYGTALLLAGSDDMPGAALLAGLGAMRSGLGKLVIGTSENVIPLIVPVLPEATYWRDGWKKAADAQLEETYRAIAIGPGLPQTESVQQAVDHVLTADCPVILDAGALAKRTYPKREGPVILTPHPGEFFRMTGVPVNELQKKRAEYAKEWAAQLQTVIVLKGNQTVIAFPDGDCWLNPTGNGALAKGGTGDTLTGMILGMLCCHEDPKHAVLNAVYLHGACAELWTDEHSAHTLLAHELSDILPRVWKRFE

SEQ ID NO: 22844 - protein, 324 aa, Synechocystis sp. PCC 6803
MAETLLFAALRQALDEEMGRDVNVLVLGEDVGLYGGSYKVTKDLYEKYGEMRVLDTPIAENSFTGMAVGAAMTGLRPVIEGMNMGFLLLAFNQIANNAGMLRYTSGGNYQIPMVIRGPGGVGRQLGAEHSQRLEAYFHAVPGLKIVACSTPYNAKGLLKAAIRDNNPVLFFEHVLLYNLKENLPDYEYIVPLDKAEVVRPGKDVTILTYSRMRHHCLQALKTLEKEGYDPEIIDLISLKPFDMETISASVKKTHRVIIVEECMKTGGIGAELIALINDHLFDELDGPVVRLSSQDIPTPYNGMLERLTIVQPPQIVDAVKAIIG

SEQ ID NO: 22845 - protein, 866 aa, Oryza sativa (japonica cultivar-group)
MLGGIIDTITGSSKQSRLKGTVVLMRKNVLDLNDFGATVIDGLGEFLGKGVTCQLISSTAVDPNNGNRGKVGAEASLEQWLTSSLPSLTTGESRFGVTFDWDVDKLGVPGAIIVKNHHSNEFFLKTITLDDVPGRAGAVVFLANSWVYPADKYRYDRVFFANDAYLPSQMPAALKPYRDDELRNLRGDDQQGPYEEHDRVYRYDVYNDLGSPDSGNPRPILGGSPDTPYPRRGRTGRKPTTTDPDSESRLSLVEQIYVPRDERFGHLKMADFLGYSIKAIAEGIVPAIRTYVDTTPGEFDSFQDILDLYEGGLKLPDVPALEELRKRFPLQLVKDLLPAAGDYILKLPMPQIIKQDKEAWRTDEEFAREVLAGVNPMMITRLTEFPPKSSLDPSKFGDHTSMITAAHIGSNLEGLTVQQALDSNRLYILDHHDRFMPFLIDVNGLEGNFIYATRTLFFLRGDGTLAPLAIELSEPMIQGDVTAAKSTVYTPASTGVEAWVWQLAKAYVAVNDSGWHQLISHWLNTHAVMEPFVIATNRQLSVTHPVHKLLSPHYRDTMTINALARQTLINAGGIFEMTVFPGKYALWMSSMVYKNWNFTEQGLPADLIKRGVAVEDATSPYKVRLLIKDYPYAADGLEIWHAIEQWVGEYLAIYYTDDGVLRGDAELQAWWAEVREVGHGDLKGAAWWPRMDAVSELRDACTTIIWIASALHAAVNFGQYPYAGYLPNRPTVSRRRMPEPGTEAYGELGRDPERAFIRTITSQLQTIIGISLIEVLSKHSSDEVYLGQRDTPAWTSDARALEAFRRFSDRLVEIEGKVVGMNGDAGLKNRNGPAEFPYMLLYPNTSDVTGAAAGITAKGIPNSISI

SEQ ID NO: 22846 - protein, 484 aa, Prochlorococcus marinus str. MIT 9312
MAGETLDNIKFGTDGWRGIIGFDFNISNLSRVVVAACQELHYQFHKEVNSKKILIGYDRRFMAIEFAKQIVPFVKGCGFEPILSNSFVTTPSCSFYAKEMNCLGALVITASHNPYNWLGLKIKSFNGCSVDESFTTEIEKRLMLGNAIDKLEDSYEIADVKKLHLDRIKSLFDIEFIANQLKKMNMRIFVDSMHGSAAKCIAEIFGGNDSEVVSEIREDADPFFGGNPPEPLLNYLDDLNETLIKNSKNEVKTLGIIFDGDGDRIAAIDEKGRYCSTQDLLPYFISYLGEINHNSYPVLKTVSGSDIIKNISESQNRDVFELPVGFKYIAEKMIKEKIFIGGEESGGVGFGNFMPERDALYAAIVLLNGIAEKSQYLYETLDEIQKDFGPSVYKRIDIKFPNQSEKNNVKEFIIDNIPENINNHKLKSISKIDGIKLRIDKNFWLLFRFSGTEPLLRLYCEAPKESYLDELLEWGQVFINLAGK

SEQ ID NO: 22847 - protein, 142 aa, Bradyrhizobium sp. BTAi1
MTVRAILDIKGHQVESVEPQTTLADAAKLLADRKIGAVLVMSGSRMEGILSERDIVRSLGERGAAVLTEPVSGVMTRRVVSCRPADTVASIMETMTTGKFRHLPVIDGGLVVGLISIGDVVKWRVQEYEAEQEALRQYIKTA

SEQ ID NO: 22848 - protein, 445 aa, Hordeum vulgare subsp. vulgare
MPALRMKRKFDDDIFGSEFDIKSMKSVKISPSQVDEFEQAFVLNSSYKDPQDEPEPITQLAVQDIRVTEFSGLHAVLGGTSVALLKDLISETVVPPNLEPDSLSNNDDGKSQSNVVNTGDKEFADEDVNSAAQDICTVNDHEKSLGSNPDCSLLDIYNPDDAFPFLFDVPTGLLASYSTFCDEFVPIDSLTDMSGICGVFPLNESTVEGCIGNEPCPSQGDMCFNNFGGECFSHSEVLEWFNPYMDESDVPNLIGYTELSSDAACVSKEQGARKVTLVLDLDETLVHSTLEHCDDADFSFPVSFGLKEHVVYVRKRPHLHMFLQKMAEMFDVVIFTASQSVYADQLLDRLDPENTLFSKRFFRESCVFTESGYTKDLTVIGVDLAKVAIIDNTPQVFQLQVNNGIPIESWYNDPFDEGLSQLIPFLETLAVADDVRPIIAKRFGN

SEQ ID NO: 22849 - protein, 201 aa, Prochlorococcus marinus str. MIT 9312
MSSLRQSEIKRKTNETDISVLINLDGNGISEIETGIPFLDHMLHQISSHGLFDLKIKAIGDTHIDDHHTNEDVGIALGKAFSKALGERKGISRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSDSIPSSKGMLENQ

SEQ ID NO: 22850 - protein, 1125 aa, Populus tremuloides
MSSSRPSHSSSNSARSRHSARIIAQTTVDAKLHADFEESGSSFDYSSSVRVTDSVGGDQPPRSDKVTTAYLHHIQKGKLIQPFGCLLALDEKTFRVVAYSENAPELLTMVSHAVPSVGEHPVLGIGTDIRTIFTAPSASALQKAMGFGDVSLLNPILVHCKTSGKPFYAIVHRVTGSLIIDFEPVKPYEVPMTAAGALQSYKLAAKAITRLQSLPSGSMERLCDTMVQEVFELTGYDRAMAYKFHDDDHGEVVSEVTKPGMEPYLGLHYPATDIPQASRFLFMKNKVRMIVDCHAKHVKVLQDEKLPFDLTLCGSTLRAPHSCHLQYMENMNSIASLVMAVVVNDGDEDGDTPDSANPQKRKRLWGLVVCHNTSPRFVPFPLRYACEFLAQVFAIHVNKELELENQIVEKNILRTQTLLCDMLMRDAPLGIVTQSPNIMDLVKCDGAVLFYRNKIWRLGITPSDLQLQDIAFWLSEYHMDSTGLSTDSLYDAGYPGALALGDVVCGMAAVRITSKDMLFWFRSQTAAEIRWGGAKHEPGEKDDGRRMHPRSSFKAFLEVVKTRSLPWKDYEMDAIHSLQLILRNTFKDIETMDVDTKTIHARLSDLKIEGMQELEAVTSEMVRLIETATVPILAVDVDGLVNGWNTKISELTGLLVDKAIGKHLLTLVEDSSVDIVKRMLFLALQGKEEQNIQFEIKTHGSKSECGPICLVVNACASRDLHENVVGVCFVGQDITGQKMVMDKFTRIEGDYKAIVQNRNPLIPPIFGTDEFGWCSEWNPAMTNLTGWKREEVLDKMLLGEVFGLNMACCRLKNQEAFVNLGVVLNTAMTGQESEKVSFGFFARTGKYVECLLCVSKKLDREGAVTGVFCFLQLASQELQQALHVQRLSEQTALKRLKALAYLKKQIWNPLSGIIFSGKMMEGTELGAEQKELLHTSAQCQCQLSKILDDSDLDSIIEGYLDLEMVEFTLREYYGCYQSSHDEKHEKGIPIINDALKMAETLYGDSIRLQQVLADFCRCQLILTPSGGLLTVSASFFQRPVGAILFILVHSGKLRIRHLGAGIPEALVDQMYGEDTGASVEGISLVISRKLVKLMNGDVRYMREAGKSSFIISVELAGGHKSQKRA

SEQ ID NO: 22851 - protein, 416 aa, Burkholderia sp. 383
MTNDRVMAIVGAGHAGGRAAQVLRESGWGGRIVLIGAEAHLPYERPPLSKGVLTGERSAARCRLREPEAWVADRIEPVVATVERIDPCAREVHVSGARVFGYDALLLATGGRARRLAIPGATLDGVFALRTLDDAAALGSRLVPDARVVLIGGGFIGLEVAASARRRGCRVTVLDAAPRLLGRAVPETIAARVHALHEQQGVAIRVSRKPVAIERTASGALAVVLDDGDTLIADTVVAGIGIEPADELARDAGLAVERGIVVNERLETSAHGIYAAGDVAVFPSALSGRPVRQETWHGAETQARVAARNMLGADEPYRDTPWFWSDQYDAQLHVAGEPALGERSVARVLGDDAEIHFHFDAGARLVAASGFGRASGFIKEMRVARMLVERGAGVTPTAVADVNVKLKSLIGEAGGR

SEQ ID NO: 22852 - protein, 336 aa, Zea mays
  misc_feature (105)..(105): Xaa can be any naturally occurring amino acid
  unsure (1)..(336): unsure at all Xaa locations
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTAXLAFVTLKHDGEREFMFYRNPSADMLLTEAELDLGLVRRARVFHYGSISLISDPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 22853 - protein, 347 aa, Streptomyces coelicolor A3(2)
MLVESLPTPAQEKDRERGSDFSELSRRIAGAGLLRRRPLYYTVRFGAVALALAGGVAAFVALGDSWSQLFVAVALAVVFGQLGLAAHDLAHRQVFTRRRPSEAGGLLTANLLLGMSYGWWMNKHTRHHANPNHEEKDPDVSPDILVWSRGQASRATGLPRFVGRHQAALFFPLLTLEGLNLSFNSFKALGSRAVKRPVLEGTLLVAHFAVYFGGLFTVLSPGKALVFLAVHQGLFGIYLGSVFAPNHKGMPMIEEGMRLDFLRRQVLTSRNVRGGALVDAFMGGLNYQIEHHLFPSMPTPALGRAQAITEAYCAELGVPYHQTGLLASHREALRHMRSVGEPLRAAR

SEQ ID NO: 22854 - protein, 416 aa, Ostreococcus tauri
MRCEETRNAERVRIMTFNVLCPAYKRSGDDGRESDDGTRAMTRTMRAIDLVTSTSSDVMCAQEFWHADEATAAAWMTALERDGGRCDGLLTAVKKETLELLDARDVLFNDCGDRVACVVRARRTSDGTELIVVNTHLLFPHNENSSLIRLRECFKILEYLRGMMREPELRGRKVPIVVTGDFNGSNKGRVYQFFKSQGFVSALDSCQARDGCVTPWISHLNHHGECVGVDHMFLLNPSRQVIELGASWKEAVFAMMRAKIVEKGLVDDVAAFAAVDENDDGLLSKDEFFEFANRIGLCGEKSPGLLPAELEALYDACDKDGNGMLDFQEFVETMDIEGMAQASSMTSLDVGDFMASSAAGVVVFPMDSWDQDVWEIGDLAIKNALLPDAMIEGQWPSPDDFDVSDHGPLVVDFALQ

SEQ ID NO: 22855 - protein, 307 aa, Streptomyces coelicolor A3(2)
MSTPTTFRPVLERIAEEIERTPGSGRPADYIPALAARDPRRFGMAVAELDGTVYGVGDWREPFSAQSLTKVFTLALDLAREGDALWEHVGREPSGNPFNSLVQLEYENGIPRNPFINAGALVVTDRLHTRTGDAAGELLAFLRAESGNPDLGHDEEVAASEAAHGDRNAALAHFMASYGNIDNPVPVLLDQYFRQCSVAASCADLALATGFLARHGIRADGTRLLSRSRAKQINAVMLTCGTYDAAGDFAHRVGLPGKSGVGGGIIAVVPGHCTLCVWGPGLDERGNSVAGVAALDRFTTLTGLSVF

SEQ ID NO: 22856 - protein, 171 aa, Phytophthora infestans
MPNPQVFFDMTVGGAPAGRITFELFADKVPKTAENFRALCTGEKGVGRSGKPLHFKGSSFHRVIPNFMCQGGDFTRGNGTGGESIYGEKFPDENFLLKHKGEGILSMANAGPNTNGSQFFICTVETSWLDGKHVVFGRVVDGMDVVKNIESVGSQSGQTKKPVVVANCGEL

SEQ ID NO: 22857 - protein, 395 aa, Sinorhizobium meliloti 1021
MTPDEIANAMTGKLRETGGGRLESLLPSPMVQNHAAFLHRLEDGSLVCAWFGGTLEGKSDISIFASVLAPDAAQWGEPQRLSFDAEHSEQNPVLFTAPDGRLWLFHTSQPSGNQDECRIRMAAIERDAADPTRLAVSEGRYLDLPRGCFIRAPLVIRDDEAWLLPIFRCIQRPGQKWNGSHDNAAVGVSIDGGRSWQLADLNGSIGCVHMSPVRVGDTGYAAFFRRRQADQVYRVESVDGGRTWSLPAPTDVPNNNSSIAVVRLRDGRLAMICNPVNAALSADRRASLYDELGDDDGRPDADPSGGCVPIWGVPRAPVSVCLSADDGRTFPDRIAIEDGPGTCLSNNSTDGHNKEMSYPWLLEGHDGSLHVAYTYHRRAIKYVRLPPGWADEGRN

SEQ ID NO: 22858 - protein, 272 aa, Synechococcus sp. WH 5701
MRFRPLLALVLALCLTLVTACGGGAKAVERANVTYDDIVNTGKANDCPTLPDSARGSIPLDPSGSYQLREICLHPSEVFVKGEPANKRQEAQFVAGKILTRYTSSLDQVYGDLTIDGAQLTFKELGGIDFQPITVLMPGGEEVPFTFSSKQLIATAEGTAISPSTDFEGAYRTPSYRTANFLDPKGRGLTTGYSSAVGLVPAGDDEDLTKENVKQYIEGTGTMNLSITKVDSVTGEFSGVFSAVQPSDTDMGGKVAVDVKVTGELYGRLEQV

SEQ ID NO: 22859 - protein, 377 aa, Ostreococcus tauri
MGARDGARASTAVTTKPRRDRMARAIASTDVDAVFDALAGDLATCGDGARRWCDRRTVERFVRADKGDVVKATKRLRRTVRWRDGAKPEETRCERCFEGDFGSHYMQQIGFDACGRAVVYSDIGLALDGKPASNVEHCVQVLELLERFLPEYPYDQYVWVCDFHKLGAGSMNPNTAMKCLSLFARSYPERLEMMIFVEAPKLFNGLYKMLTAFVDPVTVQKLRFVKGPSGKGGGGSLAETFDELLSEETSKWLTTEMRMNREMWSVVKTKKSWIKSMIIENGVMEEAAAFPDFASHDCRGTDEFLNSPAGAHAAAFVKRHALGSKLAAKERLLPEFCAPIEDEAEDARIDQTEALTKTFSFVKLDEVVDARQFDRFE

SEQ ID NO: 22860 - protein, 294 aa, Arabidopsis thaliana
MAYHQPYDPFYVYQLHSHPHHLPPQLPLLADEPGAINTLFVSGLPNDVKAREIHNLFRRRHGFESCQLKYTGRGDQVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANLTDRFLQGHLEKASEGGSGARACSTLFIANLGPNCTEDELKQLLSRYPGFHILKIRARGGMPVAFADFEEIEQATDAMNHLQGNLLSSSDRGGMHIEYARSKMRKQ

SEQ ID NO: 22861 - protein, 700 aa, Burkholderia pseudomallei K96243
MTNQNRRDFLRLAAGTAGAAALQLFPPVIREALAIPANRRTGTIRDVEHIVILMQENRSFDHYFGKLRGVRGFGDPRPLALQNGKSVFHQPVLLGPAELLPFHPDASNLGMQFLQDLPHGWQDMHGAWNKGRYDRWIANKGTTTMAYLERDDIPFHYQLADAFTICDAYHCSIPSSTDPNRYYMWTGYVGNDGAGGGPVLGNEEAGYGWSTYPETLEQAGVSWKIYQDIGTGLDAAGSWGWTQNPYIGNYGDNSLLYFNQYRNAQPGSPLYDKARTGTNVSAGGTLFDVLQQDVKNGTLPQVSWICAPEAYSEHPNWPANYGAWYVEQVLKALTSNPDVWSKTALFITYDENDGFFDHVAPPFAPQSRENGLSTVSTAGEIFAGDATHMAGPYGLGPRVPMLVVSPWTKGGWVCSQTFDHTSLLQFIEARFNDRYSVRAPNVTPWRRAVCGDLTSAFNFSSPDGSWPQLPDTSGYAPPDRNRHPSYVPVPPAAQSMPKQEAGLRAARALPYELFVLGRIDQSTGKFKLTFANTGRAGAAFQVTAGNRLDGPWAYTVEARKRLSDEWSTALTLSIYDLTVYGPNGFLCQFRGSTAAALGLSANPEVIYGYDVANGNITLRLSNRGRAAVRLTVTNAYGNAAPRVYELKPGQRINDYWDLRDSHSWYDLSVSDGAPNGFLRRFAGHVETGRPSTSDPLIATA

SEQ ID NO: 22862 - protein, 433 aa, Magnetococcus sp. MC-1
MSKETITIRDNRTGKEVELPIQQGTAGPPVVDVTKFYKDFGLFTLDPGFRSTGSCRSTITFIDGDKGVLLHRGYPIEQLAAKSSFLEVCYLLLNEKLPTKAEFDDFDDKITHHTMVHEQLLRFFAGYRRDAHPMAIMVGVVGALSAFYHDALDISDPKHREISAHRLIAKIPTIAACSYKYHYGQPFVYPNNKMSYAENFLNMTFRTPCDDDFKIDPRLVSAMDKIFILHADHEQNASTSTVRLAGSSRANPFAAVSAGISALWGPAHGGANEAVLKMLGEIGSVERIDEYIAKAKDPNDPFRLMGFGHRVYKNYDPRAAVLKGACQEVLDAVGKHDEPLFKIAMKLEEIALNDDYFISKKLFPNVDFYSGIILSAMGFPTNMFTVIFALARTVGWVSQWKEMIEEEGQAIGRPRQLYMGAPQRDYVPMDQRG

SEQ ID NO: 22863 - protein, 606 aa, Frankia sp. EAN1pec
MVRQIRPTDSDNAAAAASGTDDGAEGILARPFPGSRKTYLVGSRPDLRVPMREVALSTGDSLVLYDTSGPYTDPGAGVDVRRGLPALRAGWIAARGDTEEIEGRAVQPADDGRRGPDGQAGDTFLGSGQAPRRATAGRAVTQLAYARRGEITAEMEFVALREGLSPELVRDEIAAGRAVLPANVNHPESEPMAIGRNLLVKINANIGNSAVASSIEEEVEKMVWSTRWGADTVMDLSTGRNIHTTREWIIRNSPVPIGTVPIYQALEKVGGKAEELTWEVYRDTVIEQAEQGVDYMTVHAGVLLRYVPMTARRKTGIVSRGGSILAAWCLAHHEENFLYTNFAELCEILRAYDVTFSLGDGLRPGSISDANDAAQLAELATLGELTSVAWEHDVQVMIEGPGHVPMHKIKENVDLQRELCHDAPFYTLGPLTTDIAPGYDHITSAIGAAMIGWYGTAMLCYVTPKEHLGLPDREDVKAGVIAYKIAAHAADLAKGHPGSQAWDDALSDARFDFRWDDQFNLSLDPETAREYHDETLPAAPAKSAHFCSMCGPHFCSMRITQDVRKYAADHGLDTDEAVQAGLAEKSREFAEQGARIYLPLADRQTP

SEQ ID NO: 22864 - protein, 881 aa, Medicago truncatula
MKQKLIGMLLPLHFLSVLFGVLTTLVLVQAQDQSGFISIDCGLPQKSSYSETSTGISYISDAKFIDSGVSKRILPTSNTVLQQLEYVRSFPSGVKNCYKIDVTNGTKYLIRASFYYGNYDDLNEPPQFDLHFGPNVWDTVKFTNLSRMTIKEIIYTPSLDYIQPCLVNTGKGTPFISAIELRTLDNKAYVTYAAKSSVLSYFFRFDLGSITNLEYRYKDDVLDRIWYAFEWNEMKRISTKDDILIQNIYKPPAVVMSTAVTPVNASAPIQFSFDAVNVNDQYYIYLHITEFENLAANESRSFNITVNGILMYGPEIPVYRSVDSIFSTIPLTGATKYIFTLSKTDNSTLPPILNAVEVYKVKNFSQSETQQDDVDTMRNIKKAYGVARNWQGDPCGPVNYMWEGLNCSLDGNNIPRITSLNLSSSGLTGEISSSISKLTMLQYLDLSNNSLNGSLPDFLMQLRSLKVLNLGKNNLTGLVPSGLLERSKTGSLSLSVDDDNLDPCMTESCKKKNIAVPLVASFSALAVILLISLGFWLFRKQKRQKAVVTPSNSKKRSSMKSKHQKFSYTEIVNITDNFKTIIGEGGFGKVYFGTLQDQTQVAVKRLSPSSMQGYNEFQSEAQLLMIVHHRNLVSLLGYCDETEIKALIYEYMAKGNLQQHLLVENSNILNWNERLNIAVDAAQGLDYLHNGCKPPIMHRDLKPSNILLDENLNAKIADFGLSKAFGNDDDSHISTRPAGTFGYVDPFQIPGNTNKKNDIYSFGIILFVLITGKKALVRESGESIHILQWVIPIVKRGDIQNIVDKKLQGEFNISSAWKVVEIAMSCISQTVSERPDISQILAELKECLSLDMVQSNNGSMRARDELVSIALHVSETTILAR

SEQ ID NO: 22865 - protein, 876 aa, Medicago truncatula
MKQTVIGMLLHFLLVLFGVLAILVLIQAQDQSGFISIDCGLSELSSYSETDTGINYISDAKFIDSGVSKRIPPTEIIVKQQLEHVRSFPSGVRNCYRINVTSDTKYLIRASFYYGNYDDLNEPPQFDLHFGANVWDTVKFTNLSLIATSEIIYTPSQDYIQPCLVNTGNGTPFISSIELRTLNNTAYVTNSTKTVLSNFLRFDIGSITNIEYRYKDDVFDRVWFPYEVDWARLNTSLNNNDLVQNDYEPPRIVMSTAATPVNASAPMQFHWSVDNENDQYYAYFHFNEVEKLAENETRSFNITVNGDFLFGPEIPVHQAVHTIVSTKPLTGAARYLFSLLKTENSTLPPILNAYEVYKVMDFPQSETEQDDVDTITNIKKAYGVARNWQGDPCGPVNYMWEGLNCSIDDANNPPRITSLNLSSSGLTGEIASFISKLAMLEYLDLSNNSLNGPIPDFLIQLRSLKVLNVGKNNLTGLVPSGLLERSKTGSLSLSVDDDNLGLCTMNCKKKNIAVPLVASFSALVVIVLISLGLWILRRQKVVVTSSNSKERGSMKSKHQRFSYTEILNITDNFKTTIGEGGFGKVYFGILQDQTQVAVKRLSPSSMQGYKEFQSEAQLLMIVHHRNLVSLIGYCDEGEIKALIYEYMANGNLQQHLFVENSTILNWNERLKIAVDAAHGLDYLHNGCKPPIMHRDLKPSNILLDENLHAKIADFGLSRAFGNDDDSHVSTRPAGTIGYADPEYQRTGNTNKKNDIYSFGIILFELITGKKAMVRASGENIHILQWVISLVKGGDIRNIVDTRLQGEFSISSAWKVVEIAMSCVSQTTAERPGISQISTELKECLSLDMVQRNNGSTSARDELVSVATVSVSTFLAR

SEQ ID NO: 22866 - protein, 136 aa, Cichorium intybus
MARTKQTARKSTGGKAPRKQLATKAWNTLATATGGVKKPHRFRPGTVALREIRKYQKSTELLIRKLPFQRLVREIAQDFKTDLRFQSSAVAALQEASEAYLVGLFEDTNLCAIHAKRVTIMPKDMQLARRIRGERA

SEQ ID NO: 22867 - protein, 136 aa, Griffithsia japonica
MARTKQTARKSTGGKAPRKQLATKAARKSAPASGGVKKPHRFRPGTVALREIRRFQKSTELLVRKLPFQRLVREIAQDFKSDLRFQSSAVLALQEAAEAYMVGLFEDTNLCAIHAKRVTIMPKDIQLARRIRGERT

SEQ ID NO: 22868 - protein, 434 aa, Ostreococcus tauri
MQTVELTARTAIAGNFRKATTPRADAKVRVCAIDRDRARVRRARGARRLTNATACVTQANVNVVTEAKVKVAINGFGRIGRNFVRCWKTRGPDCPLQVVCVNQSGGAKPAAHLLKYDSILGTFKSDVKVIDDSTISVDGDVIKVVSDRDPLNLPWKEMGIDIVIEGTGVFLDGPGAGKHITAGAKKVVITAPAKGNDIPTYVVGVNADQFDPSANIVSNASCTTNCLAPFAKVIDDKFGIVKGTMTTTHSYTGDQRILDASHRDLRRARAAALNIVPTSTGAAKAVALVLPQLKGKLNGIALRVPTPNVSIVDLVVNVEKKGVTAEEVNAAFKEYADGPMKGVLAITDTPLVSVDFRCTDVSTTIDAALTMVIGDDMVKVVAWYDNEWGYTQRVVDLTLIVANSLINEGSVTLDPLDQLCSDDPSADECKVFDS

SEQ ID NO: 22869 - protein, 123 aa, Porphyra yezoensis
MKANSTKLSQLMKSVEIPFIKTEVPEIKVGDTIQLGLMVKEGSKTREQLCEGVVLARRRKKSLNTSLTLRCSFQGIGVERVFFLNSPRITFVKVIRRAKIRRAKLYYLRDLLGKAGRLKQIFN

SEQ ID NO: 22870 - protein, 422 aa, Phytophthora infestans
MPLPPPTSALERLDALAETYGTPLQIYDEQLIRDNARRLLTAFRAHFPDFQQFYAVKALPNPAILKLLHQEGCGMDCSSSAELHIVKELGVPGDQVIFTSNFTAKNDLGTAFDQGVIMNLDDVSLVDSLVAVRGKCPELMSFRLNPGIGRTDSETKSNVLGGPDAKFGVPPFQIVEAYRKAQQAGAKGFGIHMMTGSCVMNQEYWRETVTVLFNTIVQLKKELGIEFEFMNIGGGLGIPYREDQEPVNVEAIAKMLREVFDEAVKEHGLQTLPRLCMENGRFMTGPFGWLVTRCEAIKETYGRYYGVDACMAHLMRPGMYGAFHHISIPARANEEVSPSHVVGTLCENNDWFAKDRPLPKAQVGDLFVIHDTGAHSHSMGFQYNGKLRAPEVLLRADGSDSLIRERETYDALYGNCVIPADL

SEQ ID NO: 22871 - protein, 497 aa, Legionella pneumophila
MIRNSMKSHTELLSWNLLQKEADRVRLNSDSLTCVVPDSNNYESSKQINCIEYDYSRQRVNRTIIDLLIDLANEVKLQEKIDNLINGKKINISENRPALHTALRDLGNKSIMIDGLDIMSAVINTREKIKVISNQIREKKWLGHSGLPITDIVNIGIGGSDLGPRVCINALSNYISKEFNYHFISDVDPASFNDVIAKINPQTTLFIVSSKSFTTKETLLNARKAFALYEDTASIDQHFIAVTAHPERAYQMGIKTVLPIWDWVGGRFSFCSAVNLITAIAIGYEQFVELLAGAHDIDTHVQFTDFKNNIPVLMALIGIWNNNFLNIHYDLIGYNFKEYFVPYVQQLDMESNGKSIDVNGRMVDYATGPIVWGGLGNQAQHSYFQLLCQGTHRCVGDFITLKTNDEHEINSMCHYKMKVLSEGIQTIENPYGYIPGNMPMNHLILSDCSPYTLGALVALYEHKIFEQSVIWNINPFDQPGIESAKSAHREITLSSES

SEQ ID NO: 22872 - protein, 680 aa, Bacillus cereus ATCC 14579
MYKTFTNISEGKNSMSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYDNFRKTVQDVGETAQAEWNTMLGEYAQAYPELANEFQAAMNGQLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDAAVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 22873 - protein, 450 aa, Oryza sativa (japonica cultivar-group)
MRCLPFLHGDSKEEDPVNKSASVRSLSTTSTERDVRSGSDFNSLNVSDMSAESIRRTQYPSFTDRPSNLRVFSFSELKNATRNFSRSLMVGEGGFGCVYRGVIKNSDEPTERTEIAVKQLNRKGLQASYFSSELYRLQAFNAHSNFLLLGQKEWLTELNVLGIVEHPNLVKLIGYCAEDDERGVQRLLVYEYMPNGSVDDHLSSRSNSTLSWPMRLKVALDAARGLKYLHEEMEFQVIFRDLKTSNILLDENWNAKLSDFGLARHGPSEGLTHVSTAVVGTLGYAAPEYMQTGRLTAKSDIWGYGVLLYELITGRRPIDRNRPKGEQKLLDWVKPYISDIKRFPIIIDPRLEGHYNLKSMTKLASVANRCLVRLPKSRPKMSEVYEMVQKIVASIETGTPQPPLHYHGSVSEPGSKRPKKGSLKRRFQEFKFGCRQIVWRSWKPEIIKTC

SEQ ID NO: 22874 - protein, 622 aa, Populus tomentosa
MEAGKKNSLFCCVASLICLWTTAYGELTAAGVNYEVEALMGFKNSLHDPHNILNWDEHAVDPCSWAMVTCSPDNFVTSLGAPSQRLSGTLSPYIGNLTNLQSLLLQDNNISGHIPSELGRLPKLKTIDLSSNNFSGQIPSALSNLNNLQYLRLNNNSLDGAIPASLVNMTQLTFLDLSYNDLSTPVPPVHAKTFNIVGNPQICGTEQGCAGTTPVPQSVALNNSQNSQPSGNNKSHKIALAFGSSLGCICLLVLGFGFILWWRQRHNQQIFFDVNEQHNEELSLGNLRSFQFKELQVATNNFSSKNLIGKGGFGNVYKGYLQDGTVVAVKRLKDGNAIGGVIQFQTEVEMISLAVHRNLLRLHGFCMTTTERLLVYPYMSNGSVATRLKAKPALDWGTRKRIALGAARGLLYLHEQCDPKIIHRDVKAANILLDDYCEAVVGDFGLAKLLDHRDSHVTTAVRGTVGHIAPEYLSTGQSSEKTDVFGFGILLLELISGLRALEFGKSTNQKGALLDWVKKIHLEKKLELLVDKDLKNNYDRIELEEIVQVALLCTQYLPSHRPKMSEVVRMLEGDGLAEKWEASQRAEESRSRANEFSSSERYSDLTDDSSLLVQAMELSGPR

SEQ ID NO: 22875 - protein, 181 aa, Arabidopsis thaliana
MVHASQVTLGDVEKVKKDETFAVYVKIGDDENGFMIGNLSQKFPQFSIDLYLGHEFEISHNSTSSVYLIGYRTFDAFDELDEEIDSDSELDEYMEQQIAALPQNEINPEEDDESDSDEMGLDEDDDSSDEEDVEAEAPLKVAPPSKKMPNGAFEIAKGGKKNKSSGGKKRCPFPCGPSCKK

SEQ ID NO: 22876 - protein, 1228 aa, Ostreococcus tauri
MGRSTHRSRPARRATRARRAARATTAEDVAIDMSVQEYIEKHDLTRKVEEALNAAVKAKADEPLAFVVRAPIARRDRWRRDGDATFFDATQSEYMKKRTAPAITKVVGRQIFDSRGNPTVEADVYTHKGMFRAMVPSGASTGIYEAVELRDGGNTYMGKGVQQAVKNLNEIIAPALVGKDPREQKALDDFMCKELDGTENKGKLGANAILAVSMAIAKAGAAEKDVPLYKHLADLAGNGKLVLPVPAFNVINGGSHAGNKLAMQEFMILPVGAKTFKEAMQMGSEVYHNLKSVIKKKYGQDACNVGDEGGFAPNIQDNKEGLDLLVEAIEKAGYTGKMKIGMDVAASEFLTEDKQYDLDFKTENNDGSMKKTGAQMIDLYQEFINEYPMISIEDPFDQDDAENTAALTAKGNCQIVGDDLLVTNPKRVQAAIDGKWCNALLLKVNQIGTISESIEAVGMSKRAGWGVMASHRSGETEDCFIADLAVGLSTGQIKTGAPCRSERLAKYNQLLRIEEELGDAAVAPLASKSPRSHRSPTRLPRPRAHFTPRAMARRRLDARPSSARPLERARCGLYNASNTCYLNAVIQARPPRSARRRRDRARSHRARSDARAQALRHSRDFIDYLLSDEAAALFSARNATLGADGGGTRRSYAAEDEILRFHDGVGRKRRKTGDVGDGSEASGTSGTSGRRRFAIRPPAMTRGSRADMESAEGLDVGAEIRKVMRTMIEGECEAFPPQELLRSVWRLVPSFAGNEQQDAHEFMRFLLDRLRKELSLGKYAVRTRGIVTPRQKEHSPGNGGIPHPPTRARSARKRSGRLSPSPGFLKNDGDDDLNGMKTNSNSDHSSYVGMANDDDKEERNGAESGENDGYIIISRWGAKKHKRGCICRPCKAKRKLEENGGGSDTNDGEETSTMMVVNTTLSSPIASTLVTPSRLSRGVTASEVREKLEESQKDVVPKASPRSPTLNTDKEDDKIMELFGGLAVTRVTCMTCERFTERREPFMDLSLPIPSVLGKNGSAPTTPVSPSSDFVDGEGPNGEVTLQQCLAAFVRNETLSGHGRYFCEGCGKVQSATKSTRIAKLPPILCLHLKRFTWKGHTTRTKLTNDVDFPLDDLDLAPYCESDGEGDKKQEKKTAASSGKSRTPLRGANASTQHTHSDKLYDLIAVVTHHGSSASSGHYTACARELTDDGSNGWQHFNDDEVNLLTPEEVRSGQGYIFLYARRPTETS

SEQ ID NO: 22877 - protein, 557 aa, Acinetobacter lwoffii
MNYKQPLIVKSQQQALSALRNLKMQTQDTHLNQFFSDDSGRFERFSVEQEQLVLDFSKHRIDQNVLNGLVDLAHAQDLTQWIQRLFSLEEINYTEQRAAMHWALRVPEQNQQVLPEITAQVHTQLERMYSLVEKIHAGQYRGATGEVIQDVVNIGVGGSDLGPLMVTHALSDFKVVTAKPLDVHFVSTMDGSQLSDLLHQLRPETTLFIISSKSFGTIDTLSNAQTVRQWLEKALGKNSHVLKHHFIGVSTKPDKMSEWGIAPENQLLLWDWVGGRYSLWSCIGLPIALTVGVDGFKQLLSGAYAIDQHFQTAPFAQNIPVLIGLLGVWNNNFLDIQTHAVLPYDGRLKYFAAYLQQLEMESNGKSTQRSGEKVDSATCPIVWGEVGPNAQHAFYQLLHQGTHKVSCDFIAPVKRYNANHFTYAENAEALIEQHHLALSNCLAQSRLLAFGNQALTADEIEDLPTYKQYEGNQPSSTILLKELNPYSLGMLIATYEHKVFVQSVLWNINPFDQWGVEKGKEIANQLLPILNREQDDLSTFDASTQGLLKILLGKNNG

SEQ ID NO: 22878 - protein, 396 aa, Thiomicrospira crunogena XCL-2
MTDFIPSIADHAKTIQPFRVMKILGEAKALERQGKDIIHMEIGEPDFESLECVHDAVKTALDQGKTHYTPTLGLPELRHKLSEFYADFYRANVKSDNIMLTPGASSALQLALTALLNPGDKVLMSDPTYPCNRQFVQLLHGELVLLPVDADSDYQLTLAHLKRHWQDGIKVVMVASPSNPSGTVIEQDELIKMAEFAATKNAYFLVDEIYQGLVYDRPAESILSHDHPPDNVIVINSFSKFFNMTGWRLGWMVAPSHLMSVLERLGQNLFLSAPTPSQYGALRVLEKEALMQLEGRRKIFERRRNTLFHAMQDAGIPPKVLPQGAFYLYWDVSDYTDDAEQFCSRLLAETGVAITPGTDFGTHKAHQHVRLAYTTSEDQLKQAVLKIRAFIDTLSL

SEQ ID NO: 22879 - protein, 364 aa, Glycine max
MRPMQLPPPSASGANPAPATTNNNNKEQRPQRRRKDLTLPLPQRDTNLAVPLPLPPSTAPAAAASGGASQQAAQQVIPFSELERLNRIGSGSGGTVYKVVHRTSGRVYALKVIYGHHEESVRRQIHREIQILRDVDDANVVKCHEMYDQNSEIQVLLEFMDGGSLEGKHITQEQQLADLSRQILRGLAYLHRRHIVHRDIKPSNLLINSRKQVKIADFGVGRILNQTMDPCNSSVGTIAYMSPERINTDINDGQYDAYAGDIWSFGVSILEFYMGRFPFAVGRQGDWASLMCAICMSQPPEAPPSASPHFKDFILRCLQRDPSRRWSASRLLEHPFIAPPLPNHNQTPPNLHQLLPPPPRPLPS

SEQ ID NO: 22880 - protein, 267 aa, Solanum habrochaites
WRFDREALPEDLISRGLAEEDPNAPYGLRLTIEDYPFASDGLVLWDILKQWVTNYVNHYYPQANLIECDEELQAWWSEIKNVGHGDKKDEPWWPELNTPNDLIGIVTTIIWVTSGHHAAVNFGQYSYAGYFPNRPTIARSKMPTEDPTDEEWEDFLNKPEEALLKCFPSQLQATKVIAVLDVLSNHSPDEEYIGTNIEPFWKDEPVINAAFEVFSGKLKELEGIIDARNADCNLKNRNGAGVMPYELLKPFSEPGITGKGVPYSISI

SEQ ID NO: 22881 - protein, 269 aa, Burkholderia pseudomallei K96243
MRTFARRARPPAAILFSESMQSIPLSLPLSRTAFFFDFDGTLVDLAPTPDAIQVPPDVPVLVDALRQLSHGAVAIVSGRGIDSIDAYLNLPGLPVAGLHGAERRDANGDTQRIGFDDPRLLRIERELAALVDRHPGMLLEIKGAALALHFRNAPEREGVARAAAERLVADYADAYVLQPGKMVFEIKPKGVDKGRAVAAFLNEPPFAGRMPVFAGDDLTDEQGFAVANANGGLSIKVGAGDTTARARVDSVAALRAQLARWIAAGRAPA

SEQ ID NO: 22882 - protein, 215 aa, Oryza sativa (indica cultivar-group)
MSEGEEGRQVQEVVAHVYDVASSGSSEGGGGGTAILHVNRFFKDAIGLGGIFHTAIQVYGDEEWSFGYCENGTGVFSCPPCKNPMYTYPWVNRFANAGDAALEVAENTAEKLKQAKKDIAGACKAATTYLTGASSSSPSNADDSGGSTNSSLFEGTWLRSIIGISMKPSRSLMCSDSSDSSDDEKSEDERESDCQQPSGDQIEEKKDATQEQAGK

SEQ ID NO: 22883 - protein, 271 aa, Triticum aestivum
  misc_feature (249)..(249): Xaa can be any naturally occurring amino acid
  misc_feature (261)..(261): Xaa can be any naturally occurring amino acid
  unsure (1)..(271): unsure at all Xaa locations
AYLGDLQNKFVQKSRFVPVRNSRDIVDPRVRRVTTGEMLTGPARALFMDEISTGLDSSSTFQIVKYIRQLVHVMNETVMISLLQPPPETYNLFDDIILLSEGYVVYHGPRENILEFFESAGFRCPERKGIADFLQEVTSKKDQQQYWYLDQEQYRHVPVPEFAERFKSFHVGQQMLKELQIPFDKSKTHPAALTTNKYGQSSWESFKTVMSREKLLMKRNSFIYIFKVAQLVIPGLLAMTVFLRTKMPXGQFSDSTKFLGXALTFQLMTVL

SEQ ID NO: 22884 - protein, 982 aa, Solanum lycopersicum
MKHIFKKLHHSNRSNDAQSTSSISSSSSPASSLSSASCTTDHRNSNSVSQSPLSPSTISTASTTTTPAAPVGAGGGGGGGNLSTINRQQDYYTSEEEYQVQLALALSVSSSQSQDPFPSDVNSSNGHGVGRTAVDLARDREDAAADLLSRQYWDYGVMDYEEKVVDGFYDVYNLFTDPASRGKMPSLSELETNPGTSNFEGVIINQRIDPSLEELMQIAHCITLDCPASEISLLVLRLSELVTGHLGGPVKDANIILAKWMEISTELRTSLHTSVLPIGSLKIGLSRHRALLFKVLADHVGIPCRLVKGSHYTGVEDDAVNIVKLPNDSEFLVDLRGAPGTLIPADVLSAKDASFNSPKLNKIPSLPSNSHSGVSYPRRNLLSGQNSVLGDDFSGRSKPEKIESVHSISDAGGSSTAGSSGINKRPSSNQVDWTSPLAIGTSLYKGGRGPNAAGDGLRLNVNVVPYDQNNPEDPKNLFADLNPFQIKGSGNTLLQKNPARNKVSELQQPINTLIPGRPPAPMMWKNRYAPNEVPRKNESDSEGLFPKKNGGSSGYNISSIASTSSNIPQKSSTDTSRLHGNSRPAYRGNDEVASTRNNSSILSAELEFRRLSVQNSQNNNRETSQWEGHSLQSDDLNRTQAYGDDIIVESDHTRNLQAQSIGTNIKLKEPENPTSSGNLGPSQVDPVFDDVGDCEIPWEDLVIGERIGLGSYEKFTHADWNGTEVAVKKFLDQDFSGAALAEFKREVRIMRRLRHPNVVRFMGAITRPPHLSIITEFLPRGSLYRIIHRPHFQIDERQKIKMALDVAKGMDCSHTSNPTIVHRDLKSPNLLVDTDWNVKVCDFGLSRLKHNTFLSSKSTAGTPEWMAPEVLRNEPSNEKCDIYSFGVILWELATLRLPWSGMNPMQVVGAVGFQNKRLEIPKELDPIVARIIWECWQTDPNLRPSFAQLTVALTPLQRLVIPAYVDQLNSRLPQEISVNSTP

SEQ ID NO: 22885 - protein, 1067 aa, Oryza sativa
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRNANGHGTHTLATAGGDACYDSDILAAFEAAIADGVHVISASVGADPNDYLEDAIAIGALHAVKAGITVVCSASNFGPDPGTVTNVAPWILTVAASTMDRAFPAHLVFNRNRVEGQSLSPTWLRGKTFYTMISAANAAVPGYPPADALLCELGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKPDVTAPGVSVIAAWSGAAGPTGLPYDQRRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 22886 - protein, 129 aa, Saccharomyces cerevisiae
TRSSVLADALNAINNAEKTGKRQVLIRPSSKVIIKFLQVMQKHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 22887 - protein, 574 aa, Oryza sativa (japonica cultivar-group)
MGKSPAKWIKSVLFGKKSSRSGSTKAKDLSKGSNNKGYAAAGKDAGFESSPVISEPVLVTPHNNEAVQEVGRGENSSLQGEVVVRDVSQDLEKQNTVVSDASNDPERLREEQAAVKAQAAFRGYLARRAFRALKGIIRLQALIRGHLVRRQAVATLRATWLIVKFQALVRGRNVRLSTNTIQVNWKLVQQQSGSGKRDAWKEKLSSNAFARKLLASPILVEALHFQYDERDPNSAFNWLERWTIGRVWRPISHPKRAAVTDAKPHTRKASYAMETESGKLKRNSRRSSAAPVESSQTNIAMETEKSRRNPRKFTSSTADSVPESQLTELEKVKRNLRKVTNSMAEASKVSTPATEIPERQEVQCEKPQRTAEEVPNYPEIQEPQNGNLLENAKTDILVPDLQPEPEVPSYQVETEEKVAELTVADPTVETMPLQDIHNEENALVNDMEQRSKEEPLSTESLKSSKRRSSFSTKTEYPENGSKNSPAVPSYMAATQSAKAKLRGQNSPRLSSDSAEKNGFTRRHSLPSSNGKLNSHSPRTQRPTHAGGKEGVKADKSMLSSRDASERPAKAEWKR

SEQ ID NO: 22888 - protein, 253 aa, Glycine max
MGRKFFVGGNWKCNGTVEQVESIVNTLNAGQIASTDVVEVVVSPPYVFLPTVKGKLRPEIQVAAQNCWVKKGGAFTGEVSAEMLVNLGVPWVILGHSERRSLMGESSEFVGEKVAYALAQGLKVIACVGETLEQREAGSTMAVVAEQTKAIAGKIKDWTNVVVAYEPVWAIGTGKVATPAQAQEVHANLRDWLKTNVSPEVAESTRIIYGGSVTGASCKELAGQPDVDGFLVGGASLKPEFIDIINAATVKSA

SEQ ID NO: 22889 - protein, 867 aa, Medicago truncatula
MKHFLLVLFSVLTTILVLIQAQDQSGFISIDCGLPAHLNYSALDTGINYISDAKFIDTGVTKRITPTNNNIKQELEYLRSFPSGVRNCYKINVTSGTKYLIRATFLYGSYDGLDKPPQFDLHFGPNVVATVRFSNHTSHFTYREIIYTPSQDYIQPCFVNTGNGTPFISVIELRTLNNTAYVTYPANSVLSFWKRSDVGSITNLQYRYKDDVYDRIWFPWDLPSDLRRLSTSLNKTDLNQSSYKPPEIVMSTAVTPVNASAPIQFQWDANNVNDRFYLYMHFNEVEELAENETREFNITVNDKFLYGPVTPYTTIFSTKPLTGAPRYHVSLSKKDNSTLPPILNAFEVYKQRDFSISETQQDDVDTMTNIKNAYGVARNWQGDPCAPVNYMWEGLNCSSDGNNIPRITSLNLSSSGLTGEISSSISKLTMLQYLDLSNNSLNGPLPDFLMQLRSLKIFRNVGKNKLTGLVPSELLERSKTGSLSLSVDDNPDLCMTESCKKKNIIVPLVASFSALVVIIFISFGFWIFRRQKAVLTSSNSKERGSMKSKHQKFSYSEILNITDNFKTTIGEGGFGKVYFGTLQDQTQVAVKSLSPSSMQGYKEFQSETQLLMIVHHRNLVPLLGYCDEGQIRALIYEYMANGNLQHFLVENSNILSWNERLSIAVDTAHGLDYLHNGCKPPIMHRDLKPSNILLDENLHAKIADFGLSRAFGNDNDSHISTRPAGTFGYADPVYQRTGNTNKKNDIYSFGIILFELITGQKALIKASEETIHILQWVIPIVEGGDIQNVVDSRLQGEFSINSAWKAVEIAMSCTSPNAIERPDMSEILVDLKECLCLEMVQRNNGSKSARDELVSVATVSETSLSGR

SEQ ID NO: 22890 - protein, 231 aa, Glycine max
MEAELDTEQQQQMTEGSYSQTMQIDPKRARFPCSVVWSPLPVISWFIPCIGHIGICREDGVILDFAGPNFVCVDSFAFGAATRYLQIPKEKCCVPLVQSVYNGEEHYMQGETRGDLRTWDDALRKSTQEFQHLSYNLFTCNCHSFVANNLNKLGFLTGGWNVVNLAIFILFNGRWVSKASMLRSILPFVVVFFLGVTFWGFTFLKFWFFFTSILIGWFLLGTYCFKNLIQL

SEQ ID NO: 22891 - protein, 154 aa, Griffithsia japonica
MNPEYDYLYKNLLIGDSGVGKSCLLLRFADDTYTESYISTIGVDFKIRTIELDGKTIKLQIWDTAGQERFRTITSSYYRGAHGIIIVYDVTDQESFNNVKSWLQEIDRFASEHVCKLLVGNKNDMTSKKVVDTETAKNFADSLGIKFLETSAKT

SEQ ID NO: 22892 - protein, 375 aa, Cryptococcus neoformans var. grubii
MEEEVAALVIDNGSGMCKAGFAGDDAPRAVFPSIVGRPRHQGVMVGMGQKDSYVGDEAQSKRGILTLKYPIEHGIVTNWDDMEKIWHHTFYNELRVAPEDDPVLLTEAPLNPKQNREKMTQIMFESFNAPAFYVSIQAVLSLYASGRTTGIVLDSGDGVTHTVPIYEGFSLPHAILRIDLAGRDLTDYLVKILMERGYLFTTSAEREIVRDIKEKLCYVALDCEQELQTAAQSSQLEKSYELPDGQVITIGNERFRCPEALFQPSLLGLEAAGIHETTYNSIMKCDLDIRKDLYGNIVMSGGTTMYNGIADRMQKEITALAPSSMKVKIVSPPERKYSVWIGGSILASLSTFQQMWIAKSEYDESGPSIVHRKCF

SEQ ID NO: 22893 - protein, 321 aa, Arxula adeninivorans
MSNSLEALKATGTVIVTDTGEFESIAKYKPQDATTNPSLILAVSKKPEYAALVDAAAKAATGANAKEKASNALDILLVEFGTKILEIVPGRVSTEVDARLSFDKDATIKKALHIIELYKQKGISKDRVLIKIASTWEGIQAAAELEAKHGIHCNLTLLFSFVQAVTAAEAKATLISPFVGRILDWYKKSTGKTYESSEDPGVHSVKSIYNYYKKFGYDTIVMGASFRNTGEIKELAGVDYLTVSPALLEELVNSTEAVPKKLEKSQATSLDLEKVSYINDEAKFRFELNEDQMATEKLSEGIRKFAADAVTMLEELEKRVA

SEQ ID NO: 22894 - protein, 590 aa, Ostreococcus tauri
MPVVMEAKALISSTEEWRALRSHVEAIDKTHLRDLIRDEARCDALALEYDGLYCDFARQRVTTETMEKLYDLARAAGVREKVNAMFNGEAINSTENRAVLHVATRAPKDKVINVDGRNVVPDVHDVLEKIKEFSERVRNGEWIGETGKPLKDVVAIGIGGSFLGPLFVHTALRTNPEAAVGASGRQLRFLANVDPVDVARSLNGLDPETTLVIVVSKTFTTAETMLNARTVRAWIRASLGENAVQKHMVAISTNLKLVKEFGIDPDNAFAFWDWVGGRYSVCSAVGMLPLSLQYGYDTMEKFLEGAWSMDQHFANAPFEENLPVTLGMLSVWNVSFLGCPARAILPYCQALAKLAPHIQQVAMESNGKGVAIDGTPLDYDTGEIDFGEPGTNGQHSFYQLIHQGRTIPCDFIGIVKSQQSVYLKGEIVSNHDELMCNFFAQADALAVGKSAVELRSENVPDALIPHKTFSGNRPSLSIMLPELNAYTTGQLLSLYEHRVAVQGFVWGINSFDQWGVELGKVLASRVRATMNDKRTKGETMSGGEGYNPSTTRLLNRYLAGKAKLIYPEPKDVFPCDLIDSDECRPPTSYV

SEQ ID NO: 22895 - protein, 320 aa, Gibberella zeae PH-1
MTSHASAPQITVLGSLNMDLVSYVPHHPLPGETLTSSHFNTSPGGKGANQAVACGKLSRDSDLANPSANVSMVGAVGADPYGTLLLDSLRSFGVSVDSVTARQDQKSGIAIIIVDEPSGQNRIIVSPEANHSLRPADFETLPGLRPDLLIMQLEIPFDTVMQALKVAKRDGVPVLLNPAPAQTLPMDAYDGLAHLVVNETEAAILAECNESELDTPAGLERVGRVFIDRGVHNVIITLGGRGVYFVNKQGQSALLPATKTTVVDTTAAGDTFVGSYSLAAVAARGGQFDIEAAVTAANRAAALTVARKGAQISIPWKDEL

SEQ ID NO: 22896 - protein, 222 aa, Prochlorococcus marinus str. MIT 9211
MMQMNQDFIKKLRFNENGLIPAIAQDWLDGAILMLAWMNKDSLEKTIQTGQVHYWSRSREKLWLKGETSGNIQWLKAIRYDCDADAILLTIEQVGSGACHTGVRSCFFQNENTKSEQSPISLPPPSDACTEVFKVITKRTSNPEEGSYTNSLLKAGDNGILKKIGEESAEFVMACKDNAPNTIANEAADLIFHLQVALAYHEVDWRDVLEVLALRRSNKQRK

SEQ ID NO: 22897 - protein, 256 aa, Oryza sativa (indica cultivar-group)
MAMETMATTTTKRMSVAEVSLVEAVLFDIDGTMCVSDPFHHRAFSELLQALGYNSGVPITPEFGMAHMAGRSNHQIGSFLFPDWPQHRLDAFFADKEALFARYAAEGLREVAGLTDLCRWAAGRGLKLAAVTNAPRANADLMISILGLSDFFQVIVAAADDCDLPKPSPEPYLRALSLLGASPRHTLVFEDSVVGVQAGVAAGMPVIAVAEEAREAKVVAAGASLVIRDYKDHKLWAALDKLQAAAAAQSNGQLGA

SEQ ID NO: 22898 - protein, 193 aa, Methanosarcina mazei
MPEIRQLSEGIFEVTKDKKQLSTLNLDPGKVVYGEKLISVEGDEYRTWDPRRSKLGAMVLKKFDIPLKRNSKVLYLGAASGTTVSHVSDIVSEGAVYSVEFAPRSMRDFIGLASRRKNIFPILADAGKPDSYAHIVEPVDVIFQDVAQPNQAEIAARNAVRFLKKDGYLLLSIKARSIDTAASPKEIFKEEVK

SEQ ID NO: 22899 - protein, 132 aa, Robiginitalea biformata HTCC2501
MIKPDAVENGHIGPILEKITAAGFRIVAMKYTQLSRRDAEEFYAIHKERPFFGELVDFMTRGPIVSAILEKDNAVEDFRALIGATNPAEAAEGTIRKLFASDIAENAIHGSDSDANAEIEGAFHFSGREIYS

SEQ ID NO: 22900 - protein, 487 aa, Chlorobaculum tepidum
MSIAADSGGDALHTTSYVMQQADTLAAQFDVAVIGSGPGGYEAAIHAARYGLKTCIVEKAVLGGVCVNWGCIPTKALLRSAEVFDLAKNPETFGVNVGNVSFDLAQAVKRSRNVALKSSKGVAYLLKKAAVEVLAGEAVLTGGAGVMVTMPDGSVRMLGAKNIIVATGSTPRVIPGLEPDGKKIITSREALILKEVPKSMIVVGGGAIGVEMAWFYAKAGSKVTIVELMPRMLPAEEAEVSEALKRSFEKAGITVHCGAKLDNVAVSESGVSAELVVEGSAPQTLNASCLLVAVGVTGAIDGLGLDAVGVETERGFIRTDGQCRTSAPGIYAIGDVRGGMLLAHKASAEAAIAVEAIAGKSPEPLSEPLIPRCVYAQPSVASVGLTEEAAVNAGYQVAVGRSQFAASGKANAYGQLEGFVKLVFDAATGKMLGGHLIGHDAVELIGELGLACRYGVTAGGLVNTVHAHPTLSETVREAAFDALQSMG

SEQ ID NO: 22901 - protein, 148 aa, Griffithsia japonica
MKALILVGGYGTRLRPLTLSVPKPLVDFCNKAMILHQIEALAAAGVTEVVLAVNYQPEKMRSFLNEKEKQLGIKITTSKEDEPLDTAGPIKLAEPHLNDGEPFFVLNSDVSCAYPFEEMIAFQKKTGASGVLLATPVEDPSKFGVSCR

SEQ ID NO: 22902 - protein, 293 aa, Zea luxurians
IIESVGEGVTDVAPGDHVLPVFTGECKECAHCKSAESNMCDLLRINTDRGVMIGDGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMA

SEQ ID NO: 22903 - protein, 211 aa, Burkholderia pseudomallei K96243
MNRPKSMLVANIAWARETSERSPDFFDALSRGQNPRVLWIGCADSRVPAEAITQSAPGELFVHRNIANIFQPDDDNCASVLEYAVKVLKVDHVIVCGHYGCGGVRASLLPPSPELPHVNRRIAPLCALAGRHRAELDGVPPDAAADRLAELNVLEQVRLLRSSPIIRDAAPAPLVHGWIFSLADGRLKELASGYPAAQRPPQAERAQAAAA

SEQ ID NO: 22904 - protein, 467 aa, Ostreococcus tauri
  misc_feature (158)..(164): Xaa can be any naturally occurring amino acid
  unsure (1)..(467): unsure at all Xaa locations
MATTTTADDDARDVVVVGGGPGGYVAAIKAAQLGLRATCVEGRGTLGGTCLNVGCIPSKALLNASHKYEDAKHGMAKHGIAFGGEVTIDVGTMMAHKTKAVTGLTKGIEGLFKKNGVDYAKGWGRLTSANEVEVTSEDGTKRTIKTKNVILATGSVPXXXXXXXKNACRRRWRLIGGGVIGLELGSVWSRLGAKVTVIEFAPAICGAGIDDEIRTTFQRSLKKQGFDFKLNTKVVSAVKKPEGGVTLTLEPSAGGEQTTLEADIVLVSTGRRPFTDGLGLEDVGVETNKKGQVVIEPHSFKTSVPNIYAIGDVVEGPMLAHKAEEEGVSIVEQIAGKKGHVNYDTIPSVIYTHPEVAWVGKTEAQVKEMGIEYVVGKFPLAANSRARANDDSEGVVKFVCDKATGKVLGAHIVAGGAGELLAECVLAMEYGATAEDIARTCHSHPTVSEAVKEAAMAAVPGMGSIHF

SEQ ID NO: 22905 - protein, 269 aa, Solanum chacoense
MEFWGAEVKSGEPLTVQPGDGMVLHLSQASLGELKKDKSESVCLSVNIDGKKLVLGTLNSEKVPQQQFDLVFDRDFELSHNLKSGSVYFFGYKATNPFEEEEDDEDDYDESDEDIPLTLANSGKPEPKEAGKSNAGKDSASGKQKVRIVEPTKDDEDESSDDDDSDMGEDEDDSDDSEEETPKKAEPAKRRKADSATKTPVTDKKAKLTTPQKTDGKKGGGHVATPHPSKQASKTPKSAGSHHCKPCNRSFGSEGALDSHSKAKHSAGK

SEQ ID NO: 22906 - protein, 386 aa, Chlorobium tepidum TLS
MGLSLGERCGLVMQSDIRAMSIECARMGGINLSQGVCDTPVPPVVLQGAADAVMQGANIYTHHTGIRELREAIVAKQRRFTGVAFDAEREVVVSAGATGAMYCAFQALLNRGDEVIVFEPFYGYHVSTLRAVEAVPLFVPLDPSDGWSFRVEALEAAVTPKTKALLINTPANPSGKVFSCDELALLAEFAIRHDLFVFTDEMYEHFVFGGLSHVSMASMPGMRERTITISGLSKTFSVTGWRIGYALCDPRWAASIGYFNDLFYVCAASPLQVGVTAGLRLLGDDYYHGLAAEYEVRRDLFCAALAEAGLEPHVPQGAYYVLAGTERLPGATAREKAMHILRETGVASVPGSAFYHDGGGENLVRFCFAKESHVLEAACEKLLKLR

SEQ ID NO: 22907 - protein, 261 aa, Glycine max
MAGLYEKPSETYAKKRPRYPKEWFSMLASLTAGHHRAWDAGCGSGQASLSIAEHYDSVVATDVSEGQLRHAIAHPKVRYLHTPEDLAEDDLVALVGGEGSLDLVIVATAIHWFDVPLFYAVVNRVLRKPGGVLAVWGYNYDIHPFGDKLHGALYPAMRPYMDPRTRLAMERYRDLPFPFEPVGVGREGEPADVDMEAEMTLEDLAGFVMTGSVATTAGEKGVDLEALVKGVMKEVEEGWGDRPTVPRKLVFKAFMLAGRPR

SEQ ID NO: 22908 - protein, 338 aa, Polaromonas sp. JS666
MPLNQQILLDNRPIGEAVASNFKLVSSETPALKDGQVLVRHHFLSLDPYMRGRMNDTRNYAAAQPLGQVMIGGTAGEVMESRSPKFQPGDKVVGMGGWQQYSVVDAEQPGALRKVDTTQVPLSHYLGAVGMPGVTAYYGLVKIIEPKAGQTVAVSAATGAVGSAFAALAKARGCRTVGIAGGPDKCQYAVNELGFDACIDYKLYKDAASLSAALKEACPNGIDGYFENVGGMVLNAVLPLMNDFGRIAVCGMIAGYDGEPTPITHPALILRSRLKVQGFIVSEHMEVWPEALKELGTLVATGKLRPRETIAQGLQAAPEAFLGLLKGRNFGKQLVKLI

SEQ ID NO: 22909 - protein, 606 aa, Magnetospirillum magnetotacticum MS-1
MELRNIAIIAHVDHGKTTLVDAMLRQSGTFRENQQVAERVMDSNDLEKERGITILAKCTSVEWKGVRINIVDTPGHADFGGEVERILSMVDGVVVLVDAAEGPMPQTKFVTGKALGLGLRPIVVVNKVDRGDARPHEVHDECFDLFAALDADDDQLDFPTLFAVGRDGWADDSLEGPRKDLAALFDLIVAHVPPPKRDLDAPFSMLATTLEADPYLGRVLTGRIYSGTAKLNMQVKGLSHDGKVLEQFRLSKLLAFRGIERIPVESAEAGDIIAIAGMTKPTVADTICVPEVTEPLKANPIDPPTLAMTFSVNDSPLAGQEGDKVTSRMIGARLAREAESNVAIHIRETAGKDAFEVSGRGELQLGVLIEQMRREGFELSISRPRVLFQTDEHGKRLEPIEEVFIDVDDEYSGVVVEKMSLRKAELTGMRPSGGGKTRVTFLAPARGLIGYHGEFLTDTRGTGLMNRMFHGYAPYKGAIEGRRNGVLISNGQGDAVTYALWNLEDRGSMFITGNVKIYEGMIIGEHNRPNDLEVNALKAKQLTNIRAAGKDEAVKLTPPRKMSLEQAIAYIEDDELVEVTPKSIRLRKRLLDPNERKKADRAAKND

SEQ ID NO: 22910 - protein, 361 aa, Prymnesium parvum
MLHLLPPLVGALVLPGGALTTPQRALAVRMQTTDAAFGASHTSFYTDAVKQDSYFSLEEVLEQKMSDKDLGSVIKTMFDACGTITEALRKELVTVAEKQESVFGDVQLGVDVLADDLMWEVCKTDPLIKEGASEEEPEVREMHADGKFCICWDPLDGSSIVDNNWAVGTILGIWGAETGILGATGRDQKASMVALYGPRTTVFVTLDDGVYEFTYGANGVDGWLCSRERCEIAPKSKIFAPANMRAAQDLPEYAALIDYWMANKYTLRYTGGLVPDICQQFTKKMGVFANPTSESSPAKLRLAFEAAPFGLLVEKAGGKTSDGVSGGSVLDVKITGIDQRTPLCIGSAEEVDRFNTMLKLN

SEQ ID NO: 22911 - protein, 144 aa, Zea mays
  misc_feature (68)..(68): Xaa can be any naturally occurring amino acid
  misc_feature (75)..(75): Xaa can be any naturally occurring amino acid
  misc_feature (84)..(84): Xaa can be any naturally occurring amino acid
  misc_feature (87)..(88): Xaa can be any naturally occurring amino acid
  misc_feature (96)..(96): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(107): Xaa can be any naturally occurring amino acid
  misc_feature (111)..(111): Xaa can be any naturally occurring amino acid
  misc_feature (114)..(116): Xaa can be any naturally occurring amino acid
  misc_feature (121)..(121): Xaa can be any naturally occurring amino acid
  misc_feature (128)..(129): Xaa can be any naturally occurring amino acid
  misc_feature (131)..(131): Xaa can be any naturally occurring amino acid
  misc_feature (134)..(135): Xaa can be any naturally occurring amino acid
  misc_feature (137)..(137): Xaa can be any naturally occurring amino acid
  misc_feature (139)..(139): Xaa can be any naturally occurring amino acid
  misc_feature (141)..(141): Xaa can be any naturally occurring amino acid
  misc_feature (143)..(143): Xaa can be any naturally occurring amino acid
  unsure (1)..(144): unsure at all Xaa locations
MGIADLVLIMACEGCGNTSDLYGTGCKHTTLCSDCGKSMALSRARCLVCSAPITRHIREYNVLANSVXDKTYSIXRFVTGLPSXSKXXNAENYWSXHYEGLAXPXIXENMXEKXXXKPWIXEDETAIXXIXVKXXGXSXSXTXY

SEQ ID NO: 22912 - protein, 488 aa, Prunus dulcis
LPTEDDMGNSEVGHNALGAGRIFAQGAKLVDSALETGKLYEGEGFKYIKESFPTNTLHLIGLLSDGGVHSRLDQLLLLVKGASERGAKRIRVHILTDGRDVLDGSSVGFAETLENYLAQLREKGVDAQIASGGGRMYVTMDRYENDWGVVKRGWDAQVLGEAPHKFKNAVEAIKTLRQEPNTSDQYLPPFVIVDENGKPVGPIVDGDAVVTFNFRADRMVMIAKALEYADFDKFDRVRFPKIRYAGMLQYDGELKLPSKYLVEPPEIDRTSGEYLTYNGVRTFACSETVKFGHVTFFWNGNRSGYFNPQMEEYVEIPSDSGITFNVQPKMKAVEIAEKGRGAILSKKFEQVRVNLPNSDMVGHTSSIEATVVACKAADEAVKIIIDAIEQVGGIYVVTADHGNAEDMVKRNKKGQPLLDKNGNIQILTSHTLQPVPIAIGGPGLAPGVQFRKDVPNGGLANVAATVMNLHGFEAPADYETTLIEVVDN

SEQ ID NO: 22913 - protein, 251 aa, Burkholderia pseudomallei K96243
MSKQRIKRVIGNWKMHGRLSGNEALLDEVAQGAQAVPEHVGIGVCVPFPYLAQARARLHGGRVAWGAQDVSAHEQGAFTGEVAAGMVAEFGAAYAIVGHSERRAYHGESNEIVAAKAQRALAAGLTPVVCVGETLAEREAGATEQVVGVQLAAVLAVLSQDEAARIVVAYEPVWAIGTGRSATAEQAQQVHAFLRGRLAAKGAERVSLLYGGSVKADNAAELFSQPDIDGGLIGGASLKSGDFLAICRAAQ

SEQ ID NO: 22914 - protein, 231 aa, Methanococcoides burtonii DSM 6242
MKERNANASSSEKEAAGNAAASLVEDGMIIGLGTGSTTAFAIAEVGRRVREEGLNVLAVVTSYQAEMLAIEAGVPLTSLAEHPVLDLAIDGADQVDAKLNVIKGGGAAHTHEKVVAHSAKRFIVVVDESKISEELDHFVPIEVLPYARELAKKQFIELGGKPQIRLASRKDGPVISDNGNVIIDVEFGVIEDAAELSQKLSTCVGVVEHGIFLNTDEVYVGMKDGSVKIIN

SEQ ID NO: 22915 - protein, 735 aa, Robiginitalea biformata HTCC2501
MASQTLIQKENKEIAKQYKELLRISYQTLSDEDKRLIRQAFDVAVDAHKDQRRKSGEAYVFHPIAVPKIVASEIGLDAVSIASALLHDVVEDTPYTLNDIERMFGETVARIVDGLTKIAHLKKDTNISQQAENFRKMLLTLHDDVRVIIIKIADRYHNLLTMDAMPEHKQVKIASETLYIYAPLAHRIGLYNIKTELEDLSLKYTEPEVYNDILSKIEDTKEEQGKYIEDFTAIIQDSLDREGLNYHIKGRMKSIYSIRRKMQAQNVGFDQIYDKFAIRIIYKSDRKNEKFLAWKIYSIVTDHFTPNPVRLRDWISSPKSTGYEALHITVMGPKGRWVEVQIRSERMHEIAEKGYAAHFKYKHGDQKEQGIEIWLNRLQEALESSNGNAVDFVEEFKLNLYSKEIFVFTPTGDLKSLPKGATPLDFAFHIHTEVGLKTRGAKVNGKLVPLNTVLKSGDQVEIITSESAKPNQNWLDYATTGRARSKIRSSLREEKKELAMEGKEMLRRKLKSQKVTLNEDVVNKMVTYFKLQTSLDLFYRVGNGAIDNQQIRDFAASYNNAFISFFKNKIRRKEPPKDIDREEITSKYDMLVFGKEEEKLEYTLSKCCNPIPGDDVFGFVSVNEGIKVHKKNCPNAISLQSNYAYRIISAKWVDSTQQEFTAQIRMSGIDNMGLINDITDLISDEMHVNMRNINFSTDGGTFEGKITVVVKNKAILKKLVSNLKEINGIDKVVRT

SEQ ID NO: 22916 - protein, 1079 aa, Dehalococcoides sp. BAV1
MNKPKKVLIIGSGPIIIGQAAEFDYAGTQACKAMREEGVESILVNSNPATIMTDENVADRVYIEPLTVESITKIIEKERPDGLLPTLGGQTGLNLAVDLADAGVLAKYNVRSLGTPINTIRTAEDRELFKELLTKIGEPVPPSETVTTAEDALRVAHMIGLPVVIRPAYTLGGTGGGFAHNWDEVEEVAQTGLNASPIHQILVEKSVAGWKEIEYEVMRDGADNCITICNMENFDPMGVHTGDSIVVVPVQTLTNKESQMLRTASIKIIRALGIEGGCNVQLSLNPNGNEYYVIEVNPRVSRSSALASKATGYPIARVASKIAIGKRLDEIPNAVTGKTLACFEPAVDYIVAKIPRFPFDKFALGDRGLGTQMKATGEVMAIDRSFEAAIHKSIRSLEFGKKTVLWEDRSWIMGDDLSTYPLHAHDTRLWTILAALRRGHTPEAIHEKTMVDNWFLYKLKNITNMEKRLLKENLTPLLMLEAKQMGFSDEEIATLSGKLAEQVRQTRLEWNIKPVFKMVDTCAAEFDAATPYFYSTYDDENEAIPQNVKKAVVIGSGPIRIGQGIEFDYCSVHAAWALEKAGLQSIMINSNPETVSTDFDTSNRLYFEALDEESVRDILENENISAPESTPSIVQFGGQTAINLAAPLTRSSNPIIGSSAEAIDLAEDRRRFERLLSEMGIPQAPGAGITSLDEALSIADSIGYPVVVRPSYVLGGRAMEIVSDASDLVRYMSAAIELNTGHPILIDKYLVGKEVEVDAIADGETVFIPGVMEHIERAGVHSGDSMAVYPTQNLNEHDLATITDYTIRIGKALNVRGLMNIQFVVSKDPEGGDNIVYVLEVNPRGSRTVPFLSKVTGVPMVDIAVNVMLGKTINEQGYQNGIMPNTDLVAIKAPVFSMAKLVGVDTYLGPEMKSTGEVMGVDHTFNKALVKTLQAASIMLPETGTLLFSIADRDKAEALPLIRTLHGLGYNFYATEGTAAMITAAGITVKQISKKLDEGHPNIVDIIRNGTVCGVINTMTGGRVPLRDGFYIRRAAAERKVPCFTSMDTAKAAVEALANGNRQITVLPLNEYRQGKSGS

SEQ ID NO: 22917 - protein, 643 aa, Arabidopsis thaliana
MVFTGANLGLTLVATVLVVYFAPTAAGPGIPEIKAYLNGIDTPNMFGFTTMMVKIVGSIGAVAAGLDLGKEGPLVHIGSCIASLLGQGGPDNHRIKWRWLRYFNNDRDRRDLITCGSASGVCAAFRSPVGGVLFALEEVATWWRSALLWRTFFSTAVVVVVLRAFIEICNSGKCGLFGSGGLIMFDVSHVEVRYHAADIIPVTLIGVFGGILGSLYNHLLHKVLRLYNLINQKGKIHKVLLSLGVSLFTSVCLFGLPFLAECKPCDPSIDEICPTNGRSGNFKQFNCPNGYYNDLSTLLLTTNDDAVRNIFSSNTPNEFGMVSLWIFFGLYCILGLITFGIATPSGLFLPIILMGSAYGRMLGTAMGSYTNIDQGLYAVLGAASLMAGSMRMTVSLCVIFLELTNNLLLLPITMFVLLIAKTVGDSFNLSIYEIILHLKGLPFLEANPEPWMRNLTVGELNDAKPPVVTLNGVEKVANIVDVLRNTTHNAFPVLDGADQNTGTELHGLILRAHLVKVLKKRWFLNEKRRTEEWEVREKFTPVELAEREDNFDDVAITSSEMQLYVDLHPLTNTTPYTVVQSMSVAKALVLFRSVGLRHLLVVPKIQASGMSPVIGILTRQDLRAYNILQAFPHLDKHKSGKAR

SEQ ID NO: 22918 - protein, 380 aa, Malus x domestica
MSNTAGQVIRCRAAVAWEAGKPLVIEEVEVAPPQANEVRIKILFTSLCHTDVYFWEAKGQNPLFPRIYGHEAGGIVESVGEGVTDLKAGDHVLPVFTGECKDCAHCKSEESNMCDLLRINTDRGVMLSDGKSRFSIKGKPIYHFVGTSTFSEYTVVHVGCLAKINPSAPLDKVCLLSCGISTGLGATLNVAKPKKGSTVAVFGLGAVGLAAAEGARLSGASRIIGVDLHSDRFEEAKKFGVTEFVNPKAHEKPVQEVIAELTNRGVDRSIECTGSTEAMISAFECVHDGWGVAVLVGVPHKDAVFKTHPVNFLNERTLKGTFFGNYKTRTDIPSVVEKYMNKELELEKFITHKVPFSEINKAFEYMLKGEGLRCIIRMEE

SEQ ID NO: 22919 - protein, 397 aa, Robiginitalea biformata HTCC2501
MDDDFLKYQAQTTPHPLGLNILRASGSYVYDDREKEYLDLIAGVSACTLGHCHPEVVRAIREQAGKYLHVMVYGEFAMEPAVAFCRELAAALPAPLETTYLVNSGTEAMEGAIKLARRVTGRSEILAARDAYHGNTLGSLSLMSLESRKAPFRPLLPDVRHIRFGHAGDLDKITGKTAAVVLETIQGGAGFLLPPEGYLQQVRERCSQTGTLLILDEIQPGFGRTGKLFAFEHYRCIPDILVMGKGMASGLPVGAFTASREHMTALSNRPKLGHITTFGGNPVVAAAALATLRVLREGTLMEAITRKEMLFRELLRHPRIQEIRGRGLMLALILSDPAEADHVILRGMERGLLLFWLLFEPRAVRITPPLTISEEEIRKGCQMLLELLDTCPKAPVN

SEQ ID NO: 22920 - protein, 466 aa, Escherichia coli B
MSSVGGEPWGFSKTCFLLLIRCRLVNLNLFNLVYKSIMTTDDLAFDQRHIWHPYTSMTSPLPVYPVASAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 22921 - protein, 456 aa, Prochlorococcus marinus str. MIT 9211
MNLLKDTFDLIVLGAGSGGLAAAKRAASHGARVAIVEGDRVGGTCVIRGCVPKKLLVYGSQYDEYLKDSHYFGIEISRSSIDSSVLLNNVRREVDRLNRLHVELLEKSGVEIISGWGSITSPTSISVISSDKSKKNKEIHARNILIAVGGRPVRPDIPGAALGWVSDDMFLQKNWPEKVVIVGAGFIACEFSCIMNGLGVEVVQLVRGNTLLKGFDQELSLFLEENMRKEGIDLQFQKTLSALEGCQGDLKVLLQCNEAIDCGGVLFATGRKPFLDGLNLDKIGIVQEAERIKVDSGNATNIANIFAIGDVAGHVQLTPVAVEEGRVLADNLFSGTHRKVKYNLIPKAVFSKPEIASIGLSENEALDKFGGGNVQVYRSKFRPMSQSLQKSERRCLLKLVVDVKTDKILGCQMAGEHSAEIIQMASIAISMGATKLDFDQTMALHPTIAEEFVTMR

SEQ ID NO: 22922 - protein, 412 aa, Synechococcus sp. CC9605
MATTPLPSTGALSGLGETLAFFTQADFAQRRFETHGDVFETKLLAQRMVFIRGERAIGDMLGQGDALQGWWPESVRQLLGSRSLANRSGPGHKARRRVVGQLFSSAALARYTPSIEQLVAELCHELITTNTALPLAARMRRFAFAVIATTVLGLDGASRDALFADFEIWTRALFSIPLAIPGTPFAKAMAARQRLLKRIKGVLQAGTNQGGLDLLSGGLDEAGIPLDDDDLAEQLLLLLFAGYETTASSLSCLFRALLLNPEVESWLRDGLNKDPASPKLDATVMEVMRLTPPVGGFFRRSLAPIELAGVAVPEGSVIQVVLSPTSDGDDDDLASFRPQRHLDGSFKQTLLPFGGGERVCLGKALAELEIRLMAVGLLQAVELQLQPGQDLALQLIPSPTPKDGLLVQAAAR

SEQ ID NO: 22923 - protein, 368 aa, Zea mays
MDVEARKSDAPPARGKAMHRFLVALNCGMLAVGAIGGPLLSRLYFSKGGHRQWLSAWLETGGWPLLVIPVAASFVARRARDRGAPVLLAPPRILLAAAGLGVATGADDFIYAFGLAYLPVSTSAILISTQLAFTVFFAFLVVRQRLTAASVNAVALLTVGAVVLGLHVSSDRPPGVTRGQYWLGFVLTLGAAALYGLVLPLVELAYRRAAGAGGRAVTYALVVEMQLVMGFFATAFCTVGMVVNKDFQAIPREARRYALGEARYYAVLAWSAVMWQCFFLGAVGVIFCVHTLLAGILIAVFIPVTEVAAVIFLRERFSSEKGVALVLSLWGLASYSYGEWSEARAKKRKRTRTEEGAAAAEALQQANP

SEQ ID NO: 22924 - protein, 433 aa, Bradyrhizobium japonicum USDA 110
MKQRSSKSRGRIMTTTPHRVVIVGAGFGGLEATYRLAGTPVDITLIDRRNHHLFQPLLYQVATASLATSEIAWPVRHLMRDRREVTTLFATVSGVDATRRCVLIDDGSEVPYDTLVLATGARHAYFGHDEWEQFAPGLKTLEDATTLRRHILVAFERAERETDPAKRAARLTFVIVGAGPTGVELAGTIAEMAHHTLPEDFRNIDTTKARVVLIEAGPRVLAGFADELSAYAQASLEKIGVEVVLGQPVTEIDRDGVVYGGTRLDAKTKIWAAGVRASPAAEWLGVPADRAGRVQVEADLTIPGHPEIFAIGDTVTISAWEGKPVPGIAPAAKQQGRHVAETVKARLRGETKGAFRYKHSGSLAQIGKRLAVIDFGRIKLRGTIAWWIWGIAHIYFLIGLRHRLSVALSWLWIYARDQRAARLITQGSSKVVG

SEQ ID NO: 22925 - protein, 148 aa, Capsicum annuum
MEQTFIMIKPDGVQRGLVGEIIGRFEKKGFSLKGLKLITVDRAFAEKHYADLSAKPFFNGLVEYIVSGPVVSMVWEGKGVLTTGRKIIGATNPLESAPGTIRGDYAIDIGRNVIHGSDAVESARKEIALWFPEGVAEWQSSLHCWIYE

SEQ ID NO: 22926 - protein, 182 aa, Zea mays
MDEKRTTAFGLMQIDEEWRIIEFAKKPKGEQLNEMIVDTTILGLDDVRAKAMLYIASMDIYVFSQDVMLQLLREQFPRANDLGSEVIPGATSIGKRVHAYLYDGYLEDIGTINTFYNANLIILHTKCWTAQLSNLWMCFLWKPPWPGFICVQERVLLQFDALDISTPQASEINSSYVIIHLY

SEQ ID NO: 22927 - protein, 242 aa, Oryza sativa (indica cultivar-group)
MSEKTHVEAYSLPMQNEDLHTSTNGAKGRAKRSSNFNRKEDIQLCISWQSISSDPIIGNEQPGKAYWQRIAEHYHANRDFESDRNAFSLEHRWGNIQKEVSKFQGCYEQIERRHPSGIPHQELVLEAEALYSSNAPKNRAFQFNHCWLKLRNSPKFQTLKSHKRPRSRKSSTPIESAGEEDEEGDDARKSTTPDLSQPSAKKRPMGRKEAKEKLKNGGEDGPYKEAMKDLLDAKEKEAKVKE

SEQ ID NO: 22928 - protein, 714 aa, Synechocystis sp. PCC 6803
MDSPAILPTTRTLCPYCGVGCGLEAVASPQKSVVDAGHAHKIRGDRQHPSSQGMVCVKGATVMESMDKQRLLYPMFRSSLDQPWQQISWEAALEIVVDKIQQVKQTLGVSGLCMYASGQMQTEDYYVAQKLFKGCLGTNNFDTNSRLCMSSAVSAYSLSFGSDGPPCCYEDLEITDCAFLIGTNTADCHPIIFNRLRKHHKQNPHVKLIVVDPRCTATAEVADLHLAINPGSDITLLHGIAYLLKKWNLIDQKFIDNHTQDFEQYCQVIDHYPPEKVTQICGISLEQLETAAHYWGNAKTVLSLWSMGMNQSFQGTAKGRCLINLHLLTGQIGKPGSGPFSLTGQPNAMGGREAGGLSHLLPGYRSIKNPQHRQEVEQLWQISPGRINPEPGLSAWEMFMGLENQQVGFLWIVATNPVVSMPDLERVKKALQQSTFTIHQDAYSPTETAEYAHLLLPAAQWSEKTGTMTNSERRVTLSPAFRSPPGEARPDWEIFAEVGRRLGFENQFNFVDSAAVHREYVQLTAERLCDQSGVSYEKLQKLGPLQWPCRQSDQESQLLSTKRLYTDYKFCTENGRANFCLDHSRGLAEPVDPNYPFVLTNGRLYGHWHTQTRTGHIEKIKKMHPKPILEMHPKDAEKLGIKSQDLVAIKSRRGSAQLEVLVTRAIAPGTVFMPMHWGFLWDDNAEVNSLTHATACPISKQPELKACAVNITPV

SEQ ID NO: 22929 - protein, 347 aa, Arabidopsis thaliana
MWRYICLPFFLLLWNDIGLAKEASESILLPSESGFDGSRSPVCSSPDPNLNYRPVIGILSHPGDGASGRLTNDTSSTYIAASYVKFAEAGGARVIPLIYNEPEEVLFQKLELVNGVIFTGGWAKKYDYFEIVKKIFTKALERNDAGEHFPVYGICLGFELMSIIISQNRDILERFDAEDNASSLQFVDNVNNDGTLFQRFPPELLKKLSTDCLVMQKHKYGITPANFQANPALSSFFEILTTCIDENSKTYVSTVKAKRYPITGFQWHPEKNAFEWGSSAIPHSEDAIQVTQHAASYLVSEARKSLNRPESQKVLSNLIYNYKPTYCGYAGRGYDEVYIFTQPRSRF

SEQ ID NO: 22930 - protein, 276 aa, Mycobacterium sp. MCS
MPDRRPAAVPDSARKAAVLGSPIAHSRSPQLHLAAYRALGLTDWTYERIECTAEQLPGLVGGFGPEWVGVSVTMPGKFAALRFADERTERAELVGSANTLVRTPNGWRADNTDVDGVAGALGNVDGPGIVVGSGGTAPAAVVALAGLGATRLTIAARNADKAASLVDLAHRLGVTARWCDLDDPDLTALAAAAGAVVSTVPADVAQRYAATFAGTPVLLDAIYDPWPTPLAAAVQAAGGRVIGGLQMLLHQAFAQVEQFTGLPAPKEAMRAALQTA

SEQ ID NO: 22931 - protein, 128 aa, Legionella pneumophila str. Lens
MQPINTKLAPKAIGTYSQAIKSGEIVFLSGQIPLDPETMQICSDDIKLQITQVLENLSAVCEEAGGSLANIVKLNVYLTDLSHFPLINEAMSRYFSEPYPARAAIEVSALPKGAKVEMDGILVLSASA

SEQ ID NO: 22932 - protein, 417 aa, Burkholderia pseudomallei K96243
MAEIKNYTLNFGPQHPAAHGVLRLVLELDGEVIQRADPHIGLLHRATEKLAENKTFIQSVPYMDRLDYVSMMVNEHGYVLAIEKLLGIEVPERAQYIRVLFDEITRVLNHLMWIGAHALDVGAMAVFLYAFREREDLMDVYEAVSGARMHAAYYRPGGVYRDLPEAMPQYKASKIRNERALAKMNEARSGSVLDFIDDFFTRFPKCVDEYETLLTDNRIWKQRLVGIGVVSPERALQLGLTGPMIRGSGIAWDLRKKQPYEVYDRLDFDIPVGVNGDCYDRYLVRVEEMRQSTRIAKQCIEWLRKNPGPVITDNHKVAPPSRVGMKTNMEDLIHHFKLFTEGFHVPEGETYAAVEHPKGEFGIYLVSDGANKPYRLKIRAPGYAHLSALDEMARGHMIADAVTIIGTQDIVFGEIDR

SEQ ID NO: 22933 - protein, 559 aa, Mesembryanthemum crystallinum
MGSTEFSWKLADHPKLPKGKTLAMVVLDGWGEASANQYNCIHVAETPTMDSLKQGAPEKWRLIRAHGKAVGLPTEDDMGNSEVGHNALGAGRIYAQGAKLVDLALESGKIYDGEGFNYIKESFETNTLHLIGLLSDGGVHSRLDQLQLLLKGSAERGAKRIRVHILTDGRDVLDGSSVGFVETLENDLAQLRAKGVDAQIASGGGRMYVTMDRYENDWSVVKRGWDAQVLGEAPYKFKNAVEAVKTLRQEPKANDQYLPPFVVVDESGKAVGPIVDGDAVVTLNFRADRMVMLAKALEYEDFDKFDRVRFPKIRYAGMLQYDGELKLPNRYLVSPPEIERTSGEYLVHNGVRTFACSETVKFGHVTFFWNGNRSGYFKPEMEEYVEIPSDSGITFNVQPKMKALEIAEKARDAILSGKFDQVRVNLPNSDMVGHTGDIEATVVACKAADEAVKMIIDAIEQVGGIYVITADHGNAEDMVKRDKKGQPAMDKNGNIQILTSHTLEPVPIAIGGPGLTPGVRFRNDIPTGGLANVAATVMNLHGFEAPSDYEPTLIEVVSN

SEQ ID NO: 22934 - protein, 162 aa, Burkholderia pseudomallei K96243
MTAIQQFFKTFFLTELLKGLALTGRYTFKRKFTVQFPEEKTPISPRFRGLHALRRYENGEERCIACKLCEAVCPALAITIESETRADNTRRTTRYDIDLTKCIFCGFCEESCPVDSIVETQILEYHGEKRGDLYFTKDMLLAVGDRYEKEIAAAKAADARYR

SEQ ID NO: 22935 - protein, 116 aa, Triticum aestivum
MDQGDVAVAVPPAAPSSSCAGAGCKKGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 22936 - protein, 132 aa, Prochlorococcus marinus str. MIT 9211
MTLPSKRAVETKFAPSPVGPYSQAVIAGGWLFCSGQIGLDASTGLIVGEGDIEAETRQVIKNLLAVLHASNAKASQVIKTNIYLINLKDFELVNKIYAEVFSQEISPARACVEVSGLPKGALVEIDCVAWLG

SEQ ID NO: 22937 - protein, 223 aa, Vibrio sp. Ex25
MELTVSVKIHYQNTHFITSAPDIRHLPEDEGVEIAFAGRSNAGKSSALNRLTNQKSLAKTSKTPGRTQLINLFKVEEGCHIVDLPGYGFAQVPVEMKNKWQKSLGEYLQKRECLKGLVVLMDIRHPMKDLDQQMIFWAIDSHIPVQVLLTKADKLKSGARKQTLLKVRKQVETFGGDVSVDVFSSLKGLGVDQLRAKLDTWFAPALAHLIEEGELDTPASDEE

SEQ ID NO: 22938 - protein, 415 aa, Pseudomonas fluorescens Pf-5
MDAFNYRDGELFAEGVALSAIAERFGTPTYVYSRAHIEAQYQAYAQALAGMPHLVCFAVKANSNLGVLNVLARLGAGFDIVSRGELERVLAAGGQADKIVFSGVGKTRDDMRRALEVGVHCFNVESAEELERLQLVAAELGVRAPVSLRVNPDVDAGTHPYISTGLKENKFGIDIATAEDVYIRAAQLPNLEIVGVDCHIGSQLTTLEPFIDALDRLLDLVDRLGECGIYLRHIDLGGGLGVRYRDEEPPLAADYVKAVRERLDGRDLALVFEPGRFIVANAGVLLTRVEYLKHTEHKDFAIVDGAMNDLIRPALYQAWMDVSAVRPRDTEPRTYDIVGPICETGDFLAKERTLALAEGDLLAVHSAGAYGFVMSSNYNTRGRAAEVLVDGDQAVEVRRRETVAELFAGESLLPE

SEQ ID NO: 22939 - protein, 451 aa, Streptomyces coelicolor A3(2)
MREILIVGGGYAGFYTAWGLEKKLRRDEARVTVVDPRPYMTYQPFLPEVVAGSVEARHAAVSLRRHLHRTRLIAGSVTEIRDSAHTATVRPQSGPEFDLHYDILVMTAGAVTRTFPIPGLSDQAYGLKHVEEAVAIRDRLLTSFDRAATLPHGPERRRLLTATVVGGGFSGVEGFGELLSLASALLKHYPEIGAEELAFHLVEARGRILPEVTDGPGEWVVRSLEKRGARVHLNTQLVSAKDGRVVLSDGSEYDSELLVWTAGNAANPIVHNHTDLPVDARGLLMVRADLRVGTESEVVADVWAAGDDASVPDLAAGRPDARTVPNAQHAVRQGKLLAKNILASLRGRPAKDYVHHSLGVVATLGLGRGIFQYRRLVIKGFPAWLMHRGYHVLAIPSWERKARVFAVWVTAAFFGRDVISLASVQHPREAFVSSGDPRRGEKSADADAVAG

SEQ ID NO: 22940 - protein, 275 aa, Campylobacter coli RM2228
MLANTKSGKKLRSKLLLAIAGENANSYKICAAIELIHLASLLHDDIIDESKLRRGAKSVNAEFGTKNALMLGDILYSKAFYELSQLDACFASIISDAVVKLAVGELMDVEFSKSFNADKDKYLKMIYNKTAVLIEASARCGAILANLDEKAFGEYGKNLGLAFQMIDDILDIKGDEKTLGKPAMNDFKEGKTTLPYIYLYENLNNEDRAQLKNLFQKDLNNDEKIWIQTKFEETKALNKAILEAKEYAHQAALAIKDFSNEKLQDIIQAMIDRDF

SEQ ID NO: 22941 - protein, 377 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTSAEREIVRDVKEKLAYIALDYEQEMETANTSSSVEKSYELPDGQVITIGGERFRCPEVLFQPSLVGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 22942 - protein, 292 aa, Bradyrhizobium japonicum USDA 110
MSKRGYAASKKLLTGLIGAPIAHSASPAMHERAAEALGLRGHYQLIEVAGADAAGLRLMLEGVRRLGFAGVNVTYPYKEAVVPLLDALAPGAAAMGAVNTVVVRDGRLTGHNTDTTGFARAVAPLLAPSGNAVAVIGTGGVGKAIAFALASLEVADLRIFDSEPARAEKLAALLAKHGGARVAKSVEDALDGATGLVNGTPVGMLPNRGMPVPAALLHEKLWVADAVYSPLITPLLAAAQERGAKIMTGRELAIYQAADAFELFTGLAPSTEVMGEAFDEVMAARSSAYHAA

SEQ ID NO: 22943 - protein, 205 aa, Zea mays
  misc_feature (52)..(52): Xaa can be any naturally occurring amino acid
  misc_feature (157)..(157): Xaa can be any naturally occurring amino acid
  misc_feature (184)..(184): Xaa can be any naturally occurring amino acid
  unsure (1)..(205): unsure at all Xaa locations
VDFFFQLHLSHVTRRFAASISERWIWARVIAPEEACSVWALPPEPARDRFCXHGGPPPRAALVGRAAPPSSSSRLEAVEVLPAGVQPYTVRVTGLARGSFFYQCVCVYLLLEPTPEEVGASDHCCADFGYRRKTPWLPHVRLLYGDFTDDDDELMRXAKKKIDELIKDICGIEFDITELVLYRXDAIDISLESWELVEVCHLEKK

SEQ ID NO: 22944 - protein, 326 aa, delta proteobacterium MLMS-1
MATGKILIVDDSPESVVLLRRMLEGGGYREIYDADGAAAAFAFFGLDDQGGGTPAPDVDCDLILLDIVMPGMDGIEVCRRLKKIPGLSEIPVIMVTADNTDSNLRAVFDLGAVDYIHKPVKQVELCARVKSALRLKDEMDRRATLAWELEEANQRLRQMAMVDGLTGIANRRRCDEFLEREWRRCRRDALPVAVCLVDIDFFKLYNDLYGHLRGDEVLKQVATLFQKAVNRPGDLLARFGGEEFVFILSGTDAQGAEKVARLAIAELQQAAIDHPHSPAGEHLTVCFGIAASKPALDTHPRLLLDQADKALYEAKQTRGNRIVVAA

SEQ ID NO: 22945 - protein, 224 aa, Brassica napus
GFTLEDATGLTVNGDIDVHSVVVASLPTSHPSFAPQRHLELSKRWQAPLVPDGPVELFIGILSAGNHFGERMAVRKSWMQHVLITSSKVVARFFVALHGRKEVNVELKKEAEYFGDIVLVPYMDSYDLVVLKTVAICEHGALAYSAKYIMKCDDDTFVKLGAVINEVKKVPEGRSLYIGNMNYYHKPLRGGKWAVTYEEWPEEDYPPYANGPGYVLSSDMARFI

SEQ ID NO: 22946 - protein, 658 aa, Streptococcus thermophilus LMG 18311
MSNLSVNAIRFLGVDAINQSNSGHPGVVMGAAPMGYTLFTRQMHVNPEVPNWINRDRFVLSAGHGSMLLYALLHLSGFKDLSIEELKQFRQWGSKTPGHPEFGHTVGVDATSGPLGQGIAMAVGMAQAERFLASRYNKEGFPIFDHYTYVIAGDGCFMEGVSAEASSYAGLQKLDKLIVLYDSNDINLDGETKDSFTEDVRARYEAYGWNTEFVQDGTDIEAINAAIESAKASGKPSLIEVKTVIGHGAPNKQGTNGVHGAPLGPDETAAARENLGWNHAPFEIPKEVYADFKENTVDRGRQAYDTWVALVDEYKQSYPELGSELARILEGKDAVEFQSSDFPAVENGYSQATRNSSQDALNAIADKVPTFLGGSADLAHSNMTYIKSEGLQDDEHRLNRNIQFGVREFAMGAILNGMSLHGGLRVYGGTFFVFSDYVKAAVRLSALQGLPVTYVFTHDSIAVGEDGPTHEPIEHLAGLRAIPNLNVYRPADARETQAAWYQAITSKSTPTALVLTRQNLTVEEGTDFDKVSRGAYVVHETAADFDTILLASGSEVNLAVASAKALESEGYKVRVVSVPSTDVFDAQDQAYKEEVLPNAVRRRVAIEMAASLPWYKYVGLDGAVIGIDTFGASAPAAKIIEEYGFTVENIVETVKGMN

SEQ ID NO: 22947 - protein, 534 aa, Porphyra yezoensis
MKKKIVHPIVLAILDGWGHTNIQQGNAIKIAKTPTIDSLIQAYPSTLLAASGQEVGLPKGQMGNSEVGHTTIGGGRVIQQELVKIGNSIVDNSFFNNLELNEACEYANNNKASLHLIGLCSNGGVHSHIDHLLALIDLADSKQVTNLYLHLITDGRDTSSNSAKYFIKIVADHIEHKQFATISTISGRYYAMDRDFRWSRTQAAYNILTSNNSIKLNASVNYGDLIDHYYNKGISDEFIPPSRINLGSIKDNDAIVFFNFRPDRMRQIVQAFVQKPFNCFATKPLYNLRVVTFTNYDTSLNTTIAFHPHILNNFLGEVLYKYGLKQFRVSETEKYAHVTYFFNGGAEEPFPGEDRELVSSPDVTTYDLSPDMSAELVTQKSISAIKKAIYSCIVINYANADMLGHTGKLKETIQSIETVDRCITELLDAVSKLNGTLIITADHGNAECMFTDEGNPCTAHTTNLVPLILIEGEQEAISGHGGQVKLRNNGSLADIAPTILDILHLKKPPEMTGKSLIINSRYETRNIEKTSIEL

SEQ ID NO: 22948 - protein, 519 aa, Oryza sativa (japonica cultivar-group)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 22949 - protein, 107 aa, Porphyra yezoensis
MDTETKKRIDQLLNDHKIVLFMKGNKTMPMCGFSNTATQILNTLNIKYFTYDILEDENIRKAIKEYSSWPTIPQLYINREFIGGADIMLELFETGELQAQVEALLAT

SEQ ID NO: 22950 - protein, 478 aa, Bradyrhizobium japonicum USDA 110
MTFVARHALWSDEQKDAAQRMRRIVEEKNLEVIRLAFPDQHGILRGKTIIAAEAIASLESGCSITTTMLAKDTSHRTVFPVFTSGGGFGMKEMEGAADVLMVADPTTFRVLPWAPTTGWVLCDLHFNDGRPVPFATRGLYRKVLDELAGRGHDFVAGLEVEFHIFKLDDPHMRAEDAGQPGTPPSVSLLSHGYQYLTEQRFDQMEPVLEILRRDVVALGLPLRSVEVEFGPSQCEFTFAPRKGLEPADNMVLFRSAVKQIARRHGYHATFMCRPKLPNLFASGWHLHQSIVSRTSGENQFMAQAGGEPLSAFGRAYLAGLLDHARASAVFTTPTINGYKRYRSYSLAPDRAIWGRDNRGVMIRVLGAAGDAATRLENRIGEPAANPYLYMASQILSGLDGVDRKLDPGPSADTPYETKAPLLPKSLRDAVAALKEDPFFREKFGAEFVDYYTHIKNAEIDRFLAEVTDWEHREYFEMF

SEQ ID NO: 22951 - protein, 543 aa, Oryza sativa (japonica cultivar-group)
MAARGGSGCAASAAAGGGGCRRRISGPQPDMGSEVALAHLSERFWRPLIRSYCKYVRDISEDLHCILHFWTNEDLNKPLLEILDDHSSQSNTFPGNVVGESSKVQTSRSDTSPRSHGISDSGRTYPADSCTPQGSNLDVEVIAGPSHGISCSRQSTSPTIPITLGRVPPSDLVLKDSEVSGKHARINWNAKTLKWEIVDMGSLNGTFVNSRAVHHPNVGSRHWGEPAELADGDIITLGTSSKLSVQISLQNQRVPAGIGMASDPMVGRRSGKKLAMEDISFCQCPLQGVEQFGLFGIFDGHGGDGAARAVSKIFPENVATLLSHHETKEKVLSYSDASDVLRYAFTMTEAAIDHEYEGCTATVLLIWFDQKKDCFAQCANLGDSACVMSVNGKMIEMTEDHRVASVTERARIARAGQALKAGEVRINGLNLARMFGDKFLKEQDSRFSSEPYVSQAVHITKACTAFAVIASDGLWDVISTKRAVQLVVEGRERNSGDSASADKVRLQKPPVVSLTEMEYCGICQGLESSGVTLKFSVLIQQDA

SEQ ID NO: 22952 - protein, 521 aa, Thiomicrospira crunogena XCL-2
MTKAVQIKNRPTGLIILDGWGHREATQHNAIAQAHTPNWDNLLKDYHHTLINTSGLAVGLPEGQMGNSEVGHMNLGAGRVVYQELTRIQKDIDDGRFFENNALVKAIDAASNRDHKVHILGLLSDGGVHSHISHIKASIKMAHDRGAKVYVHIFTDGRDTAPQSALQYIEELETFMKELGGGRIASVTGRYFALDRDNRWERVKKAYDAIACGSAEFEAKDAKEAVELAYARGENDEFIQATVIPRNNGKPARVKDGDSVIFMNFRSDRARQLTEAFIMDDFADFHRCKTPVLSAFVTLTEYKKNFEKFGALVAYRPTSLRNTFGEYVSKKGLKQLRIAETEKYAHVTFFFNGGVEEPNDNEVRILINSPQVATYDLQPEMSLPELKEKLIDAIKSGEYDTFICNIANPDMVGHTGDFNACVQAAEAVDEALGEILATIKAVDGEAIVTADHGNMEMLFNEETGKPLTSHTTFPVPFVYFGKKGYPLKDGGALCDVIPTLLDMMGIEKPEEMTGTSLIDKA

SEQ ID NO: 22953 - protein, 420 aa, Streptomyces coelicolor A3(2)
MPRAKTFVIVGGGLAAGKAAEELREHGHDGPLLVIGDERERPYIRPPLSKGYLLGKEDRESIHVHPESWYREHDVDLLLGTSVTSVDARGRAVTLDDGRRVPYAGLLLATGSSPRRLSVPGADLEGVLYLRRVGDSERLKEAFTEGARIVVVGGGWIGLETAAAARAAGAEVTVLERGELPLLKVLGREAAEVFAGLHRDHGVDLRPHARIEAVTGTGGRVDGVRLADGTHLPADAVVVGVGITPNVRLAEEAGLDVRNGIVTDARLRTSAAGVHAAGDVANAYHPRLGRHLRVEHWANALHQPRTAALSMLGQDAVYDRLPYFYTDQYDLGMEYTGYAEPGGYDRVVFRGSREERRFLAFWMSGDRVLAGMSVNLWDVIGTIRALIESGAETDDAALADPSVPLESLLPPHARPTGDQA

SEQ ID NO: 22954 - protein, 524 aa, Arabidopsis thaliana
MGCCQSLFSGDNPLGKDGVQPQPLSQNNHGGATTADNGGSGGASGVGGGGGGGGIPSFSEFSFADLKAATNNFSSDNIVSESGEKAPNLVYKGRLQNRRWIAVKKFTKMAWPEPKQFAEEAWGVGKLRHNRLANLIGYCCDGDERLLVAEFMPNDTLAKHLFHWENQTIEWAMRLRVGYYIAEALDYCSTEGRPLYHDLNAYRVLFDEDGDPRLSCFGLMKNSRDGKSYSTNLAYTPPEYLRNGRVTPESVTYSFGTVLLDLLSGKHIPPSHALDMIRGKNIILLMDSHLEGKFSTEEATVVVELASQCLQYEPRERPNTKDLVATLAPLQTKSDVPSYVMLGIKKQEEAPSTPQRPLSPLGEACSRMDLTAIHQILVMTHYRDDEGTNELSFQEWTQQMKDMLDARKRGDQSFREKDFKTAIDCYSQNSYGYIHCFCGQFIDVGTMVSPTVFGRRSLCYLLCDQPDAALRDAMQAQCVYPDWPTAFYMQSVALAKLNMNTDAADMLNEAAQLEEKRQRGGRGS

SEQ ID NO: 22955 - protein, 475 aa, Bacillus subtilis subsp. subtilis str. 168
MNLQENSSQQLKRTMKSRHLFMISLGGVIGTGLFLSTGYTLHQAGPGGTILAYVIGGLMMYLVMQCLGELSVANAVTGSFQKYATTFIGPSTGFMVGIMYWINWVVTVGSEFTASGILMQRWFPDSSVWMWSAIFAALLFICNAFSVKLFAETEFWFSSVKIVTIILFIILGGAAMFGLISLNGTADAPMLSNFTDHGGLFPNGFLAVFIAMISVSFAFSGTELIGVTAGESANPQKDIPRSIRNVAWRTVIFFIGAVFILSGLISWKDAGVIESPFVAVFAEIGIPYAADIMNFVILTALLSVANSGLYASTRMMWSLANENMISSRFKKVTSKGIPLNALMISMAVSCLSLVSSIVAPGTVYVVMVAIAGFAGVVVWMSIALSQLLFRKRFLKKGGDVKDLTFRTPLYPLMPIAALLLCSASCIGLAFDPNQRIALFCGVPCIILCYLIYHFKRNVTKAKKISQEEYPADHIL

SEQ ID NO: 22956 - protein, 369 aa, delta proteobacterium MLMS-1
MSFAQFDFDATLTANIAACGYQAPTPIQTQAIPEIRRGRDIMGLAQTGTGKTAAFVLPLLQKLSAGPRGRVRAVIVAPTRELAEQIHVNIGELGRQTGIRSVAVYGGVSKFGQLKAFKAGVEIIVACPGRLLDHLDSRDVNLGAVEMLVLDEADMMFDMGFMPAIKKLLKYLPAKRQNLLFSATMPAEIRHLADSILKDPARVQINHTQPTALVAHKLYRVEKQGKGALLKQVMQESAFSSALVFTRTKHAAKKLALNLEKAGHRAVALQGNMSQNKRKAAMEGFKQGRFNIMVATDIAARGIDVAGISHVINYDMPATVEAYTHRIGRTGRAERNGEAYTFATAEDKVIVRQIERAIGSQMITLETPR

SEQ ID NO: 22957 - protein, 1112 aa, Mycobacterium sp. MCS
MPRRTDLRHVLVIGSGPILIGQAAEFDYSGTQACRVLRAEGLTVTLINSNPATIMTDPEYADYTYVEPITPDFVERVIAQQAERGNKIDALLATLGGQTALNTAVALSENGVLERYDVELIGADFDAIQRGEDRQRFKDIVTKVGGESAKSRVCFTMEEVRETVGELGLPVVVRPSFTMGGLGSGMAYSAEDVERMAGHGLASSPSANVLIEESIFGWKEYELELMRDRHDNVVVVCSIENFDPMGVHTGDSVTVAPAMTLTDREYQTMRDLGIAILREVGVATGGCNIQFAVNPKDGRLIVIEMNPRVSRSSALASKATGFPIAKIAAKLAIGYTLDEILNDITKETPACFEPTLDYVVVKAPRFAFEKFPGADATLTTTMKSVGEAMSLGRNFIEALGKVMRSLETGRAGFWTAPDPIATVDEVLENLRTPTDGRLYDIEFALRLGASVEQVAEASGVDPWFVDQIAGLVALRTELLDAPVLDGTLLRRAKNSGLSDRQIAALRPELAGEVGVRALRQRLGIHPVFKTVDTCAAEFEAKTPYHYSSYELDPAAESEVAPQAERPKVLILGSGPNRIGQGIEFDYSCVHAATTLSEAGFETVMINCNPETVSTDYDTADRLYFEPLTFEDVLEIYYAESASGAGGPGVAGVIVQLGGQTPLGLAERLEQAGVPIVGTSPKAIDLAEDRGAFGEVLRTAGLPAPRFGLATTFDQARRIAADIGYPVLVRPSYVLGGRGMEIVYDEQTLEGYITRATQLSPEHPVLVDRFLEDAIEIDVDALCDGTEVYIGGIMEHIEEAGIHSGDSACALPPVTLGRSDIESVRRATEAIAHGVGVVGLLNVQYALKDDVLYVLEANPRASRTVPFVSKATAVPLAKACARIMLGASIAQLREEGVLAATGDGATTARNAPVAVKEAVLPFHRFRKADGAQIDSLLGPEMKSTGEVMGIDHDFGSAFAKSQTAAYGSLPSEGTVFVSVANRDKRSLVFPVKRLADLGFKVLATEGTAEMLRRNGIPCDEVRKHFEEPGAGRPARSAVEAIRAGDVAMVINTPYGNSGPRIDGYEIRSAAVSMNIPCITTVQGASAAVQGIEASLRGDIGVMSLQELHSELGN

SEQ ID NO: 22958 - protein, 379 aa, Legionella pneumophila str. Lens
MEQRDYYELLEVSRNASDAEIKKAYRRLAMKYHPDRNPGDTSAEEKFKEIQKAYNILSDKQKRAAYDQFGHAGVDPSMGGGPGGFGGFGGFGDVFEDIFENIFSGGRGQGRQSRGQRGADLQFNVQLTLEEAAIGKEVEITVPRHGTCTVCEGSGAKKGTSPKTCETCQGMGQVRIQQGFFSIQQTCPTCHGEGKIISDPCASCHGQGRVRESKKINVKIPAGVDNGDRVRLSGEGEAGVHGGGSGDLYVQISLKKHAIFERHENDLHCEVPISFATAALGGSIEVPTLEGRVTLKIPAETQTGKVFRLRSKGMKSVRGYGQGDLLCKVVVETPVNLSREQKELLNKLQDSLENAKGTHSPKTSSWFAGVKKFFEDMKF

SEQ ID NO: 22959 - protein, 208 aa, Zea mays
  misc_feature (158)..(158): Xaa can be any naturally occurring amino acid
  unsure (1)..(208): unsure at all Xaa locations
MVELLPVGFMDWLALAVAVALYYFLVEQLSYRRKKGALPGPSLVVPFLGSIVPMIRDPAGFWDTQAARAKKSGAGLAAEFVVGRFIVFIRDSELSHRVFANVRPDAFQFVGHPFGKDLFGIFYLFGDEHKDLRRRMAPNFTPRTLSTYAAVQQRIILXHIRRLLDRNRRSVAAPIQVTCRNINLETSQTVFVGPYLTEEARERFHQDY

SEQ ID NO: 22960 - protein, 466 aa, Chlorobaculum tepidum
MSRKQNIRNIAIIAHVDHGKTTLVDSIFKQTGAFRENQHVDVRVMDSNPQERERGITIFSKNAAVQHKGCKINIVDTPGHADFGGEVERILKMVDGVLLLVDAFEGPMPQTKFVLRKALELHLKPIVVINKIDRPQADPEKVHDQVLDLFIALGADEDQLDFPYIFASAKNGIAKCNMSDPDGDMSLLLDMIVKEIPAPEADDDAGFQMLVTSLDYSDYIGKIAIGRIQRGKVAPGNQLTLVTQDGVVGKGTVTKLFLFDRTQRVEAMEATAGDIVALAGIAAANVGETLTTPDQPEPIESFEISKPTLSMLFSVNDSPFAGQEGKEVTSRKIRERLMKEIMTNVALNVEETDSADTFRVSGRGELHLSVLIETMRREGYELAISRPEVILREENGVTMEPVEHVTIDVPEEYTGVVIEKMGRRKAEMTNMSTLRGGMNRLEFEIPTRGLIGYNLEFTTDTKGEGM

SEQ ID NO: 22961 - protein, 457 aa, Clostridium thermocellum ATCC 27405
MYDLQRKDLEYIWHPCSQMKDYEDFPPIVIERGEGPYIFDVLGNRYIDAVSSWWVNLFGHCNKRINDAVKRQLDSLEHVIFANFSHRPAIELAGKIVEITPQGLNKVFFADNGSSAVEIALKLSFQYHLQTGSCEKKKFVALSDAYHGETLGALAVGGLDLYSKIYKPLMMSTIKVPGPDCYRCKYGKERTCCEAECFCEMEKILEEKHREICGVIIEPMVQAAAGMKIYSAKYLIKLREACSYYNIHLIADEIAVGFGRTGKMFACEHGGISPDIMCLSKGLTAGYMPLSLVVTTQKIYDAFYSDYIELKAFLHSHSYTGNPLACAAALESLKIFEDDDVLNKNREKSGLFRKLAESLAHSHPYVGEFRQIGMIAALELVENKAQKKEFDWKKRVGYNIYKLALKKGLLLRPLGNVLYFMPPYVVGQKDIEDIVSGAFYAINEYFGLDFKYKRMFP

SEQ ID NO: 22962 - protein, 384 aa, Burkholderia pseudomallei K96243
MPTTPTLLSRLPEVGTTIFTVMSALAAEKGAVNLGQGFPDFDCDPRIVDAVAHAMRDGRNQYPPMAGVAPLREAIADKIERLYGRRYDAATEITVTAGATQALLTAILCAVHPGDEVIVIEPTYDSYLPSIELAGATPVFVTLNAPDYAIPFDKLAAAITPKTRAILINTPHNPTGTVWREADMRALEDIVRGTGLLIVSDEVYEHMVYDGARHESVARYPELAARSIIVSSFGKTFHVTGWKIGYVAAPAPLTAEFRKVHQFNVFTVNTPMQFGLADYLRDPEPYLTLPAFYQQKRDFFRAGLANTRFALLPCAGTYFQCVDYSAISDLPEAEFAKWLTTEIGVAAIPVSAFYHEPHESGVVRFCFAKREDTLATALERLARL

SEQ ID NO: 22963 - protein, 630 aa, Cytophaga hutchinsonii ATCC 33406
MTTENTNMAPQITREPLTGSQKIYVSGTMHPSVKVAMREIKLEDTVIHTGLKGAAEKRQKNPSVTVYDTSGPYTDPSIDIDIRKGLPRLREQWILERGDVEEQKESFSEYTQKRNNDPSLDHLRFDHLKQPLRAKPGQNVSQMHYARKGIITPEMEYIAIRENNRIQELQASGDSIKSLWDQHEGHSFGAAIPKVITPEFVREEVARGRAIIPSNINHPESEPMIIGRNFLVKINTNIGNSAVTSSIEEEVEKAVWSCRWGGDTLMDLSTGKNIHETREWIIRNCPVPVGTVPIYQALEKVNGKAEDLTWEIFRDTLIEQAEQGVDYFTIHAGVLLRYIPSTAKRVTGIVSRGGSIMAKWCLSHHKENFLYTHFEEICEIMKAYDVAFSLGDGLRPGCLADANDEAQFSELKTLGELTEIAWKHDVQVMVEGPGHVPMHMIKENMDKQLKECHEAPFYTLGPLTTDIAPGYDHITSAIGAAMIGWFGTAMLCYVTPKEHLGLPNKKDVKDGVMAYKIAAHAADLAKGHPGAQNRDNALSKARFEFRWADQFNLSLDPDTAREFHDETLPAEGAKIAHFCSMCGPHFCSMKITQEVRDYAEANGLNDGAILEEGMKAKSEEFKKVGGDLYV

SEQ ID NO: 22964 - protein, 216 aa, Vibrio sp. Ex25
MNYQAAIFDMDGLLLDTERVCMRIFQEACEVQNLPFYEDVYLSIIGRNAAGIEAIFRKAYGENLDRLHHEWRTRYNAVVKHQAIPVKNGVVELLEWLKAQGLPIAVATSTAKEVAKIKLELAGLSKYFDNLTTGCEVNHGKPDPEIYLLAANRLDVEPSQCLAFEDSNNGVRAAVAANMVTYQIPDLVEPCEEVKQFGHSIVPSLHEALDALKQNR

SEQ ID NO: 22965 - protein, 142 aa, Brassica napus
  misc_feature (33)..(33): Xaa can be any naturally occurring amino acid
  misc_feature (41)..(41): Xaa can be any naturally occurring amino acid
  misc_feature (56)..(56): Xaa can be any naturally occurring amino acid
  misc_feature (71)..(71): Xaa can be any naturally occurring amino acid
  misc_feature (95)..(95): Xaa can be any naturally occurring amino acid
  misc_feature (105)..(105): Xaa can be any naturally occurring amino acid
  unsure (1)..(142): unsure at all Xaa locations
ATTIVFLGYIEESQIPSLCNSVFGATCYLMEQXCAYSGNDXSTLVLVLHEVEVEFXLEASRAEKHSLPLLXFGETKNGQILPPMAKAVGIPAAIXALLLIADKIXTRVVLRPLDPEVYFPALDISPAYGMNLMEKAEAFLFL

SEQ ID NO: 22966 - protein, 379 aa, Oryza sativa (japonica cultivar-group)
MTSSPSWFSGIARASSTMPPGGVASAAAPLSDGAGGRGGGGGGGGGGGGVVAAVVAAGPGAGAGVGAGGKRRQVQGALFKYGPKSAQVAFKTGDFNHQVIFIGGLTDGFLATDYNSLYVESNKHEKNLKNDELEKDRKNNTISSLLGAFVTCTRGREMVTGTAVTFFIIHWDALELDQLISYLINKENSDGVILLGHSTGCQDIVHYMRTNFACSKAVSGVILQAPVSDREYRATLPETAEMIDLAAKMLSEGRGMDLMPREANPDAPITAYRYHSLCAYMGDDDMFSSDLSEDQLRQRLGHMSTTQCQVIFSMGDEYVPEYVDKEALVDRLCRALGNAEKVEIEWGNHALSNRVQEAVRAIVDFVKREGPKGWDDPWS

SEQ ID NO: 22967 - protein, 382 aa, Vibrio sp. Ex25
MQAPIVIIGSGFAAYQLVKTVRRMDAQVPIQVFTADDGAEYNKPDLSHVFSRKQTARDLVVTTGEAFAQEHHIELLTHTKIESVDTQAQQVVADGQVYAYSKLVFATGAKAFVPPMRGDASGDVLTLNSLQEYQLAEERVSQAKRVMVIGGGLIGVEIAMDIASSGKAVTVVESNQRLLANLIPEFVALPLESQLKQQGIQLALGNGVVEVNRNADSLVATLNSGEVIDTDVVISAAGLRSNTQLANACGLEVGKGIAVDAKLQTSTNNVFALGDCAEIQGRMLPYLQPIVLSANVLGKQLLGQEAQLKLPPMMVKVKTPSYPIQLAGDFSAVANWNVQISQSGIVAKAENEQSILTGFVVTGEQVAQAFPLLRELSQVAQS

SEQ ID NO: 22968 - protein, 421 aa, Oryza sativa (japonica cultivar-group)
MNGQPRFHDMIGGGGKGMQDNEINGLFNMPSYHKFVEGSQMSVDSADGFNMANYVGGSVAMSVDNSSVGSNESRTVILKHPGLRDAPTASYSVGNSVFRPNRVAAHTLNEDALARVLMDPSHPTEILSNYEEWAIDLGRLDMGVPFAQGAFGKLYRGTYNGEDVAIKLLEKPENDPERAQALEQQFVQEVMMLSRLRHPNIVRFIGACRKSIVWCIITEYAKGGSVRQFLARRQNKSVPLRLAVKQALDIARGMAYVHALGFIHRDLKSDNLLIAADKSIKIADFGVARIEVKTEGMTPETGTYRWMAPEMIQHRPYDHKVDVYSFGIVLWELITGMLPFTNMTAVQAAFAVVNKGARPVIPQDCLPALSHIMTLCWDANPEVRPAFTDIVCMLESAEMEILSNVRKARFRCCITEPMTTD

SEQ ID NO: 22969 - protein, 549 aa, Oryza sativa
  misc_feature (543)..(543): Xaa can be any naturally occurring amino acid
  unsure (1)..(549): unsure at all Xaa locations
MDTDKLGEAAAAHPPEAEKRRGVAAPGAATVLVLVALPLMLVSYFFGDLAADTVVRLHRFKESSLSSSSPAAAADRLLGGLLSPEFDEASCLSRYEASSRWKPSPFRVSPYLVERLRRYEANHRRCGPGTARYRDAVARLRSGDGDGDAECRYVVWLPIQGLGNRMLSLVSTFLYALLTGRVVLVHEPPEMEGLFCEPFPGTSWLLPPDFPYKGGFSAASNESYVNMLKNGVVRHDGDGGALPPYVYLHLEQIHLRLQNHTFCEEDHRVLDRFNWMVLRSDSYFAVALFLVPAYRAELDRMFPAKGSVFHHLGRYLFHPGNRAWGIVERFYDGYLAGADERLGIQVRIVPQMAVPFDVMYEQILRCTREHGLLPQVTSTSESAGGRPPPPPTATATKVKAVLVVSLKREYYDKLHGAYYTNATASGEVVAVYQPSHDGDQHTEARAHNERALAEIYLLSFSDAVVTTAWSTFGYVAHALAGVRPWQLAPLDWGKMRADVACARPASVEPCLHSPPPLVCRARRDRDPAAHLPFLRHCEDVPAXGLKLFD

SEQ ID NO: 22970 - protein, 432 aa, Glycine max
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKSIKVVSSRDPLKLPWAELGIDIVIEGTGVFVDGPGAGKHIQAGAKKVIITAPAKGADIPTYVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYRLVHSPSMYNKLSSLTHFLNIILTR

SEQ ID NO: 22971 - protein, 337 aa, Zea mays
  misc_feature (121)..(121): Xaa can be any naturally occurring amino acid
  unsure (1)..(337): unsure at all Xaa locations
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKXVISAPSKDAPMFVVGVNEKEYKSDINIVSNASCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTGRLEKSATYDEIKAAVKAEAEGSLKGILGYVEEDLVSTDFQGDSRSSIFDAKAGIALNGNFVKLVSWYDNEWGYSTRVVDLIRHMNSTK

SEQ ID NO: 22972 - protein, 631 aa, Solibacter usitatus Ellin6076
MCGIAGYALIDQSAQRARVQAMCDQIRHRGPDDEGVHVDRNCAIGMRRLSIIDLSTGHQPMCNEDGSVWIVFNGEIYEYKELRAELIAHGHQFRTASDTETLLHLYEEEGVEGLRRLRGMFAFAIWDARRNRLMLARDPFGKKPLYYAVLPTGIYFGSEISCLREAGVPLEPDPEALRLYFQFNYIPDPMSAYRAVRRLPAGSWLTWENGQVRQGRYWQPPVPAAQPVAGLSHADAVVKVREKFDEAVRIRMIADVPLGAFLSGGIDSSSIVASMAMQSREPIKTFSIGFEESEFNELPYAAMVARKYGADHHEIVVRPDSIGIIRKFARHFGEPFADASAIPTYIMSEFAARYVKVALSGDGGDELFGGYTSLRQVQKLAAFDRVPQAVRLMMSWASSRMPYSAYGKNFLHMLGRRSALDRYFAFNYAPFHMRSKLLRPDWMLPAESGFLARALPDCILPEDAGALSQVMYFEGTANLTGDMLVKVDRMSMAASLEVRCPLLDHELAELAATIPHAWKVVGGQGKRILLDALGDRLPPELLNRPKTGFGVPLVDWFRTSLRELLWDTLTAERFLAHNIVAPEFLRTLLEEHDSGRRDNSQWLFTLLVLALWFEDIEQPLASPVPARVEGA

SEQ ID NO: 22973 - protein, 300 aa, Mycobacterium sp. MCS
MPFQFSVDEGAEVIRRKLRDLPRREVHPEVEAQDRTIPGPAGDIPIRVYRPATAESSPPVVVFFHGGGFAAGDLDTHDGECRHHAVAADAVVVAVDYRLAPEHPYPAAVEDAWAALTWVAGHGAELSVDTNRLAVAGDSAGGNLSAVMTHRARTRGGPPIAFQLLWYPVTMWDMSLPSVTENAGAPILDRTAMDGLSRWYAGELTDPGHELAPGLADDFTGLPPAYIAVAGHDPLRDDGIRYAELLSAAGVPVEVHNAETLVHGYLGYAGVVPSATAATDRGLAALRAALHPEAGQRPEK

SEQ ID NO: 22974 - protein, 422 aa, Legionella pneumophila str. Lens
MHIHKIQAREILDSRGNPTIEADVILENGIIGRASVPSGASTGSREACELRDNDPKRYAGKGVQKAVKHVNEEINQALQGLSVSDQENLDRILCQLDNTENKSHLGANAILATSLACARARALSLNQPLYMTLNQGDMMTMPVPMMNILNGGAHADNNVDIQEFMIMPIGAPDFPVALQMGTEIFHVLKSVLKKQGLNTAVGDEGGFAPNIQSNRQALDLLSEAIEKAGFRLGEDIVFALDVAASELFNEGFYHMSSENQKFDSHQLIEYYANLISSYPIASIEDGLDEKDWSGWKQLTTLLGNKVQLVGDDLFVTNPKILQEGIAQGIANAILIKVNQIGTLSETRQAIKLAYDNGYRCVMSHRSGETEDTFIADLAVASGCGQIKTGSLCRTDRTAKYNQLLRINELASLPYAGKNILKR

SEQ ID NO: 22975 - protein, 625 aa, Isatis tinctoria
MGNTCVGPSRNGFLQSVSAAMWRPRDADDSVSQSNGDTASEAVSGELRSPSSDQVQNKPPEQLTMPKPGTNIEIKAKSDVEIQPEIKLETQEVTKPESKPETKSETKPETKSETKPETKSETKPETKADTPAKPKKPKHMKRVSSAGLRTESVLQRKTENFKEFYSLGRKLGQGQFGTTFLCVEKTSGKEFACKSIAKRKLLTDEDVEDVRREIQIMHHLAGHPNVISIKGAYEDVLAVHLVMECCAGGELFDRIIQRGHYTERKAAELTRTIVGVVEACHSLGVMHRDLKPENFLFVSKHEDSLLKTIDFGLSMFFKPDDVFTDVVGSPYYVAPEVLRKHYGPEADVWSAGVIVYILLSGVPPFWAESEQGIFEQVLHGDLDFSSDPWPSISESAKDLVRKMLVRDPKRRLTAHQVLCHPWVQIDGVAPDKPLDSAVLSRMKQFSAMNKFKKMALRVIAESLSEEEIAGLKEMFNMIDADKSGQITFEELKAGLKRVGANLKESEILDLMQAADVDNSGTIDYKEFIAATLHLNKIEREDHLFAAFTYFDKDGSGYITPDELQQACEEFGVEDVRIEEMMRDVDQDNDGRIDYNEFVAMMQKGSITGVPVKMGLEKSFSIALKL

SEQ ID NO: 22976 - protein, 544 aa, Ustilago maydis 521
MVAELKQRTTTATRDAPAAPKEEFADANIPDDYVSRVLATEKPLPPIQLKNILSEIQWVSFLALTVTPILAIYGLFTTSWNTKTALWSFIYYFMTGLGITAGYHRLWAHRSYNATYPLQYFLACMGSGAVQGSIHWWSRGHRAHHRYTDTDLDPYGAHFGLFWSHLGWMLVKPRRKPGVADISDLRKNPVIKFQHKFYIPMLLFFGFGLPTLVAGLGWNDWRGGFFFAGMLRLVFVHHSTFCVNSLAHYLGEATFDNKMTPRDHFFTALVTVGEGYHNFHHQFPMDYRNAVQWYQFDPTKWFIASMYKLGLATHLKTFPDNEVKKGRLAMQLQKAHELGQQLEWPKSSAHLPVISWDDFVEESKTRPLMVVHGFIHDVSSFLDEHPGGRHLLTGKIGKDATTAFLGGVYDHSNAAHNLLSMMRVGVLDGGYQLAKDELAKAERENRATGVSSHRPAGSPPSPVTSDDEDFAAPATPTDDTPMTTTSTVAAASEQLKAQQSADNVKSINAKAAAYVTPGEAYTIVKRGDLRENAKVGGTKFGRFL

SEQ ID NO: 22977 - protein, 191 aa, Brassica napus
  misc_feature (96)..(96): Xaa can be any naturally occurring amino acid
  unsure (1)..(191): unsure at all Xaa locations
MSYAAAAALFFPSTVSVRSPAKFLLRPSNPLRLLVPTTNGAASTKNAARRQMKRTFVVANALPVEDDGVSLGTMKLPMDTDLPRFETLLFQWANSXCQGANIPLPVPLKVDRISGGARLGFIVMEDEGKTDVPVYIDCLVYQSTESGSGSGPVFRATRNGRKKDKAPPGEERIMRSLLGALKRAVELARVS

SEQ ID NO: 22978 - protein, 507 aa, Mycobacterium smegmatis str. MC2 155
MTVFSRPGAADARMSFESRYDNFIGGEWVAPVDGRYFENPTPVTGQVFCEVARSSSADIEKALDAAHAAAPAWGKTAPAERALILNRIADRMEQNLEALALAEAWDNGKPIRETLNADIPLAIDHFRYFASAIRAQEGSLSQVDEDTVAYHFHEPLGVVGQIIPWNFPILMAVWKLAPALAAGNAVVLKPAEQTPASVLYLMSLIADLVPAGVVNIVNGFGVEAGKPLASSNRIAKIAFTGETTTGRLIMQYASQNLIPVTLELGGKSPNIFFSDVMAAADDFQDKALEGFTMFALNQGEVCTCPSRSLIQSDIFDEFLELAAIRTKAVRQGDPLDTETMIGSQASNDQFEKILSYIEIGKSEGARIVTGGERADLGGDLSGGYYIQPTIFTGHNKMRIFQEEIFGPVVAVTSFSDYDDAISIANDTLYGLGAGVWSRDGNTAYRAGRDIKAGRVWTNCYHQYPAHAAFGGYKQSGIGRENHKMMLDHYQQTKNLLVSYSDKAQGFF

SEQ ID NO: 22979 - protein, 423 aa, Cytophaga hutchinsonii ATCC 33406
MIMENKKNVVVIGGGFAGVQFIKKLDQKLFNVTLLDKINHHQFQPLFYQVATSQLEPSSISFPFRKIFQENENVQIRLAEVTGINPQANTVHTSIGDFNYDYVVIAAGCKTNFFGNKVIEENSYTLKSTSDSIALRNHVLINFEKIISAPKEEQEALFNIVIVGGGPTGVELAGAFAEIKRNILPKDYPGIDFTKLRIMLIEGSKNTLNSMSELAHKASRMYLEKMGVEIQTELFVKNYDGKIAELSNGERIPTASLIWAAGVTTNTFDGLEDSVYGPAKRIKVDRTSLVSGYANVYAVGDIAYMETPKYPKGHPQLANVAINQAKNLASNLKAIQKNKTLTEFEYKDLGSMATIGKNKAVVDLPFIKFKGFFAWLTWMFVHLMLILSVKNKLIIFINWAWAYITKDTSLRLILTQKGPKAEG

SEQ ID NO: 22980 - protein, 141 aa, Polaromonas sp. JS666
MAIERTLSIIKPDAVAKNVIGQIYARFEAAGLKVVAAKMAHLSKGEAEAFYAVHKERPFFKDLVSFMISGPVMIQALEGEGAILKNRDLMGATDPKKAAAGTIRADFADSIDANAVHGSDAVETAQAEIAFFFPGMNIYSR

SEQ ID NO: 22981 - protein, 333 aa, Cytophaga hutchinsonii ATCC 33406
MKVAINGFGRIGRISYRALLKKKNIEVVAINDLTDTKTLAHLFKFDSSHGVFDGEVSYDAENLIINGKKVKVLSVKNPADLPWKALGVDVVLESTGFFTEKEKAEAHITAGAKKVIISAPATGDLKTIVLGVNDNILDGSETVISNASCTTNCLAPMVKVLEDNFGIESGFMNTIHAYTSDQRLQDAPHKDLRRARSAALSIIPTSTGAAKALGLVIPSVQGKLNGTSLRVPVPVGSITDFTATLKRTVTKDEINAAFKKAAEEGSLKGYLAYSEDPLVSVDIVGNPASSIFDSELTMVQGNNVKVFGWYDNEFGYSNRTADLIELVGKQIKA

SEQ ID NO: 22982 - protein, 249 aa, Triticum aestivum
MAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 22983 - protein, 185 aa, Arabidopsis thaliana
MAISTLTLTQSLYTRSFRPTIFFSSSSSSSFSCLCSSSSDCEPKLSVKKRVFGVGLGFLASSILSLTPLDADATRIDYYATVGDPLCEYSYAKSGLGFCDLDVGFGDEAPRGVLVNGEQNNYISKLLMSKNDQVIRGLDQGILGGEGVPPMRVGKCGKRKLQIPPKLAYGPEPAGCFSGTCTIPL

SEQ ID NO: 22984 - protein, 178 aa, Rhodobacter sphaeroides
KPAVYFGGKARIIDFALSNAMNSGIRKMAIATQYKAHSLIRHIQRGWNFFREERNEYLDILPASQRVDENRWYLGTADAVTQNIDIVDSYDIKYVIILAGDHVYKMDYEIMLRQHCETGADVTIGCLTVPRAEATAFGVMHVDANLRITDFLEKPADPPGITGDEANALASMGIYVFK

SEQ ID NO: 22985 - protein, 1071 aa, Ashbya gossypii ATCC 10895
MDGDLFSVFGEEPKELPELPAEDIEQVPDEHQVETKKRGLSPSSNAKEESQQAESTAKKVKKDKELVDEKKKSEVVPVLADSFEKEASREVEASSGLATADAAQVEENGKMKLRHQVRHQVALPPNYDYKPIGQHIRTNEARTYPFTLDPFQDTAVSCIDRGESVLVSAHTSAGKTVVAEYAIAQSLREKQRVIYTSPIKALSNQKYRELLAEFGDVGLMTGDITINPEAGCLVMNTAILRSMLYRGSEVMREVAWVIFDEVHYMRDKERGVVWEETIILLPDKVRYVFLSATIPNAMEFAEWICRIHSQPCHIVYTDFRPTPLQHYLFPAHGDGIHLVVDEKGTFREENFQKAMASISNQLGDDSNSATSKGKRGQTYKGGAAKGDAKGDIYKIVKMIWKKKYNPVIVFSFSKRDCEELALKMSKLDFNSDEEKDALTKIFNNAISLLPEADRELPQIKHILPLLRRGIGIHHSGLLPILKEVIEILFQEGFLKVLFATETFSIGLNMPAKTVVFTSVRKWDGKQFRWVSGGEYIQMSGRAGRRGLDDRGIVIMMIDEKMEPQVAKGMVKGQADRLDSAFHLGYNMILNLMRVEGISPEFMLEHSFYQFQNITSMPVMEKKMNELSKKLEDIHVDDESNVKDYYDIRQTLDAYNEDVRKVMTHPANVLSFLQAGRLIKINVGGKQDYGWGAVVDFAKRINKRDPTAVYADHDSYIVNVVVNTMYKDSPLNLLKPFNPVLPEGIRPAADGEKTTCALISITLDSIQGLGNLRIFMPSDIKADSQKEVVGKTLKEVQRRFPKGIPLLDPIKNMKLEDEEFLKLLKKIEILESKMNSNPIANSVKLQELYEKYSEKVAMQNDIKHLKSKMNEAQAVIQLDDLRRRKRVLRRLGFCSASDIIELKGRVACDISSGDELLLTELILNGNFNELKPEQAAALLSCFAFQERCKEAPRLKPELAEPLKAMREVAAKIAKVIKDSKLEIVEKDYVESFRHELMEVVYEWCRGASFTQICKTTDVYEGSLIRMFNRLEELIKELIDVSNTIGNVTLKEKMEAALHMIHRDIVSAGSLYL

SEQ ID NO: 22986 - protein, 209 aa, Zea mays
MAASSALRLILGSSSASRRQILSEMGYKFTLISADIDEKAIRKENPEELVVALAHAKADAILEKMQNNGMMKEILDSQDTTLMITADQVVLHDGVIREKPSTPEEARKFIKGYSESHAATIGSVLVTNVKTGARREGWDKAEVYFHKIPDKVVESLIEEGDVFYVAGGLLVEHPLTSPLVEAIVGTIDSVMGLPKALTEKLIKESLSET

SEQ ID NO: 22987 - protein, 344 aa, Vibrio sp. Ex25
MTNATNRRIVLASRPHGAPTKENFRLEEVAKPTPQDGEMLLRTVYLSLDPYMRGRMSDAESYADPVAVDDVMIAGTVCQVEASNHPDYEAGEWVLAYTVGWQDYAISTGEMVIKLGKEPQNPSYALGVAGMPGFTAYMGLLDIGQPKPGETIVVAAATGPVGATVGQIGKIKGCRVVGIAGGEEKCRYAKEVLGFDECIDHKADDFAEQLKNACDQGIDVYFENVGGKVFEAVMPLLNTSARIPLCGLISQYNATELPEGTDHLPLLMGKLLTKRIKVQGFIIFDDYGHRYGEFAQDINQWLAEGKIQYREHLVQGLENAPEAFIGLLEGKNFGKLVVQINDPL

SEQ ID NO: 22988 - protein, 385 aa, Triticum aestivum
MTPALKLSPAAFSVTNQRSKSALVPSVSILNTNFFASCSLRPLYLTRLDDPHTFELKPRRQLLDFRCAASAADDKESKAEVLPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPVYLSLLPIIGGCGLAAATELNFNMIGFMGAMISNLAFVFRNIFSKRGMKGKSVSGMNYYACLSIMSLVILTPFAIAMEGPQMWAAGWQKALADVGPNVLWWIGAQSVFYHLYNQVSYMSLDQISPLTFSIGNTMKRISVIVSSIIIFRTPVRPVNALGAAIAIFGTFLYSQAKQ

SEQ ID NO: 22989 - protein, 545 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGRVIDKTSCVYAGDPSKLSMKAAFGKVWKLEQNGGSIIGGTFKAIQERKNAPKAERDPRLPKPQGQTVGSFRKGLRMLPEAISARLGSKVKLSWKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 22990 - protein, 475 aa, Polaromonas sp. JS666
MSKQFDVIVIGGGPGGYIAAIRAAQLGFNVACIDEWKNAKGGPALGGTCTNVGCIPSKALLQSSEHYEQAGHHFADHGIEVKGLSLDLAKMVGRKDTVVKQNNDGIVYLFKKNKVTFFHGRASFAAAKDGLYDIKVAGAAEETLSGKHIIVATGSNARALPGAPFDEESILSNDGALRIGAVPKKLGLIGSGVIGLEMGSVWRRLGAEVTVLEGLPTFLGAVDQQIAKEAYKAFVKQGLKIELGVQVGEVKSGKNGVSVAYVDAKGQAQKIDVDKLIVSIGRVANTIGLAPETVGLKLDERGAIVVDDECKTNLPNVWAIGDVVRGPMLAHKAEEEGVAVAERIAGQHGHVNFNTIPWVIYTNPEIAWVGQTEEQLKAAGRAYRAGTFPFMANGRARALGDTTGMVKMLADTATDEILGVHIVGPFASELIAECVVAMEFRASSEDIARICHAHPSLSEATKEAALAVDKRTLNF

SEQ ID NO: 22991 - protein, 422 aa, Polaromonas sp. JS666
MAIVEVKVPQLSESVAEATMLQWKKKIGEAIAIDEILIEIETDKVVLEVPAPSAGVLTELVVADGGTVVSDQVIARIDTEGKAGAGAPAPAAAAAAAPAAAASSVPAPAAGGSMAGVPMPAAAKLMADANLAAGSVPGTGKDGRVTKGDVLGATAAGAVKSVAASPVPTGAPTTSLPQVAAQVKPADLGDRPEQRVPMSRLRARVAERLLQSQSTNAILTTFNEVNMAPVMEMRKRFQEKFEKEHGVKIGFMSFFVKAAVHALKKYPVLNASVDGNDIVYHGYFDIGIAVGSPRGLVVPILRNADQMSFADIEKKIAEYGAKARDGKLGIEEMTGGTFSISNGGVFGSMLSTPIINPPQSAILGVHATKDRAVVENGQIVVRPMNYLAMSYDHRIIDGREAVLGLVAMKEALEDPARLLFDI

SEQ ID NO: 22992 - protein, 556 aa, Chlorobium tepidum TLS
MNQENASCPKKHFFGPASSRITVKGTIYPIEVGMRRVALTRSYECKGERFDAMPLYDTSGPFGDAEREHDVRKGLEPVRDRWGFDRGTVESVGGELSMTGRKPRVAKAGEAVTQMHFARKGIVTPEMEYVAIRENQALEAWIEKCGGKPVTPEMVRSEVARGRAIIPANINHPEIEPMIIGRNFRVKINANIGNSALGSSIDEEVEKAVWSCRWGADTVMDLSTGKNIHQTREWILRNSPVPIGTVPLYQALEKVGGKAEELSWEVYRDTLVEQAEQGVDYFTIHSGILAATLPDAEARQTGIVSRGGSIMARWCRAHKQENFLFTRFDDICDILRSYDVAISLGDALRPGSIGDANDAAQFGELKTLGELTLRAWKRDVQVMIEGPGHVPLHMIRENMEMQLKHCHEAPFYTLGPLVTDVAAGYDHVNSAIGGTLIASLGCSMLCYVTPKEHLGLPNRDDVREGVIVHRVAAHAADIAKGSATAWLRDELMSKARYAFAWEDQFSLALDPLKTRQIHAQNIAATGDTSATAKYCTMCGPDFCSMKRSQETTAAGL

SEQ ID NO: 22993 - protein, 166 aa, Oryza sativa
MENYQGQHGYGADRVDVYGNPVGAGQYGGGATAPGGGHGAMGMGGHAGAGAGGQFQPAREDHKTGGILHRSGSSSSSSSSEDDGMGGRRKKGIKEKIKEKLPGGNKGNNHQQQQMMGNTGGAYGQQGHAGMTGAGTGTGVHGAEYGNTGEKKGFMDKIKEKLPGQH

SEQ ID NO: 22994 - protein, 245 aa, Chlorobium tepidum TLS
MVGNWKMNNTIAESVDLATAIAEKVGADGVQCEVGIAPTFPALYEVCKVIEWSGIRLCAQNCHYESDGPFTGEVSTRMLAAAGCSYVILGHSERRQLFGETNATVNLKVKKALAEGLSVILCVGETLDERERGVTGQIVTAQVVEGLIDVTDISKLVIAYEPVWAIGTGKTATKEQAQEVHALIRAKVTELYGQKAADHLRIQYGGSVKPSNAAELFAMPDIDGGLIGGASLNADDFMAIVEAAG

SEQ ID NO: 22995 - protein, 416 aa, Acinetobacter sp. ADP1
MSFSRINGVLHAEQCSLDQLAQQFGTPLYVYSKAAFEKHYKDMDRAFDFIDHQICFAVKSNSNLAVLNVLAKLGSGFDIVTGGELARVLAAGGDPSKIVFSGLGKSEADIQKALEVGIACFNVESYAELDRIQKVAVRLDQKAPVSLRVNPDVDAKTHPYISTGLKENKFGIPSDTVFETYQYAASLSHLDVVGIDCHIGSQLTETKPFVDALDRVMVMIEQLNKLGINLKHIDIGGGLGVCYKDETPPSVAEYANALKPALEKLGLKVYMEPGRSISANAGVLLTRVDLLKPTNHRNFAIIDAAMNDLIRPSLYEAWMDIQSVNESTSAEAKEWDVVGAICETGDFLGKARTLAIQENDILAVLGAGAYGFVMSSNYNTRGRAAEVMVDDEKPHLIRERESIESLWERERLLPEE

SEQ ID NO: 22996 - protein, 165 aa, Mesorhizobium sp. SDW040
MFADGVMFDGLSIAGWKAINESDMVLMPDPDTVHMDPFFAQSTMVILCDILDPVSGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRV

SEQ ID NO: 22997 - protein, 165 aa, Mesorhizobium sp. SDW010
MFADGVMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRTKGGYFPVPPIDSAQDMRSEMLTVLAEMGVRV

SEQ ID NO: 22998 - protein, 129 aa, Burkholderia pseudomallei K96243
MNLIAKLEQEEIERALAGKTIPEFAPGDTVIVNVNVVEGNRKRVQAYEGVVIAKRNRGLNSSFIVRKISSGEGVERTFQTYSPLLASIVVKRRGDVRRAKLYYLRERSGKSARIKEKLVSKDRAAAAQQ

SEQ ID NO: 22999 - protein, 473 aa, Magnetococcus sp. MC-1
MANKEAVNKVLGMIDANNVRFVDFRFTDFKGKWQHITAPARMLTEDVFETGLGFDGSSITGWCEINNSDMAYVPDPESAVMDPFSEDATLILACNIIDPFTGEDYSRDPRSVAKRAEAYLAYTGIADTAYVGPEAEFFVFDSVRYNVGMNNVSYHIDSEEGAWNTGTEYEDGNTGHRPGIKGGYFPVPPVDSLQEMRNEMSNLMEEMGLTIEFHHHEVATAGQCEIDMRFGTMLHTADNIQKYKYVVHNVAHQYGKTATFMPKPMAGDNGSGMHCHMSIWKDGKPLFAGNQYADLSEMALHFIGGIKKHAKALNAFTNPSTNSYKRLIPGFEAPVLLAHSSRNRSASIRIPASNSPAGKRCEIRFPDPSANPYLAFAALLMAGMDGVENKIDPGPSMDKNLYDLPPEELKDIPTVCGSLREALEELSKDREFLLKGDVFSNDLIDAYIKMKMDEVYAVEHCPHPIEFQNYYSV

SEQ ID NO: 23000 - protein, 169 aa, Oryza sativa
MASSATTVAPFQGLKSTAGMPVARRSNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 23001 - protein, 215 aa, Zea mays
MSAQDPLSSTNPSSVTNNTQDASGRQPSSAAAGSSELSSAKISLRKSLRSFPDFPIPGINFVDIMPLFADPTAHATLVEALELQIAEAFPTKPDIIVGLDARGFLFGPGLALRLGVPFAAVRKQGKLPGPCVTAEYIKEYGKDLFQMQEDAVREGQKVLIVDDIIATGGSAKAAAELVQQLKGEVMGYLFILEIPGLNGRDKLGAPPTKILLEDA

SEQ ID NO: 23002 - protein, 853 aa, Mycoplasma mobile 163K
MKNFKNILVELKNKLNREQFNYLNEKNNFQEKIKENFKAKSKDLHFRNNFSLEPKSGLLNDPNGLVFFNDFYYIFFQNSPHINKHDLKVWSLYKTKDFLNYTYEGQKISPSIEKDADGIYSGGSIVENDELYLFYTGIEKKYFRKINIEKIKNFFSLADFILESNMHKTLKEIYLESLISKIIKFIENLEESNIFLAKRNTSENFDKTFLFKRDRNLYTRHFRDPLALKKDNNFYLLIGAQLKETLKGVISVYKSKKVDKDYRLIGNIKFKNFSIESYMLECPEFLRINNKDIIIFSTQGKSYFNFRKNNESIHNAIYLVGKMNWNTLEFDVEFQDFLDYGFDFYAPQVFKNVDENILIGWNGRPDISFHDENLGWSFNLSIPRKLYLKNNELIQEPIFQLENEVLNVESNKISKKQNGLYEIRFEKEKNFSEISIFNEKHNISIKLDWDNLFINVNRTNMEVNYGENIGTNWVRKMPKKYSKMNLIVDNSLIHFYFDEGKFHFTFYYFIKKSNIKFKNFSNITFRQIKSLKIKDKSKKVLLIGEALIDTYKQNFEISRQVGGAPLNVSLALSKKGVQNSFFGVIGKDEDASLILEYFKRNNLDTSLLKIDPKLKTTVANVSINDEGERNFTFVRGADENLNFEYDALINQYDLVCFSSATAFLGGKLYKSYIKALNLSLDANIDVVFDPNYRDSLYSKNIEDFKQKAKYFITKSNVVKMSLEELEIIYKLKWNSKNDTETLHKEMKKIIENDQQFFLITLGKDGTLFIDKNKIKIIPSIKVKQVDTTGAGDVFLGSFISKYINRNNKDSNSKDFHNEIFEIIKYANVNGALATTIIGVENALKTEEEINELI

SEQ ID NO: 23003 - protein, 458 aa, Ashbya gossypii ATCC 10895
MNISEAGRLLGHSRLRHIPGRRYNSMGKIRGNNYFAETTRDVWTIINEAAAKAAAESVANGGSGAGKGMKVLNLGQGFFSYSPPDFAIAGAQRALENAMNNQYAPTRGRPALVEALLKLYRPMYGDLAAENVQVTTGANEGIFACLAGLVNPGDEVIVFEPFFDQYIPNIELLGGVVRYVPIRPPAELSKRVTEGTEWVIDYDMLRQTINEKTKAVIINSPHNPIGKVFTREELLKLGNICVEKGIYIISDEVYEHLYFTDEFTRIATLSEEISQHTLTVGSAGKSFAATGWRIGWVISRNKELLALASKAHVRICFSSPAPLQEACAVAIEHALKTTYYADTRAAYQKKYERFQKPFDDLGLPYTRAEGSYFLLVDFSRLPLPADYHFPEELADKGRDFRVAYWLINELGLVAIPCSSFFIPDHREASENMLRFAICKDDTYLDEAIERLMVLKNYL

SEQ ID NO: 23004 - protein, 192 aa, Glycine max
ASTMASSSSESAVSERRGIPGAQFVEDVQTYLTQSGLDVGSALAFLQERLQQYKVVEMKLLAQQRDLQAKIPDIEKCLDVVATLKAKKGTGEELIADFEVSEGIYSRARIEETNSVCLWLGANVMLEYSLEEATGLLQKNLDNARASLEVLIADLQFLRDQVTITQVTIARVYNWDVHQRRVQHAVATTAQD

SEQ ID NO: 23005 - protein, 346 aa, Legionella pneumophila str. Lens
MKAFIYQGPGKKAIEERPTPIITNPTDAIIKVTKTTICGTDLHILKGDVVTCVPGRILGHEGIGVVDKVGQGVTEFQKGDLVLISCITSCSKCEYCRKGMYSHCAKGGWILGNTIDGTQAEYVRIPYADTSLYKIPEGIDEDVLVMLSDILPTGFECGVQNGKVQPGNTVAIVGAGPIGLSTLLTAQFYSPAEIIVIDLDDNRLEVAKRFGATATVNSSDGKAVDKIMQMTNGRGVDTAIEAVGIPATFVMCEDIVAPGGTIANIGVHGVKADLHLERLWSQNISITTRLVDTVTTPMLLKTVSAKKINPMLLISHRFKFAKILDAYETFAHAADTHALKVIINVS

SEQ ID NO: 23006 - protein, 589 aa, Neisseria meningitidis MC58
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAVSDGNGQLAGFNVLAGGGLSMEHGNTKTYPNISLELGFVPPEHALKAAEAVVTTQRDFGNRSDRKNARTRYTIQNMGLDNFRAEVERRMGMPFEPVRPFKFTGRGDRIGWVKGIDGNWHLTLFIESGRLVDEGGKQLLTGVLEIAKIHKGDFRITANQNLIVANVAEADKAKIEEFARTYGLIRNDVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILAELDDLIGKWAAERNIGEGFGDFAIRTGIVKPVLNAPVDFWDASKAVAIARA

SEQ ID NO: 23007 - protein, 193 aa, Zea mays
MSKRQGPPKHQNRYAWKPNLGQKINETEPGGRFRPLSEITGVCQRCRDQIDWKRRYGKYKPIVEPAKCQKCNKRNVRQAYHNVCRDCSKDLGICAKCCTCVNELVGRDANEEESERKSLEEAVRGARERERRTLLRIMNKGKGGESGPSVPKIADRSREGDIFPAASLDEYAEQTREQEEDDSDVEAGDFVED

SEQ ID NO: 23008 - protein, 638 aa, marine gamma proteobacterium HTCC2143
MCGIFAAMTRNGIASSCVDRALSSLNHRGPDGHGTWTSSDKRWILGHTRLSIIGLSNGEQPMTSPDGKVHTVVNGEFYDYREIRERLRHDGCQFASDSDSEIALHLYQRDGMQVAPQLRGEFAVIIADERENTMIAIRDRFGIKPLYYSVVNGDVFFASEIKALLALGVPAAWDLQGALGGMARPHEQTEFAGINAVPQGCYAVAKDGTVRIYSYWDWEIPTADDMKRDNRTEAEVIAEFRSVLMDAVQQRLVADVEVASYLSGGIDSCAVLGLAQQAMARPIRAFTLTFDNPLYDEAAIAEKQAKFVGASYHPIPVTGRDIADSYSDAIWHSETQMFNGHGVAKYLLSKAVRDAGIKVVFTGEGADEMLGGYPFFRVDAVKHNPALSEAQKSALFAEILGTNEASRAIMLPNEVNSPATDAVRRRLGWVPTVVHTMESMSNGLAPFFSNDYAAYIHGHSPIVAALDRLPIGQRMTGRDHLNQSLYLYSKTALPNFILSYLGDRMEMAHSVEGRVPFLDHRVAEAAARIPVDMKVKGIREKHVLREATRDVLIPEVYNRQKHPFTTPPTRDKNDPMLAFYRDTFASQAAKDQPIYDMQKVNKALDKLLDCPDDERIAVEGGLQRIASVVVMQKKFGMS

SEQ ID NO: 23009 - protein, 415 aa, Zea mays
MAATLDGAAGCRKRKRAAPGLADLHDDMLERVLARLPPASYFRLRGVSRRWRAAAESRSFRAACARVTARDPWFLMLEDSDHQDQDQDERRPRPAAVFDSAERALARWRGAPVPLQPVAAASGLVLYRDPSTGGLTVVNPLTGASRALPPPARVAGALQAVAMYGSPYRVVLILGELPELSTVAYDSSTNAWSEQAALSRKPEVEGAPSRERVAEVGDGDGDDTVYFLSKSGDVVASTMQRSASRQYSSAVACGGCGGGDAVAYFLSRSGTVVACDLARRAFAELPRILPAYHEHSIDVVACGGAAYAVVLSEFLDAASLRVWEFAGGAWRQVAAMPPAMAHGFRGAKADVNCVGHGGRLMVCVSSSSAGAGGCFLCDVGTNRWEELPRRAAGDGDATTGFVSALSFEPRIEAAV

SEQ ID NO: 23010 - protein, 284 aa, Oryza sativa (japonica cultivar-group)
MVVLAKGELEQIALPAAHPPPADVRAIDLSATGPARAAEARALVAACEEQGFFRVTGHGVPAGAVAFCVNRDRWFSLVCLFCSRCRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 23011 - protein, 1509 aa, Oryza sativa
MADPQHVQEEAAGAEAVHAHAARHDGAVVMEILSRSLQSMPASPDVSAYFSGASSRRPSAADEVDDEEALRWAALERLPSFDRLRTGLMRADADSSGVGVGAVGRGRRWYAHREVDVRTLELAQRQAFVERVFHVAEEDNERFLKKLRARIDRAGIQMPTVEVRFRNVNVQAECHVGTRALPTLANVSRDVGESLLGLVGLNFAKRKALHILKDVSGIVRPSRMTLLLGPPSSGKTTLLLALAGKLDPTLETSGEVTYNGYGLDEFVPQKTAAYISQHDVHAGEMTVKETLDFSAKCQGVGQRYELLKELAKKERQLGIYPDPEVDLFMKATSVEGSTLQTDYILRILGLDMCADVIVGDELRRGISGGQKKRLTTAEMLVGPTKVLFMDEISTGLDSSTTFQIIRCIQQIVHMGEATVLVSLLQPAPEIFELFDDVMLLSEGQIVYQGPREHVLEFFERCGFRCPERKGVADFLQEVTSKKDQEQYWIQSEKPYRYVSVPEFVAKFKKFHMGKSLKKQLSVPFNKGKIHKSALVFSKQSVSTLELLKTSCSKEWLLMKRNSFVYIFKTVQGILVALIASTVFLRTQLNTRDEDDGQIYIGALIFVMITNMFSGFADLSLTLARLPVFYKHRDFLFYRPWTFALPNVLVRIPSSLFESIIWVAITYYTMGFAPEASRFFKHLLVVFMLQQMAAGLFRVTAGLCRTVVVTNTAGSLAVLIMFVLGGFILPKDAIPKWWVWAYWCSPLTYAYIAFSSNEMHSPRWMDKFVPDGKRLGVAVLENSGVFTNKEWYWIATGALLGFTILFNVLFSLSLMYLNPVGKPQSILPEETDSQENIQEGKNKAHIKQIITVETPEPVSPNSIITLDKVIQQLRGYSANTSDRSHSYINAAGRTAPGRGMVLPFEPLYMSFNEINYYVDMPLEMKSQGVTADKLQLLSGISGAFRPGVLTALMGVSGAGKTTLMDVLSGRKTGGYIEGEIYISGYPKNQATFARISGYCEQNDIHSPQITVRESLLFSAFLRLPKEVNDQEKKIFVDEVMELVELTGLKDAIVGLPGVNGLSTEQRKRLTIAVELVANPSIIFMDEPTSGLDARAAAIVMRTVRNTVNTGRTVVCTIHQPSIDIFEAFDELLLLKRGGQVIYSGPLGTNSHKVVEYFEAIPGVPKIEENRNPATWMLDVSSAASEVRLEIDFAEYYRSSTMHQRTKALVKELSNPPPGSDDLYFPSQYSQSTFNQFKLCLWKQWWTYWRSPDYNLVRIFFALFTALMLGTIFWRVGHKMESSKDLLVIIGSMYAAVLFVGFENSVTVQPVVAVERTVFYRERAAGMYSAIPYALAQVVVEIPYVFVETVIYTLIVYPMMSFQWTPAKFFWFFYVSFFTFLYFTYYGMMNVSVSPNLQVASILGAAFYTLFNLFSGFFIPRPKIPKWWVWYYWLCPVAWTVYGLIVSQYGDVEDFITVPGQSDQQVRPFIKDYFGYDPDFMGVVAAVLAGFTVFFAFTYAYSIRTLNFQQR

SEQ ID NO: 23012 - protein, 434 aa, Dehalococcoides sp. BAV1
MEPRIQVFPKNTEVKNNHLIIGGVDVAGLCAKYGTPLYIFDELTIRQNCRDFKREFSRRYADSSVSYASKAFLHPALLKILAEEGMSLDVVSGGELSVANNAGFPMDMVYLHGNNKSAEELRLALRLHVGRIVVDSFDEIKLLSKLADESGHIPDILLRITPGVDAHTHHYITTGKLDSKFGFPLFQAAEAVGLAMAQASLNLVGFHFHIGSQIFETQPFLDAIDLVLDFAAQVQERYGFDIEELDIGGGYGVQYEVDKPAPPISAYAEAIGAKVVSKCRSLKLTPPSLNIEPGRAIIAQAGVALYTVGVIKDIPGIRLYASVDGGMGDNIRPALYEAKYEAVVANNVQSAEKEKVTIAGKFCESGDILIRDIELPSLRTGDILAVPCCGAYCLPMSSNYNGYHRPAVVMLKNGEDRLIRRRETVEDLSRLDSV

SEQ ID NO: 23013 - protein, 485 aa, Arabidopsis thaliana
MSSPRSNKPKIVNGPGGYILQDVPHLIDYLPDLPTYPNPLQDNPAYSVVKQYFVHADDSVPEKVVVHKDGPRGVHFRRAGPRQKVYFESDEVHACIVTCGGLCPGLNTVIREVVSSLSYMYGVKRILGIDGGYRGFYAKNTIPLNSKVVNDIHKRGGTIIGTSRGGHDTNKIVDSIQDRGINQVYIIGGDGTQRGASVIFEEIRRRRLKVAVVGIPKTIDNDIPVIDKSFGFDTAVEEAQRAINAAHVEAESNENGIGFVKLMGRYSGYIAMYATLASRDVDCCLIPESPFYLEGEGGLFEFIERRLKDHGHMVIVLAEGAGQDLMCKSMESTPMDASGNKLLKDVGLWLSQSIKDHFKKNKMVMNLKYIDPTYMIRAVPSNASDNVYCTLLAQSAVHGAMAGYTGYTSGLVNGRQTYIPFYRITETQNNVVITDRMWARLLSSTNQPSFLGPKDTSEEKKELPETPLLDDGAVDIPPVTKEVTK

SEQ ID NO: 23014 - protein, 513 aa, Glycine max
MLPRSRTLPSRIHQGIIEERHDVRPYVQVEVRPNNIQTETQAMNIQSNYSKCFDDDGRLKRTGTFWTATAHIITAVIGSGVLSLAWAVAQLGWVAGPVVMFLFAVVNLYTSNLLTQCYRTGDSVNGHRNYTYMEAVKSILGGKKVKLCGLIQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKTFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSVRKWPKSNFVTAEYDIPIPCFGVYQLNFFRLVWRTIFVLLTTLIAMLMPFFNDVVGILGAFGFWPLTVYFPIDMYISQKKIGRWTSRWIGLQLLSVSCLIISLLAAVGSMAGVVLDLKTYKPFKTSY

SEQ ID NO: 23015 - protein, 410 aa, Alkaliphilus metalliredigenes QYMF
MYFLEDKIAQRLGGKSFGKVSKEYKFRKIKKTKEEAIKKYPFISLIDLGVGEPDLAADERVVSILSKEAGKPENRWYADNGILEFQEAAVQYLNKVYGLKGLDPNENILHGIGTKSMLAMLPACFINPGDVVLTTIPGYPILSSNTQYFGGEIYPLPLHEENSFYPDFTAIPKSILNKAKLLYLNYPNNPTGQVATYDFYQEAVSIALQYGIVIVSDAAYGPITFDDHRPISLFSVPDASHVGIELHSLSKAFNMTGWRLAFALGSPEMIKAYSAIKDTTDSGQFRAIQKAGAFALQHIDIIEANCQRYSRRMDFLIEILQEVGFKATKPQGTFYCYVPIPKGTKSGIRFTNAEEVATHILEHALISTVPWDDVGSYLRLSVTFEAKDLESEKELLEELKRRLLSLELVF

SEQ ID NO: 23016 - protein, 400 aa, Dehalococcoides sp. BAV1
MKAVILAAGEGSRMRPLTFTRPKVMLPIAGKPILEHLLMEVSAAGIKEFVLVVGYRDEQVRSYFADGAKWGVKISYCQQTRQLGTAHALKQLENQLEGNFLVMNGDILAESADISALAAGSETTLSVLEVSDPSSLGVLETDGDRVRCIHEKSANPPTNLANAGLYLFTPRIFKAISGTPLSPRGEYEITSSIQLLIDNGTEVGYRRLVYWQDVSYPWDLLDVNASMLKNLAPCVYGTVEENVVIKGTVEIGEGSLVRSGAYIEGPVLIGKNCDIGPNCYIRPSTSIGDNCRVGASVEIKNSIIMDNTKIPHLNYVGDSVIGQNCNLGAGTKLANLRFDGADIIAGGVNTRRRKLGAVLGDGVETGINVSLNPGVLIGSGSRIGPGAVVSGLVEPNSYIG

SEQ ID NO: 23017 - protein, 393 aa, Triticum aestivum
MLLLQEHVLLLSLGPRATSALLSFRHRCLFSNTRFAAAAAVAASASPAPFAVADYLVASCHLTPAQAVKASKVLSRLKSPSKPEAVLAFLSDLGLSDADVAAVVVYDPLLLCSEVDKTLAPRLAELRDLGLSPSQIARLVLVDPARFRRPTIISKLQYYVPLFGSFENLLQALKYNSYLLSSDLENVVKPNVALLRECGLGDCDIAKLCIPVPRLLTSKPERIQAMVARAEDVGVPRGSAMFRHALLAVAFLSEEKIAAKVEFLKKTFRWSEAEVAIAVAKLPVVLRNSQERLLRMSEFLMSEVGLEPEYIAHRPAMLTYSLEARLKPRYYVVKFLKENGLLKPNRSFYTAAQVSEKVFMEKFIRPHKGAAPRLAEDYAATLKGEVPTRFRLQ

SEQ ID NO: 23018 - protein, 639 aa, Oryza sativa (indica cultivar-group)
MPSPPLDPHHVARPARANNRTNSKAFSFRKWHHGTQVLGSFITKLANYLPPSVPSYASTKMLYEALSQSPLTKCCIKERSLKRLAAILYGCGALIYTMYITPNLKKSKKFHPDVACTRNQHNSGRAYQDGVNEAVKRHGKRLEWIGRRRGGGGGGGGDGRIYHETGLADLAIAEQADLEAASLTSGALRSAAAPPSSLGSRDRTAPLAMRCGGVEETGVGVWGVGAATAARRRGIAVMGWTTKEREKAAASRGSWSVGRRRWRRGKWRRGLGGVGRRTEEAWIPLQAGQGGRRWQGAMATVVGGRAMRNGVWAEWAADAEKKEWGRRRSIRATTMCLKAESASQCPARYEENNVVDIEESSDNSQEAGRRGTRVNWTEEENIRLLSSWLNNSVDPINGNDKKAEYYWKAVAVEFNSNTSRSNRKRTVVQCKTHWGGVKKEIGKFCGAYSRARSTFSSGYSDDMIMEKAHIMFKSENNEKPFTLEYMWRELKDQPKWRRVLEEDSKNKRTKISESGAYTSSSNQDTEEENRRKKKRPEGQKKAKAKLKGRGKNVAPSPLGDQPCQDSVLYNEAIKVKAEAMLKSAEATSKSAEAKKEYTRMEKYQTYLKFLDKDTSNFSDAKLKRHEAVLEKLATELVEE

SEQ ID NO: 23019 - protein, 324 aa, Oryza sativa
MARDFTATFLLLLSVASLLVISPCAAQQIKTTDTRWSYHLPLPDGVSGAESLAFDGKDGLYTGVSDGRVLKWGGSAAGWTTFAYNANYRKIPLCSSSEVPPEERESICGRPLGIRLFRKTGELYIADAYKGLMKVGPDGGEAQVVATEADGVPFHFLNGLDVDQATGDAYFTDSSSTYTRRFNGEITMNADATGRLLKYDARTRRVTVLKTDLPYPNGVAVSRDRTHLVVAHTVPCQAFRYWLRGTKAGEYELFADLPGYPDNERMRLGAAPAAKHLVGVRLNPDGVEVEELTAAKGVTLSEVAEQKGKLWLGSVELDYIGMFA

SEQ ID NO: 23020 - protein, 549 aa, Mesorhizobium loti MAFF303099
MPAVTGEANGLRGVAASEGVAIGPAFAHFPPEIAAQGRVLQASEIVGEIDRFRAAVAAVQARMDRALAQDSLSAGDRGIVAALRDIAADDSLTGEAEKAIRGGNDAVSAVITAAATIAADFSAVDDHYLNARADDVHAVGRQICLVLLGQDDVSLESMPEGAILIADDIGAWDLARAPLKRIGGVICGHGGATSHIAIIARSHGIPAVLGLGDQVNALRTARDVALDGNTGHVIVDPDAATRADYGGRVEAAAKERAGLTTFKTVTPKRADGKVIEVAANIGSLEEIEAAQEAGAMGVGLFRTELLFMRHMHLPSEDMQAETYAALAKAFAPHPVIVRTLDIGGDKPIAGIEFPDEDNPFLGWRGIRMCLDRPDIFKRQLRALLRAAVQGNIKVMLPMVSDISEVTRTRALVDECAAELKAEGVPHATFDLGVMIETPAAVLIAPALAKEVAFFSIGTNDLTQYIMAADRLNPTVAKLNDVTNPAVMSAIELTAKAGVAAGIMVGMCGEAAGRPDLIPAFIEMGLTELSMSPASIQRAKKTITAMAAGE

SEQ ID NO: 23021 - protein, 340 aa, Mycobacterium sp. MCS
MTIRVGVNGFGRIGRNFFRALDAQKAEGKSTDIEIVAVNDLTDNATLAHLLKFDSILGRLPYEVSLEGDDTIVVGDTKIKALEVKEGPAALPWGDLGVDVVVESTGIFTKRDKAQGHLDAGAKKVIISAPASDEDITIVLGVNDDKYDGSQNIISNASCTTNCLGPLAKVLNDEFGIVKGLMTTVHAYTQDQNLQDGPHKDLRRARAAALNIVPTSTGAAKAIGLVLPELKGKLDGYALRVPIPTGSCTDLTAELAKPGTAEEINAAMKAAADGPLKGILKYYDAPIVSSDIVTDPHSSIFDSGLTKVIDNQAKVVSWYDNEWGYSNRLVDLVALVGKSL

SEQ ID NO: 23022 - protein, 537 aa, Brassica napus
MASRRVSSLLSRSLISSSSLFSLRGKDPLLNRGARRYSNLAASLEDTITPPVKVEHTQLLINGKFVDSASGKTFPTLDPRTGEVIAQVAEGDVEDVNRAVVAARKAFDEGPWPRMTAYERSKILFRFADLIEKHNDEIAALETWDNGKPYEQSAKIEVPMLARVFRYYAGWADKIHGMTVRGDGSHHVQTLHEPIGVAGQIIPWNFPLLMLSWKLGPALACGNTVVLKTAEQTPLSALLVGRLLHEAGLPEGVVNIVSGFGPTAGAAIASHMDIDKVAFTGSTGRPTRPLELASKSNLKAVSLELGGKSPFIVCEDADVDQAVEMAHFALFFNQGQCCCAGSRTFVHERVYDEFVEKAKARAINRAVGDPFKSGIEQGPQVDSEQFEKILKYIRHGVDSGATLQAGGDRHGSKGYYIQPTVFSDVKDDMLIAKDEIFGPVQTILKFKNLDEVIARANNSRYGLAAGVFTQNLDTANRLMRALRVGSVWINCFDVFDATIPFGGYKMSGIGREKGIYSLNNYLQVKAVVTSIKNPAWL

SEQ ID NO: 23023 - protein, 407 aa, Mycobacterium sp. MCS
MAVKTLEDLLNDGDREIAGRGVLVRSDLNVPLDDNGAITDPGRIIASVPTLEALAEAGAKVIVTAHLGRPKGGPDPKYSLKPVAAALSEKLGRHVQLAGDVVGTDALARAEGLTDGDVLLLENIRFDPRETSKDDGERRKLAEALVELVGDDGAFVSDGFGVVHRKQASVYDIATLLPHYAGTLVAAEVKVLEQLTSSTDRPYAVVLGGSKVSDKLAVIESLAKKADSLVIGGGMCFTFLASQGVSVGKSLVQPEMIDTCRELLDTYGDVIHLPVDIVVAPEFSADAEPETVAADRIPEDKMGLDIGPESVKRFTNLLSNARTVFWNGPMGVFEFPAFAAGTKGVAEAIIGATAKGAFSVVGGGDSAAAVRQLGLAEDGFSHISTGGGASLEYLEGKELPGIQVLES

SEQ ID NO: 23024 - protein, 887 aa, Brucella suis 1330
MAKWVYTFGDGKAEGAASDRNLLGGKGANLAEMSSLGLPVPPGFTITTEVCTYYYNNDRVYPSELDAQVQAALAHIATLTGRNFGDAEKPLLVSVRSGARASMPGMMDTVLNLGLNDETVQAIARESGDERFAYDSYRRFIQMYSDVVLGVDHGFFEEILEDTKADLGVEVDTALSADDWKNVIGLYKAKVEEELGQPFPQDPREQLWGAIGAVFSSWMNARAITYRRLHNIPAAWGTAVNVQAMVFGNMGETSATGVAFTRNPSTGENKLYGEFLVNAQGEDVVAGIRTPQNITEEACIAAGSDKPSLEKVMPEAFAEFLKVANRLEQHYRDMQDLEFTIERGKLWMLQTRSGKRTARAALKMAVEMAAEGLISEEEAVLRIDPAALDQLLHPTIDPRAERQVVGMGLPASPGAATGEIVFSSEEAEQAKAEGRNVILVRIETSPEDIHGMHAAEGILTTRGGMTSHAAVVARGMGKPCVSGAGSLRVDYRNGTMLAAGQTFRKGDVITIDGASGQVLKGSVAMLQPELSGDFGKLMEWADRARRMKVRANAETPADARTARSFGAEGIGLCRTEHMFFDGSRIVAMREMILSDTEEGRRLALAKLLPMQRSDFAELFEIMKGLPVTIRLLDPPLHEFLPHTDEEVDEVARSMGVDAAKLRDRADALHEFNPMLGHRGCRLAVSYPEIAEMQARAIFEAAVEAGKKTGEPVVPEVMVPLVGLKAELDFVKARIDAVAKEVMSEAGIKIDYMVGTMIELPRAALRAAEIAESAEFFSFGTNDLTQTTFGISRDDAAGFLTTYQNRGVIEQDPFVSLDVDGVGELVQIAAERGRKTREKIKLGICGEHGGDPASIAFCEKTGLDYVSCSPFRVPIARLAAAQAAVRKV

SEQ ID NO: 23025 - protein, 261 aa, Mycobacterium sp. MCS
MARKPLIAGNWKMNLNHFEAIALVQKIAFSLPDKYFDKVDVTVIPPFTDLRSVQTLVDGDKLRLSYGAQDVSQHDSGAYTGEISGAFLAKLGCSFAVVGHSERRTYHHEDDALVAAKAAAAFRHGITPIVCIGEHLKVREAGNHVEHNVEQLRGSLAGLTSEQIGQAVIAYEPVWAIGTGRVAGAADAQEVCKAIRDELGKLSSPQLAAGIRVLYGGSVNAKNVGEIVAQEDVDGALVGGASLDGEQFATLSAIAAGGPLP

SEQ ID NO: 23026 - protein, 296 aa, Neisseria meningitidis MC58
MFPVFHLSGESRRQMLQTALRFPHVFKARAEDSHKGTFGTLAVVGGSAGMSGAPVLAASAAMYLGCGKVWAGFNQDTLPFAVIAGFPEIMLDTADSLAKRQDINAWVVGCGLGTGRAAVGTLAGILTEHTDKPVVLDADALNILSTDAETRNLARGCKNLILTPHPAEAARLLGTTVAQVQADRTAAVRKIGAIFGATVVLKGHKTLVASPDTEIYVNESGNAGLATAGSGDVLGGIIGSLLAQGVPVFEAACAGAWLHGAAADVIKESAGIAAGLLAGEIAPAARWLRNRITKSM

SEQ ID NO: 23027 - protein, 393 aa, Arabidopsis thaliana
METSIACYSRGILPPSVSSQRSSTLVSPPSYSTSSSFKRLKSSSIFGDSLRLAPKSQLKATKAKSNGASTVTKCEIGQSLEEFLAQATPDKGLRTLLMCMGEALRTIAFKVRTASCGGTACVNSFGDEQLAVDMLADKLLFEALQYSHVCKYACSEEVPELQDMGGPVEGGFSVAFDPLDGSSIVDTNFTVGTIFGVWPGDKLTGITGGDQVAAAMGIYGPRTTYVLAVKGFPGTHEFLLLDEGKWQHVKETTEIAEGKMFSPGNLRATFDNSEYSKLIDYYVKEKYTLRYTGGMVPDVNQIIVKEKGIFTNVTSPTAKAKLRLLFEVAPLGLLIENAGGFSSDGHKSVLDKTIINLDDRTQVAYGSKNEIIRFEETLYGTSRLKNVPIGVTA

SEQ ID NO: 23028 - protein, 241 aa, Clostridium thermocellum ATCC 27405
MEIDTFREMVEKSGSIVFFGGAGVSTESGIPDFRSSTGIYGQKTRYSYPPEVMLSHSFFMEHTEEFFEFYKEKMIYKDAKPNAAHIALAKLEKHGKLKAVITQNIDGLHQAAGSENVIELHGSIHRNRCMKCNESYDLEYVLNSPGTVPLCKKCNGIVKPCVVLYEEPLDTDSIDRAVDYIEKADMLIVGGTSLAVYPAAGLIQYYRGDRLVLINKSPTPYDRRANLIIRDSIGAVLGSVV

SEQ ID NO: 23029 - protein, 513 aa, Yarrowia lipolytica CLIB122
MIIIETLIGAVVFVAVYVAFVKLDYYRRKAKFETSDMPVAYNGLLGWKGLRHMLTVFNNDIGPVGWREVFATYGKTLKYYAFPSNTILTYDPDNIKAMLATQFKDFSLGLRKEALAPSLGYGIFTLDGSSWSHSRALLRPQFSREQISRLESVETHVQEMMSCIDRNQGAYFDIQRLFFSLAMDTATDFLLGEAVGNLQEILHPEMPRTGTTFQVAFDRAQRLGSLRIICQEAFWVVGSLFWRRDFNNTNQHIHDYVDRYVDKALLARKEKSEIYTNPDKYIFLYELARETTNKITLRDQVLNILIAGRDTTASTLSWIFMELAKKPDIFHKLREAILNDFGTSCESISFESLKKCDYLRQVLNEGLRLHPVVPVNLRVAVRDTTLPRGGGPQGDKPIFVAKGQKINYAIFWTHRDKEYWGEDAEEFRPERWETTSGGALGKGWEFLPFNGGPRICLGQQFALTEMGYVITRLLQEYSDISIQPSDAAVKVRHSLTMCSAQGINISLTRAKEE

SEQ ID NO: 23030 - protein, 356 aa, Yarrowia lipolytica CLIB122
MSKPKPSEVRTLAFNVSDHYQILDMVGEGAYGIVCSALHTPSGQKVAIKKITPFGRSMFCLRTLREIKLLRHFSHENIIGILDVQKPASFESFNEVYLIQELMDTDLHRVIRTQELSDDHCQYFVYQTLRAIKALHSANVLHRDLKPSNLLLNASCDLKICDFGLARSAASTEDNFGFMTEYVATRWYRAPEIMLTFKEYTKAIDMWSIGCILAEMLGGRPLFPGRDYHSQLTMILDVLGTPTMEDYYSVKSRRAREYIRSLPFKKKLPFSQLFPKANPLAIDLLEKLLTFNPAKRITVEEALVHPYLEQYHDADDEPTAEPIPDEFFDFDRNKDELSVEQLKTLIYNEIMYWKRP

SEQ ID NO: 23031 - protein, 423 aa, Acinetobacter sp. ADP1
MSLSYEIENNGAWQTYLAQVDRVAPYLEADLIPYINTLKRPKRALIVDVPIVMDDGAIQHFEGYRVQHNLSRGPGKGGIRYHPDVELNEVMALSAWMTIKTAVLNLPYGGAKGGIRVDPKKLSARELERLTRRFTSEISPIIGPQNDIPAPDVGTNADIMGWMMDTYSSIKGHTVTGVVTGKPVHLGGSLGRVRATGRGVFVTGLEVAKKINLSIENSRVAVQGFGNVGSEAAYLFNKANAKVVCAQDHTGTIFNDDGLDVKSLQEHVAQTGGVAGFPDSSKIEDAEFWNVEMDILVPAALEGQITAERAQTLKAKLVLEGANGPTYPDADDVLGQRNIIVVPDVLCNAGGVTVSYFEWVQDMSSYFWTEDEINARLDKLMIQAVDDVWKKAQEKSCTMRTAAYILACERILKARKERGIFPG

SEQ ID NO: 23032 - protein, 367 aa, Rhodopirellula baltica SH 1
MPHNFMISTSRTFPSLRFCCFACISILCCASICMAHLPKSAAPDIEASEPHVRKNEQGGDGIGQRVDGERFGSVANVKKPPVLDTAFIENKLPSGTEYISDVVFKEVDGLELKLDLLLPEKRTDAHLPTAVWIHGGAWTRGNKARDFHRFDQLASRILQEGVALVSIEYRLSDQASFPEPVLDCTDALAFLSRNREKYGLDTDRTIVLGSSAGGHLASLIGTNLTSDHTRFISDPSQPMAKIRGVVDFYGPTDLVMLQSKRGEIDFQNDPSPEARFLGHSPLMRPDLARAASPVTYVSVNSPPFLIFHGDLDSRVPMMQSIYLDSMLRVNGVESRLVEVEGARHGDEKFDETIYNDIAIEFIRSLLQ

SEQ ID NO: 23033 - protein, 525 aa, Shewanella sp. MR-7
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAQSALFKDIEDAVNSDGKSLLDVWMSHGDKVSAIPEGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHIDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEIDGISRVVYDISGKPPATIEWE

SEQ ID NO: 23034 - protein, 130 aa, Ashbya gossypii ATCC 10895
MTRTSVLADALNAINNAEKTGKRQVLIRPSSKVIIKFLQVMQKHGYIGEFEYIDDHRSGKIVVQLTGRLNKCGVISPRFNVKINDVEKWTANLLPARQFGYVILTTSAGIMDHEEAHRKHVAGKILGFVY

SEQ ID NO: 23035 - protein, 373 aa, Mycoplasma mobile 163K
MKKDYYEILGLTKSASKDEIKKAYRTLAKTYHPDVNKETNAEEKFKEITEAYEILNDDVKREQYNQFGHAAFDPNAGGFGGQNPFTNAEGFSGFSDFSGFGSIFTDFFGGFGNSQRANPNRAQRGEDRHAVIKISFIDSVLGKEIVEPLEKFETCNTCNGSGAKSQSDIITCTQCSGMGEQIKITKTFLGQMQQNVICSKCNGIGKEIVEKCLICKGKTHTKTTKNITIKIPAGIQNGQTLRVENYGNAGLNGGSNGNLILSIKVSPHKHFVRKNNDIILRLPVSIKSVIGSEKVEVPTPYGFEIIKIDPNIKTGDELIIKNKGIITKYESGKMIVIFEIFIPKLTSFEKKEISTILEKNADKFYEKWIKEFE

SEQ ID NO: 23036 - protein, 697 aa, Mycobacterium sp. MCS
MTTVDDIATLTQPHHPDDWSELDSVAVDTVRVLAADAVQKVGNGHPGTAMSLAPLAYTLFQRTMRHDPSDVHWLGRDRFVLSCGHSSLTLYIQLYLGGFGLELEDIQALRTFKSKTPGHPEFRHTKGVEITTGPLGQGLASAVGMAMAARYERGLFDPDAAPGTSPFDHHIYVIASDGDIEEGVTSEASSLAGTQQLGNLIVFYDQNQISIEHDTNIALSENVADRYRAYGWHVQEVEGGENVVGIEEAIEAAKAVTDRPSFIAVRTIIGYPAPNKMNTGGVHGSALGDDEVAAVKEVLGFDPDKTFEVRDEVIEHTRKLVQRGREAHEKWQPEFDAWAEREPERKKLLDRLLAQELPDGWDADLTYWEPGSKAVATRAAFGQVLNDVAPKLPELWGGSADLAGSNNTTIKGVKSFGPPSISTDDFTADWYGRVLHFGIREHAMGSILSGIVLHGPTRAFGGTFLQFSDYMRPAVRLASLMDIDTIYIWTHDSIGLGEDGPTHQPIEHLAALRAIPNLSVVRPGDPNETAYAWRSILARGNGSGPVGFILTRQGIPVLEGTDSDGVARGGYVLGGGNPSDDADVIIIATGSELQLAVEAKKLLAEKDLTAYVVSMPCVEWFESQPKEYRDSVLPPNVSARVAVEAAVAQSWYKLVGDTGEIVSIEHYGESADDKTLFREFGFTAEAVAAAAERTINN

SEQ ID NO: 23037 - protein, 454 aa, Mesorhizobium loti MAFF303099
MPTEVILPKVDMDMATGQISRWFAEEGARVKKGDVLFEIETDKAAMEIDAPASGVLRDVSGKEGVDIPVGAPVAWIYADDEAYGAKQDAAPISPLVGEMSAKSTEGDVVPPTSHSVMPPSALPGISPTRGEIGQSPPGERATPLARRLAREAGLALAGIIGTGPHGRVVKADVDAAIAGGGAKAAPAAKAPAGAPAAAPAPAVKPMSDDQVLKLFEQGSYELVPHDNMRKTIARRLVEAKSTIPHFYLTLDCELDALLALRTQINAAAPMKKTEKGDVPAYKLSVNDMVIKAMAMALKAVPDANASWTETAMVKHKHADVGVAVSIPGGLITPIIRHADEKTLSTISNEMKDLASRARSRKLKPEEYQGGTTAVSNLGMFGIKDFAAVINPPHATILAVGAGEERAVVKNGEIKIATVMSVTLSTDHRAVDGALGAELLVAFKRLIENPMGMLV

SEQ ID NO: 23038 - protein, 501 aa, Oryza sativa (japonica cultivar-group)
MVESFHGLVVVDLRTAAPLLATAVALYILIEQLSYHRKKGSMPGPPLVVVPFLGSVTHLFRDPVGFWDLQATRASKSGAGLTADFLFGRLMVFIRDSELSRRVFANVRADAFHLVGHPFGKKLFGDHNLIYMVGKEHKDLRRRIAPNFTPRALSTYAVIQQRVILSHLRRWIDRSVANGGKAEPIRVPCRDMNLETSQTVFVGPYLTVETRERFDRDYNLFNHGFITLPIDLPGSAFRRARLAVPRLKHILEDCARQSKQRMRGGGEPECLVDYLMQETVREIDEAAAAGLPPPPHTSDMETGNLLFDFLFAAQDASTSSLCWAVSALDSHPDVLARVRAEVAALWSPESGEPITAEMMTEMKYTQAARVVPHIAGEAFQLTEQYTIPKGTIVFPSVYESSFQGFPDAGTFDPERFFSEARREDVVYKRNFLAFGAGPHQCVGQRYALNHLVIFMALLASLIDFRRERTEGCDVPVYMPTIVPRDGCVVHLKQRCAKLPSF

SEQ ID NO: 23039 - protein, 325 aa, Mycobacterium smegmatis str. MC2 155
MTNSPTPQLDVLALGRCGVDVYPLQIGVGLEEVESFGKFLGGSAANVTVAAARLGNSAGLISGVGDDPFGRYVRNELARLGVDNRFVATYGEYPTPVTFCEIFPPDNFPLYFYRKPSAPDLQIRAEQIDADAVRDARLYWSTVTGLCEEPSRSAHFAAWEARQRAPLTVLDLDYRPMFWESPAAATEVVQRALQHVTIAVGNREECEIAVGETNPHRAAEALLDLGVELAIVKQGPRGVLGKTRHSSVTVPPNEVDVVNGLGAGDAFGGSLIHGLLHDWPLEKTLRYANAAGAIVASRLECSTAMPTAAEVAALAEQTASEAVNV

SEQ ID NO: 23040 - protein, 648 aa, Candida albicans SC5314
MSKTTEIFCRLPKSVELIQDFKDITPSPKANAECRAALYSKNGDFFAYTQPQEVVILDTTGEAKVYHRIEIPEVFDIYFSPEGTYLCLWCKPIQLNKENGTWNNNLKIFNIKTKTIIAEWSAKHQNAWKPQFTSEENLFARSINQKEIHFFELDPTSDSTVNINQPSFKYKVNDPKATLQAFQISPGRNPSVAIFIPEKSGKPANVSIYNIPNFNQPICFKNFFKAEKCQLKWNSLGTALLALASTDHDTTNKSYYGETNLYLLGIAGSYDSRIDLKREGPIHDITWSPTAREFAVSYGYMPSETTFFDSRGNAIHSLPTAPRNTILYSPHAKFVLVAGFGNLQGTVDVYDRQNKFSKVVTFEASNTSVCEWSPCGRFILTATTSPRLRVDNGCKIWHASGKLIYLKEFPELFSIGWKPQPLDCFPPIRNLEPAPEAHESTKEYLEKRQALASAAAKKPAGAYRPPHARGGGAGSGSGVASSLYQKELQNNLRSNGSTPSPPPGLSRAAGNIPRVRTVVGAPPPVEKESKAAAKNRKKREAKKQAQEKNNSPAPEATTSASPVPAQAQAPISTPAPPAPTPATATAGVIGGVASLEEKKIRSLLKKLRAIEQLKMKQASGETLEDTQVIKISKEDEIRSELQTLGWNE

SEQ ID NO: 23041 - protein, 416 aa, Mycobacterium smegmatis str. MC2 155
MTQREFDLVLYGATGFAGKLTAQYLAGAAGDARIALAGRSAEKLQAARDSIGGAAADWPLVIADADNPSTLADMAARTRVVVTTVGPYTRYGLPLVAACAAAGTDYADLTGETMFIRDSIDRYHQQAVDTGARIVHSCGFDSVPSDLTVFALHRRATADGAGELVDTDLVLRSFAGGVSGGTAASMIEVLRTSSTDPAARAAMTDPYTLSPDRSREPELGDQPDVRWRRGSEIAPELAGYWTGAFAMAGPNTRIVRRSNALLDYAYGRRFAYAEQMSCGRSPAAPIAAALVTASNAATMGLGGRFFDKIPSGLLERVLPKPGTGPSEQTRERGHYRVETYTTTTSGARYVATMAQQGDPGYKATAVLLGECGLALATDRDKLSGLHGVLTPAAAMGDALLTRLPAAGVVLETTKLD

SEQ ID NO: 23042 - protein, 191 aa, Glycine max
FGSSSLSLSLFFTPIHKSPKAPLLLRERIQKDNIKINHTKMLLGKRPRPPMKRTTSMSEMTLDLNTAAAADAAANQQRSGVGPGAAADQTTRMLATPKILRRHSSDFGDTPPFLRACSLCKRCLVPGHDIYMYRGDNAFCSLECRQQQMNQDERKEKFVMASKKKVVATPPSGSQVAVATATKGETTVVAL

SEQ ID NO: 23043 - protein, 735 aa, Arabidopsis thaliana
MAGNNSESSLYQVLVEWCQRMETSQARLREDVDDLLLQEESRTGKESATGLETDTEKEAEVEVEAEAADSWDNPTATWERAVSGFYFADSAYRTLMDSMGHAIHVTSAASGEITFWSRSAENLYHWYAEEVVGYRTIDVLVTEEYRNSLTGIRNRVCRGETWTGQFPFQKKTGELFMALVTKSPVYENGELVGVVTVSSDATLFNRMHPLSNEHQQQARSNNRHESNLRKHQWHLPRPQIAAASQVPVVPQYSSAVASNLASKLLPQRNGDDSFNGNHNSRSRDENVPVVASTTFEKYGSLADKFLGKLQRKITGSQGTEDNEPILRNGINKSACGSGGSSKASNAVTCTAFRDNGNGKPKRAEVRISDVYGNGAEGLIHNGDRFQYIGNLGQSKPPRGLESGLVSGMRGTKMSDLNGEIEDAWNTRLSVDPLPILGVNSGRQQSPVNQRNNRLVTDSSCEIRWEDLQLGEEVGRGSFAAVHRGVWNGSDVAIKVYFDGDYNAMTLTECKKEINIMKKLRHPNVLLFMGAVCTEEKSAIIMEYMPRGSLFKILHNTNQPLDKKRRLRMALDVARGMNYLHRRNPPIVHRDLKSSNLLVDKNWNVKVGDFGLSKWKNATFLSTKSGKGTPQWMAPEVLRSEPSNEKCDVFSFGVILWELMTTLVPWDRLNSIQVVGVVGFMDRRLDLPEGLNPRIASIIQDCWQTDPAKRPSFEELISQMMSLFRKPGSGAQEEDD

SEQ ID NO: 23044 - protein, 333 aa, Candida albicans SC5314
MRLKLKSTNGVSTITLDDSKKLFKDFLIDIQQDTQLHQDTSESVSTIKLGFPPKPIDLSYGLETTLSDKNIKDGDQLLIEFTSFKRKSVSEPPLSPQPSEKKPNLRDDIPSTFIESLNKYLILRNIPDDNSCLFNSISYAISGYDSFKNISPPEELRKVVVNYIEKDPELYSDLILGRPREEYCRWIIKKDSWGGAIELGILADWFNVRIVCIDIESGNFIRFENEKDHPEKFIILVYSGIHYDVLATNDELSTENKDTDVAQWSTGDVQQEEDILAASQKLCKLLQSKDYATNTTTFRVRCLDCYSVLVGEMGASKHAEETGHLNFGEVKKS

SEQ ID NO: 23045 - protein, 1018 aa, Mycobacterium bovis AF2122/97
MSFLLVEPDLVTAAAANLAGIRSALSEAAAAASTPTTALASAGADEVSAAVSRLFGAYGQQFQALNARAATFHAEFVSLLNGGAAAYTGAEAASVSSMQALLDAVNAPTQTLLGRPLIGNGADGVAGTGSNAGGNGGPGGILYGNGGNGGAGGPDGGAGGNGGAAGLIGNGGAGGAGGVGGAGGAGGAGGTGGLLYGNGGAGGNGGSAAAAGGAGGNALLFGNGGNGGSGASGGAAGHAGTIFGNGGNAGAGSGLAGADGGLFGNGGDGGSSTSKAGGAGGNALFGNGGDGGSSTVAAGGAGGNTLVGNGGAGGAGGTSGLTGSGVAGGAGGSVGLWGSGGAGGDGGAATSLLGVGMNAGAGGAGGNAGLLYGNGGAGGAGGNGGDTTVPLFDSGVGGAGGAGGNASLFGNGGTGGVGGKGGTSSDLASATSGAGGAGGAGGVGGLLYGNGGNGGAGGIGGAAINILANAGAGGAGGAAGSSFIGNGGNGGAGGAGGAAALFSSGVGGAGGSGGTALLLGSGGAGGNGGTGGANSGSLFASPGGTGGAGGHGGAGGLIWGNGGAGGNGGNGGTTADGALEGGTGGIGGTGGSAIAFGNGGQGGAGGTGGDHSGGNGIGGKGGASGNGGNAGQVFGDGGTGGTGGAGGAGSGTKAGGTGSDGGHGGNATLIGNGGDGGAGGAGGAGSPAGAPGNGGTGGTGGVLFGQSGSSGPPGAAALAFPSLSSSVPILGPYEDLIANTVANLASIGNTWLADPAPFLQQYLANQFGYGQLTLTALTDATRDFAIGLAGIPPSLQSALQALAAGDVSGAVTDVLGAVVKVFVSGVDASDLSNILLLGPVGDLFPILSIPGAMSQNFTNVVMTVTDTTIAFSIDTTNLTGVMTFGLPLAMTLNAVGSPITTAIAFAESTTAFVSAVQAGNLQAAAAALVGAPANVANGFLNGEARLPLALPTSATGGIPVTVEVPVGGILAPLQPFQATAVIPVIGPVTVTLEGTPAGGIVPALVNYAPTQLAQAIAP

SEQ ID NO: 23046 - protein, 145 aa, Brassica napus
QRQWQVAGSTSFSNSNSNKILVSEKKSWKNFFSYLIGPGFLVSIAYIDPGNFETDLQSGAQYKYELLWIILVASYAALVIQSLAANLGVVTGKHLAEHCRAEYSKVPNFMLWVVAEIAVVACDIPEVIGTAFALNMLFNIPVWIG

SEQ ID NO: 23047 - protein, 261 aa, Cucumis sativus
MAISKTLSFGFLLLVSLGLASAARSLLSYDIPPHRSGYDNYDHPVVNPKVGYEHDRRDGYYHDRDHHDAPYGGGAGGGYGAGAGAGSSLGGSGYGSGGGGGSGYGGVGNHEVGYGSGGGGGYGAGVGSDLGGSGYGSGGGGGTGGGYGDLGGRGKGYGSGGGGGSGYGGRGDHGVGYGSGGGGGYGSGVGGGAGVVDHGVGYGSGGGGGAGSGYGGSKGYGGGSGGGGGAGYGGGAHGSGYGSGGGAGSGEEGGYDGGYAP

SEQ ID NO: 23048 - protein, 414 aa, Dehalococcoides sp. BAV1
MVAEVMAASGIKTYFGSCPTPTPVISHGVVNLKAAGAVIITASHNPAIWNGFKVKSADGASAPTYMITAIETEIAKLGDNPSVSRLDFDTAVSRGLIELTDLAPAYFEQISKLVDIEKLREAGFNIAIDSMYGAGIGYFKHLLEGGCNRLNEINAEPNPNFPDMLQPEPIAPNLNKLMRLVKDIRSDIGLATDGDSDRLGVVDEMGNFLNQLQVFSLLALYILEVKGLRGPLVKTITNSSMIDKLGKLYNVPVFETKVGFKYVSPVMIEQNALIGGEESGGYGFAGHVPERDAILAGAYFLDFMITTGKSPAKMLEYLYSKVGPHYYNRVDYTFDEARREEIMNHLANQKPDSLAETKVSSTDRLDGFRYKLEDGSWLLIRFSGTEPLLRIYAESPSQDKTAALLENGRRLSGI

SEQ ID NO: 23049 - protein, 332 aa, Mesorhizobium loti MAFF303099
MDATVRELSYAQAIQEAMAIAMDMDERVFLMGEDIGVYGGAFQVTGDLVERYGTERVIDTPISELGGAGVAVGAALTGMRPIFEFQFSDFATLAMEQIVNQAAKMRFMLGGEVSVPVVMRFPAGSGTGAAAQHSQSLEAWLGHVPGLKVIQPATPYDAKGMLLAAVADPDPVMIFEHKLLYKMKGPVPEGYYTVPIGKADIRREGRDLTIVATSIMVQKALDAAATLEAEGIDVEVVDLRTIRPMDKQTVIDSVKKTSRLMCVYEAVKTLGIGAEVSAMIAESEAFDYLDAPIVRLGGAETPIPYNPELEKATVPQVPDIISAARDLVKGVR

SEQ ID NO: 23050 - protein, 253 aa, Thlaspi caerulescens
MTGSTPENQAVRSPPPATKHLPESGPPPAKPKRNKYAFACAILASMTSILLGYDIGVMSGAMIYIKRDLKCTDLQIGILAGSLNIYSLVGSCAAGRTSDWIGRRYTIVLAGAIFFAGALLMGFSPNYAFLMFGRFVAGVGVGYALMIAPVYTAEVAPASSRGFLTSFPEVFINAGIMLGYVSNLAFSKFPLKVGWRLMLGIGAVPSVLLAIVVLVMPESPRWLVMQGRLGDAKRVLDKTSDSPTEAALRLEDI

SEQ ID NO: 23051 - protein, 723 aa, delta proteobacterium MLMS-1
MMKNGIDDIIRQVQEYLPEEDPTPLRRAYQLAVKVHSHGRHRYSGLPYLRHVLAVTNILVGMRLDLATVTAGLLHGALKQKEEPLSQAKLAEQFGVDVAAIVAGATRITAVQFNSHLAYQAENIRKMLLAMAADIRVLLLRLADRLHDMQTLHLEDRELAVEIAQETMDLYAPLASRLGIDWIKRELEDLAFAQLQPGAYQQLTAKIQTSLPDREAYVERIKELLSHHLRQNGLTNFRILGRPKHLYSIHKKLLVQNITLDKVYDKVAFRIIVGDIKECYTALGIIHSLWAPIDGRFKDFISHPKANGYRSVHTSVIGPDGDFMEIQIRTEEMDRIASEGIAAHWAYKEGQDASSRDVKLFKWLKQLVAMLQDLEDPKELLDTVKGELYEDDIYVLTPAGEVKGLPQGSSPLDFAYCIHTDVGHHCTGAKVNGQITPLRTPLKNGDVVEIITSPQQKPNRNWLNIVKTNRARNRIRQWLNQEERQRNLERGREICERELRKHQISFKKLVRTGHLKEVLKSLSCNSLDELLHKVGAGKLSIAAIVRQLQPEELRREEEEAEQERRRQAERQAARPRGGTGDGLVRVEGGTDIPTKIANCCLPVPGDEIIGFITTGRGITVHKSNCPNLLAGEAARRIGVSWTSQAKAPYRASIQATGVNRKGLLAALSNTITSDDANIASLEASSGKNGARFKIVLEVNGIDHLQRILQHIRQIDGINEAHRL

SEQ ID NO: 23052 - protein, 301 aa, Glycine max
MALLRLVCLTSTNQLSTQSTSFSFLRKTPHSQSIHIDPSSFHFPRLSLITTTLTHAQQQTQQADPVVAEEEFSRTRLLAQNVPWTSTPEDIRSLFEKHGKVLQVELSMYKKNRNRGLAFVEMGSPEEALEALNNLESYEFEGRVIKVNYARPKKEKTPPPVKPKVVTFNLFVANLSYEASAKDLKEFFDSGTGKVVSAEVVYRDNPRRPSGYGFVSYKSKKEAEAALAEFQGKIFMGRPIRVDRGRRFVQQPGDGSAKSEDTPSDLSVNGAEAQQPAEGSAKSEDTPSELSVNGEEADKVD

SEQ ID NO: 23053 - protein, 212 aa, Streptococcus thermophilus LMG 18311
MVEAIIFDMDGVLFDTEKYYYDRRASFLGQKGISIDHLPPSFFIGGNTKQVWENILRDEYDKWDVSTLQEEYNTYKQNNPLPYKELIFPDVLKVLNEVKSQGLNIGLASSSVKADIFRALEENRLQAFFDIVLSGEEFKESKPNPEIYLTALKQLNVQASRALIIEDSEKGIAAGVAADVEVWAIRDNLFGMDQSAAKGLLDSLTDVLDLIK

SEQ ID NO: 23054 - protein, 311 aa, uncultured archaeon
MPLDPQIKPILERIRALSIAASPQELRRQVEEQSRLLTAAVQEPIAETRDVHIPVSGGSIRARVYFPKKAAGLPAVLYYHGGGFVFGSIETHDHICRRLSRLSDSVVVSVDYRLAPEYKFPTAVEDAYAALKWVADRADELGVDPDRIAVAGDSAGGNLAAVVSILDRNSGEKLVKKQVLIYPVVNMTGVPTASLVEFGVAETTSLPIELMVWFGRQYLKRPEEAYDFKASPLLADLGGLPPALVVTAEYDPLRDEGELYAYKMKASGSRAVAVRFAGMVHGFVSFYPFVDAGREALDLAAASIRSGLQPS

SEQ ID NO: 23055 - protein, 244 aa, Streptococcus thermophilus LMG 18311
MELKNKNVFVTGSTRGIGLAVAHQFASLGANIVLNGRSEISEDLLAQFVDYGVTVVGISGDISNGEDAKRMVAEAIEKLGSVDVLVNNAGITNDKLMLKMTEEDFERVLKINLTGAFNMTQAVLKPMSKARQGAIINMSSVVGLMGNVGQANYSASKAGLIGFTKSVAREVAARGVRVNAIAPGFIESDMTDAIPEKMKDAMIAQVPMKRIGQAKEVAEVAAFLAGQEYLTGQTIAIDGGMTMQ

SEQ ID NO: 23056 - protein, 494 aa, Burkholderia sp. 383
MKSESEHPGLAAALAWCRSGAKQHFIDGKWVPAASGRTMETLNPATADVLAHIAEGDKADVDLAVAAARRAFESSGWRGMSPHARTAVLLRLADAIEQHADELAALETLDNGMPAWFSAAVVKMTVDTFRYYAGWPTKILGTTVPTDPSAFIYTLREPIGVCGQINPWNVPLLLAGVKFGPALACGNTIVAKPSELASLTCLRLVEIFHEAGLPPGVMNVVTGYGQTVGAAISEHPGIDKVAFTGSTAIGKQILLASAGNLKRVTLELGGKSPHIVFPDADLDKALAAAVNGFTRNSGQICSSGTRLFVHRSIHDEFANEVAKLAARLKVGNPFDADTKLGPLISSKQRDRVMSYVAAGNDEGATLLTGGRQACDAGYYVEPTVFSGVSNAMRIAQEEIFGPVVCVIPFDTEEDVIAQGNDSTYGLAGGIWTRDIGRAHRIAAALKGGRIWINTFGETDPVMPFGGYKQSGLGREFGAESIQTYTEAKSVMLRY

SEQ ID NO: 23057 - protein, 117 aa, Zea mays
MASSFAVATVPSLAAPAAKKRSGGVTYVEGMNAYSGLKGLNKVNMLGVRKTADYSFAKVVASLSPAGRKRRGGAFGAQMNDAAEIFRIAATMNGLVLVGVAVGFVLLRVEAAVEESE

SEQ ID NO: 23058 - protein, 303 aa, Deinococcus radiodurans R1
MTSLPLIVSAGEALTDLVTAGGNTWHAHPGGAGWNVARACARLGVPSAFAGAVGQDNFGDDLHRESLEAGLDPRFLQRVPAPTLMAVVYSTRPPQYRFLGENSADLHFDPTRLPGGWLGAARWLHVGGISLARWPLADTLLGVIEAARAAGVRISFDPNARIAHRHPDYPAVFAAVTKRADLLKFSDEDLAFFFPGASEAQALQELRGLNPRCPIVVTRGAAGASLYHSAGRVDLPTVPVEVADTVGAGDSLCAGLLVSATERPDALWTEHLRFGLGAASVTCAHAGAYAPTREEVAALSSGK

SEQ ID NO: 23059 - protein, 259 aa, Deinococcus radiodurans R1
MAPVWAGRRSPSPFTQGLPKSGPRRQGVRYAGMRLAPQTPLLPAVEDLRALLLDLDGTLADSNGAHARAWVEALADEQITREESEVRPLIGMGGDQLVPALTGESDKSDLGKALVQGWQDHFGPLIPDIAMIGGARDLLEWAHDQGLKVVLASSGEDEIVDALLEQIGVSDLVPVRVRSDEVQQTKPEPDVLQAALAKAGVSAEQALFVGDTTYDARAARAAGVACVVLRAGGSPGLSTESHVLSDPAELLAELKKATS

SEQ ID NO: 23060 - protein, 552 aa, Oryza sativa (japonica cultivar-group)
MAAAAARGAAAARSPLVLHRHPHPAHHRRLRLLPLVAGGGGGSPRVWGGGSGPAGRRGGGSGLGFSRDRAGELPKLVEDLLQTSISTGPRGAFRFAQGIQAVLGVGGEWLNDFSKTANTSAGIPAQMQLGLLSPLYLRRLFERMGATYIKLGQFVASAPTLFPAEYVEEFQNCFDRAPPVPYSEIESILREELQQPLDSVYEYIDPVPIASASIAQVHGARLKSSQKDVVIKVLKPGIEDTLVADLNFIYVVARILEFLNPELQRTSLVGIVKDIKESMLEEVDFRKEAMNIEAFQRYIDAMGFDRQAKAPFVYRHCSTKRVLTMERLYGVPLTDLDSIRSLVPDPELTLVTALNVWFGSLISCESFHADVHAGNLWLLRDGRVGFLDFGIVGRISPRTWAAMEVFLASFATDDYNAMASALSEMGATGNDINVNEFAKDLEKIFSSIQDLDTEVIVATARTPDATAVSANVVVDERQMNALFLDLVRVSESYGLKFPREFALLMKQLLYFDRYTRLLAPSMNMLRDERINIGMNRSAAAKENLDEYNWTFS

SEQ ID NO: 23061 - protein, 476 aa, Haemophilus ducreyi 35000HP
MSVNRVLDLIKENDIKFVMLKFTDIKGKEHGVSLPVSLVVDDLEALFEEGKMFDGSSVEGWKAINKADMLLMPISETAVVDPFAQIPTMTIRCSIYEPNTMQPYDRDPRSIATRAENFLKSTGIADSVMFGPEPEFFLFDDVRYATEANNVSYKIDDIEAMWNTNRKYEDGNNAYRPLKKGGYCAVAPLDSAHDIRSEMCLIMEQMGLIIEAHHHEVATAGQNEIATKFNSLTLKADETQIYKYVVQNVAIAHAKTACFMPKPFAGDNGSGMHCNMSLSKAGKNIFMGDKYAGLSETALYYIGGIIKHAKALNAFTNPTTNSYKRLVPGFEAPVLLAYSASNRSASIRIPAVTTPKATRIEARFPDPMANPYLCFAALLMAGLDGIINKIHPGDAMDKNLYDLPPEELQDIPAVASSLAEALDALSTDFTFLTQGNVFSKAFIDAYIAIRRKEVERLNMTPHPVEFEMYYAYSGLK

SEQ ID NO: 23062 - protein, 251 aa, Blastopirellula marina DSM 3645
MKAVITGGSDGIGFAIASAFVAEGAQVWLVARNAEKLATAADSLQSAGTKVMSTVADLSDPGAAEQVGVEVAATWDRVDVLVNNAGMARFTSFSEATPDEIQAQVQLNLLSPYLLTQQLLPLLAAAQGNVINISSTSAHRLIPGRPASVYAMTKGGLNSLTKALALELGPQGVRVNAIAPGTIKTPLTQKMIASFTEERKKEYDQFVRQAFALGRLGEPEEVAHLAVYLASVEAKWTTGSIFIVDGGLSTN

SEQ ID NO: 23063 - protein, 218 aa, Deinococcus radiodurans R1
MTDLSELNFDPSGLIPVVTQDARSGAVLMQAYADRAAVERTLDTREATYYSRSRGEQWVKGQTSGHTQRVVSVHVDCDGDSLLYRVEQTGPACHTGEYSCFYRPLLEDDAPDTGLDGTLERVYATITERLATLPEGSYVARLHAGGLDRVLKKISEEAGEVLLAAKNADRAELATETADLLFHTLFALAEVGVSPADVAAVLQGREGKSGLKGPKEVG

SEQ ID NO: 23064 - protein, 684 aa, Ashbya gossypii ATCC 10895
MSRSSSPSVSLPLPSSATLFLDREDKTEEALGTFIELEQCTYTHKRLGDSRSNEFMECDCFEDYKDEQNHACDENSDCINRLTLIECVNDLCTSCGDDCQNQRFQKKEYADIAVFQTEKKGYGVRAERDIEANEFIYEYIGEVISEADFRDRMVDYDMRGFKHFYFMMLQAGEFIDATERGCLARFCNHSCNPNAYVSKWDVAGKLKMGIFAHRKILKGEEITFDYNVDRYGATAQPCYCDEPNCIGFLGGKTQTDAASLLPQNYADALGVRPSVEKKWVKMRKALGEEIDKSGSSNINIEFVESLELEPCVQYSDVNKVMSVLLQIDDKFICSKLLERILLTSDETMRYQIIKLHGYKCFSKLLGLFETDENTQHRILQYLSDLPKTTKNGIVSSQIDKKVESLLQKEALKEDASALLERWNTYETYQRIAKKDFTKTSNGLNKVTDFRRVRLPLGWEIIHENGRPMYYNAQRQIKRVDPPSDTHLQRPARTTPPQRYNGGFYDRTTKRPLDPESFEKRKRQRLEWEQQKLAKKKQEEVRHLKEKLEVEKQKKSELEQIIEDANKQQEQQRLERLQKEKETAERRERRRQTHSASRIEHKWNKFFAQIVPNLIKSYATSMDRARIKECARDIVKILSSKELKKDATKVPPAEVTKEKRKKVNEFCKSYMDKLLAKMHEKAVSK

SEQ ID NO: 23065 - protein, 94 aa, Oryza sativa
MAAAANGGGAALFSEEELRDVSGVRRCEDFVEVTCGCTSHRYGDAVGRLRVYASGDLEVSCECTPGCREGPCSPLCIISTPRPFCLLACLSRCS

SEQ ID NO: 23066 - protein, 254 aa, Legionella pneumophila str. Lens
MFNQNLAIIIGGSSGMGLETAKKLSSNNMELLITGKDKQKLENAAAEIQKLGAKVDILVLDLYDKEQVFQFMSSMNDETRRVKYLVNAAGYFKPITFLEHEEEDYDRQVNLNKAFFFITQAVVKNMKKNGGGSIVNIGSMWANQAVKATPSSAYSMQKAGLHSLTQHLAMELAEHNIRVNAVAPAVVATPIYKSFIDEERIEESLKDFNKFHPIGRIGKATDIADAIEFLLSEKASWITGEIMNVDGGVMAGRN

SEQ ID NO: 23067 - protein, 186 aa, Photobacterium damselae subsp. piscicida
MKSRAAVAFGPGKPLEIVEIDVAPPQKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTALLQS

SEQ ID NO: 23068 - protein, 226 aa, Triticum aestivum
  misc_feature (24)..(24): Xaa can be any naturally occurring amino acid
  misc_feature (138)..(138): Xaa can be any naturally occurring amino acid
  misc_feature (206)..(206): Xaa can be any naturally occurring amino acid
  unsure (1)..(226): unsure at all Xaa locations
MAALLARQAALALRARQTARLGPXSATAMQGHLRTYMDAGAPKRFKEDEEKEQLAKELAKDWSAVFERSINTLFLTEMVRGLMLTLKYFFERKVTINYPFEKGPLSPRFRGEHALRRYDTGEERCIACKLCEAICPAXQAITIEAEEREDGSRRTTRYDIDMTKCIYCGFCQEACPVDAIVEGPNFEFSTETHEELLYDKEKLLEXNGDRWETEIAENLKSEALYR

SEQ ID NO: 23069 - protein, 433 aa, Clostridium tetani E88
MYKKWKCLVCGVIFDGDVPPNPCPVCGASSDNFEEVLVARNDFADDSKLNFVIIGNGAAGFYAADSVRNRNKNCNITMISKEKTYSYYRPLLSEYLNKEKLPSNFYLSKENWFEEKNINLILNTAVNNINPVDKKVLLSNGKTLNYDKLILANGGYNFIPPIEGKDKKGVFTLRGLEDSENIKDYAKKIKHATVIGGGLLGLEAAWELRNIGLDVSVIEFFDRLLPRQLDEKAGKLFQDSIKQSNVDIILGDSLVEILGDNSVESIKLKSGKEIKTDMVLFSIGIRSNKELAENCGLKTDKAVIVNEKMETNIDDIYACGDVAEFNGKNYGNWPAAVQMGKVAGANASGDNLNFKDFVSAIIFRAMNTKMFTCGNCDDNMVNVAYEDPKNGTYKKLFFEKDILVGATLLGDISSSGKLVEQIKNKTSINDIIK

SEQ ID NO: 23070 - protein, 279 aa, Triticum aestivum
EEASERVGNGGSGGKCLTARVTHAALSVAGYGLARRSGGLFTGYPVVGRQDQMQASGGCLTGKEDVLQTACAWDPRVSDSSFFHQTTFSLPLSRPGAFVQDVQRLRDLNPKALCGLELYDGILIRYVKSSTAHLGKPAAPGESADMVDFDMTYYRSRDPGRARLHEDFLEEIEQMGLVKYGGLPHWGKNRNLAFAGAASKYPGMRRFLRVKSAYDPDGLFSSSWSNMMLGVTTAPTKDAPGCALEGMCVCSRDAHCAPEQGYVCRPGKVYKDARVCTKV

SEQ ID NO: 23071 - protein, 415 aa, Zea mays
MAATLDGAAGCRKRKRAAPGLADLHDDMLERVLARLPPASYFRLRGVSRRWRAAAESRSFRAACARVTARDPWFLMLEDSDHQDQDQDERRPRPAAVFDSAERAWARWRGAPVPLQPVAAASGLVLYRDPSTGGLTVVNPLTGASRALPPPARVAGALQAVAMYGSPYRVVLILGELPELSTVAYDSSTNAWSEQAALSRKPEVEGAPSRERVAEVGDGDGDDTVYFLSKSGDVVASTMQRSASRQYSSAVACGGCGGGDAVAYFLSRSGTVVACDLARRAFAELPRILPAYHEHSIDVVACGGAAYAVVLSEFLDAASLRVWEFAGGAWRQVAAMPPAMAHGFRGAKADVNCVGHGGRLMVCVSSSSAGAGGCFLCDVGTNRWEELPRRAAGDGDATTGFVSALSFEPRIEAAV

SEQ ID NO: 23072 - protein, 408 aa, Solanum tuberosum
MAASAATATATTSYLSALDKKTPFLFALDKKTPFLCPKSSTKRRSFNGGVKCMAIETTSGFTATKKRSGYELQTLTSWLLRQEQAGVIDAELTIVISSISMACKQIASLVQRAGISNLTGVQGAVNIQGEDQKKLDVVSNEVFSNCLRSSGRTGIIASEEEDVPVAVEESYSGNYIVVFDPLDGSSNIDAAVSTGSIFGIYNPNDECLADHGDDSTLDNIEQKCIVNVCQPGTNLLAAGYCMYSSSVIFVLTLGNGVFSFNLDPMYGEFVLTQENVQIPKSGKIYSFNEGNYQLWDDKLKKYIDDLKDPGPSGKPYSARYIGSLVGDFHRTLLYGGIYGYPRDQKSKNGKLRLLYECAPMSFIVEQAGGKGSDGHQRVLDIQPTEVHQRVPLYIGSTEEVEKLEKYLS

SEQ ID NO: 23073 - protein, 463 aa, Bacillus cereus G9241
MQHTNKSGTLNRGLKERHITLMSLGSAIGVGLFLGSASAIKLAGPSILLGYMIAGLVIFFIMRALGEMAIEQPVAGSFSKYAYDYLGPLAGYITGWNYWFLWVVTCMAEITAAGIYMQYWFPDIPCWTWALLALLLMSAFNFLSVKVFGELEFWFALIKIVTIICMIVVGAGIILFGFGNGGIATGISNLWSHGGWFPNGFSGLLLSMQMVLFAYLGVELIGVTAGEAQNPKKTLAKAIDNVFWRILLFYVGALFVMMAIYPWNELGEKGSPFVLTFQQIGIAKAAGIINFVVLTAALSSCNGGLFSTGRMLYTLAQQKKAPERFGRLNKNGIPSQGIIATAIVLLVGVILNYLVPAKVFTWLTSISTFGAIWTWGIILVAQIKFRKSLPAQNKQKLSYKMPLYPISSYFSLAFLALVLCIMAYSEDTRIALIVGPIWLIGLAIVYYMKGFHKIDETPNSKIS

SEQ ID NO: 23074 - protein, 313 aa, Arabidopsis thaliana
MEKASNSNKSTKFSKMLQRAMSIGHSAAPFSPRRDFHQHRTTSTANRGIFFSSPLVPTAARVRRNTKYEAVFAEPTSPKVSCIGQVKLARPKCPEKKNKAPKNLKTASSLSSCVIKEEDNGSFSKLKRIFSMRSYPSRKSNSTAFAAAAAREHPIAEVDAVTAAPSLGAMKKFASSREALGGFDWTVQMKREKEDVMIPCSVGIPLTQLEDLSLCPKPKSEVNLWKRRTMDRPKPLQHFLSGYDNERFEIQMHTLLPNHLYAYQNRTQKYQILTMFIKVFRGQDDQKGYGSKSCPMSSQIHLWKKTMRTTIYN

SEQ ID NO: 23075 - protein, 339 aa, Yarrowia lipolytica CLIB122
MTSLANRNIVGIESDRVTNVTSTDFPGHWPGADDAWDLDKFDKNLQVKIHSLTDNYSNFDLIGIDTSLANAFRRIMIADIPTIAVEEVFIHANTSIIQDEVLAHRLGLVPLVINPERINALPRGLDASEIEDYYDDSNTFVLRLNVTCERLADGTMKNAHIYARDITFDPMGNQCQWVKDEGLENVFKVANPDILIAKLRPNQSINLTMFCHLGFGHDHAKFSPVATASYRLMPTITITGDITGDEAKKFQKCFPKGVIELEGGKPVVADARKDTVSREVLRHEEFNGKVKLGRRRDHFIFNVESSGALEPDEIFLKSVMELQAKAQTLKAAVSGYMQQ

SEQ ID NO: 23076 - protein, 119 aa, Oryza sativa
MDWAYSGNSYGYGYYSSGTSSPPAGGEDAYMTVSSAPPKRRGGRTKFKETRHPVYKGVRSRNPGRWVCEVREPHGRQRIWLGTFETAEMAARAHDVAALALRGRAACLNFADSPRRLRV

SEQ ID NO: 23077 - protein, 298 aa, Oryza sativa (japonica cultivar-group)
MYSRRAAAGGEQQHLSNRVVGLVNLVTLVASVPIIGAGLWLQAHGGSSPCGSALQAPLLAIGFVTLLVSLAGFLGACYHVPSALWLYLAAMLLLVLALLGITVFGLAVTAGGGGTQVAGRPYREFRLADYSSWLQRHVRAERYWRPALACVLAARACDTLAAWTPLDYLRNDLTPVQSGCCKPPTACTYYDDAQQQQQQPDCYRWSNAPGVLCYGCDSCKAGVLEQLRRHWHNVTILNVVLLLLLILFYSCACCAFRNTATATSSKTIFHLHPRWEYRWYLLYLCARESQGGGMDEDS

SEQ ID NO: 23078 - protein, 126 aa, Rhodopirellula baltica SH 1
MSSHVPNFDAGVPCPKTGQPLLPAIAQDATTGRVLMLAWMNREAWDETISGNRAVYFSRSRGKLWRKGDTSGHAQVVREIRVDCDADTILLSVEQTGAACHENYESCFFRRVDPDGTTHITEERIA

SEQ ID NO: 23079 - protein, 256 aa, Haemophilus ducreyi 35000HP
MARRPLVMGNWKLNGSKAFTQQLIAELKTELAEITGCDVAIAPPVMYLSEAEIALAGQSTIRLGAQNVDINTQGAFTGDISTAMLQEFCAKYIIIGHSERRTYHAESDQFIAKKFAALKTAGLTPVLCIGETEAENEAGQTQQVCARQIDAIINSLGVEAFNQAVIAYEPIWAIGTGKSATPAQAQAVHAFIRQHIAEKSQAVADQLIIQYGGSVNDTNAAELFSQPDIDGALVGGASLKATAFAEIVKAAEKAKA

SEQ ID NO: 23080 - protein, 176 aa, Triticum aestivum
  misc_feature (71)..(71): Xaa can be any naturally occurring amino acid
  misc_feature (87)..(87): Xaa can be any naturally occurring amino acid
  misc_feature (99)..(99): Xaa can be any naturally occurring amino acid
  misc_feature (123)..(123): Xaa can be any naturally occurring amino acid
  misc_feature (150)..(150): Xaa can be any naturally occurring amino acid
  unsure (1)..(176): unsure at all Xaa locations
MGPTVMASSATFVTPFQGLKSTVGLPVSRRSNGASLGSVSNSGRIRCMQVWPIEGIKKFETLSYLPPVSTXEALLNQDHYLIRSKWXPCLQFIKGGFIXREHNASAVYYHGRYWTMWKLSMFXCTDSTQVINQVEEAKKEYPNSYVRIIXFYNMRQVQCVSFIAFKPPGCEESGKA

SEQ ID NO: 23081 - protein, 472 aa, Mesorhizobium loti MAFF303099
MAAVRDLKATEMAASGGDDAIELGKRHLIQPWPYAGSVGAEARALIGEGDGIYITDNTGKRLIDGPAGMWCVNVGHRREELARVMYDQAMALSYNTPWYTMNAPSAELAMRIAGHAPDDLSHVFYTTGGSSAVETALRFMQFYNNVRGRPEKKLILSRGGAYHGSTYLSASLNGRPRDRDWMDGADELVIKLSSPDPFRRPQGMSLAAFTDFLVDQFRDTVARVGADKIGAFVGEPVQASGGVVIPPDGYLKRIREICRVNDILYVSDEVVTGFGRLGHVFASGDVFGIDPDMITFAKGVTSGYFPLGGVIISERLLQELRRSNHPDAMFGHGLTYTSHPVGCAVALKNLDLLEESVLAHTQAVAPYFQAQLKTLEELPLVGEVRGAGLMGCVECVADRESKNPLQLDKDVGKRIDAHCHELGLLVRPLINMCVMSPPLIITREQIDDMVGILREGISRTMDDLWKEGVWRG

SEQ ID NO: 23082 - protein, 487 aa, Brucella suis 1330
MKAQPKASHFIGGAFVEDKAGKPLPVIYPATDEEIASLYSATPGIIEAAYAAALKAQGEWAALKPVERGRILRRTAEILREKNRKLSKLETLDTGKALQETLVADAASAADALEFFGGIISGFNGEFVELGGSFAYTRREALGICVGIGAWNYPIQIAAWKSAPALAMGNAFIFKPSENTPLSALALAEAYKEAGLPDGLFNVVQGYGDVGAALVNHRLTAKVSLTGSVPTGRRIMAQAGEQLKHVTMELGGKSPLIVFDDADLESAIGGAMLGNFYSTGQVCSNGTRVFVHKNIRERFIERLVERTRKIRIGDPFDEATQMGPLISAAQRDKVLSYIKKGKAEGATLACGGGVPKLQGFDKGFFIEPTVFADVTDTMTIAREEIFGPVMSVLEFSDEDEVIARANDSEFGLAAGVFTADLSRGHHVIGQIKAGTCWINAYNLTPVEVPFGGYKQSGIGRENGIAALAHYSQIKTVYVEMGKVDSPY

SEQ ID NO: 23083 - protein, 152 aa, Blastopirellula marina DSM 3645
MERSLILLKPDCVQRRLIGRIISRFEDKGLNIVGMKLMQVTPDLAKQHYAEHVAKPFYPGLEAFITASPVVALVLEGLEAIRVIRDILGATSGLKAAAGTIRGDFSSSRQMNLVHASDGPEAAAREIGLYFTESELCDCTLSLTPWLRADDE

SEQ ID NO: 23084 - protein, 292 aa, Candida albicans SC5314
MSDFKVKAGLAQMLKGGVIMDVVNADQAKIAEAAGACAVMALERIPAEMRKSNQVCRMSDPKMIKDIMETVKIPVMAKCRIGHFTESQILEALGVDYIDESEVLTPADTVYHIDKTKFKVPFVCGARNLGEALRRINEGAAMIRCKGEAGTGDVSSAVDHIRTIKKDIEEASKLKTETEIVELARELRVPTELLIQVIEEKKLPVVLFCAGGVSTPADAALLMQLGCDGVFVGSGIFKSKNPEKLAKAIVNATTHYNDPVKLLQYSTDLGELMGGIAIDSIKEEEKLEKRGW

SEQ ID NO: 23085 - protein, 211 aa, Brassica napus
DSLSVHQQRASRASLPFSQALLSRATSHNGSNKHVSVPASSVLKTTSPRTNFFHSQRSASTSNHTLRPLVRASAIETTDTTTDSTLVDKSVNTIRFLAIDAVEKAKSGHPGLPMGCAPMSHIWYDEVTRYNPKNPYWFNRDRFVLSAGHGCMLQYAWLHLAGYDSVREEDLKSFRQWGSKTPGHPENLETPGVEVTTGPLGQGMANAVGLA

SEQ ID NO: 23086 - protein, 1399 aa, Vibrio vulnificus CMCP6
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADGDGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAISLIADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYSLDKVELVTGVKANDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVADITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 23087 - protein, 387 aa, Medicago truncatula
MAIAAAAVVVPLGLLFFASGLIVNFFQAICYVLVRPLSKNLYRRINRVVAELLWLELVWLIDWWAGVKVEIYTDRETSRLMGKEHALVICNHRSDIDWLVGWVLAQRSGCLGSTLAVMKKSSKFLPVIGWSMWFSEYLFLERSWAKDENTLKSGIRRLNDFPLPFWLALFVEGTRFTNVKLLAAQEYATSTGLPVPRNVLIPRTKGFVSAVSHMRSFVPAVYDITVAIPKSSPAPTMLRLLQGKRSVVQVHIKRHLMNELPETDEAVAQWCRDIFVAKDALLDKHVAEDTFSDQELQDSRRPIKPLAVALSWGFVVVAGSVKFLQWSSLLSSWKGVAFSTFGLAVVTGLMQVLILFSQAERSNPAKVAPAKPKNKEEQPEAINDKQQ

SEQ ID NO: 23088 - protein, 450 aa, Streptococcus thermophilus LMG 18311
MVKEYDYIVIGGGSGGIASANRAAMHGAKVILFEGKEVGGTCVNVGCVPKKVMWYGAQVAETLHRYAGEYGFDVTINNFDFATLKANRQAYIDRIHGSFERGFDSNGVERVYEYARFVDPHTVEVAGELYTAPHILIATGGHPLYPNIPGSEYGITSDGFFELDEVPKRTAVIGAGYIAVEVAGVLNALGSDTHLFVRKDRPLRTFDKDIIDVLVDEMAKSGPTLHMHANATEVVKNADDSLTISFDNEETITVDCLIWAVGRAANTSGFGLEKTGVELTERGNIYSDEFENTSVPGIYALGDVTGKLDLTPVAVKAGRQLSERLFNNKVDAKLDYTDVATVVFSHPAIGAIGLTEEKAIAKYGAENIKVYKSSFTPMYTALGDNRQLSTMKLVTLGEDEKIIGLHGIGYGVDEMIQGFSVAIKMGATKADFDNTVAIHPTGSEEFVTMR

SEQ ID NO: 23089 - protein, 1626 aa, Nostoc punctiforme PCC 73102
MMNQPNAFDSLDEIAIVGMNGRFPRAKNIEQFWQNLRDGVESISFFSDEELLSSRIDPATLSQPQYVKAGSVLEDIELFDASFFDFSAKEAQITDPQHRLFLECAWEALESAGYNSEIYAGRIGVYAGASLNTYFLTNLYTQPKIIESVGSYRISIGNSPNFLPTYVSYKLNLKGPSLNVQTACSTSLVAVHLACQSLLNGESDIALAGGVSIQVPHKTGYRYQQGGIMSPDGHCRAFDAKAQGIISGNGVGIVVLKRLEDALADGDCIHAVIKGSAINNDGSLKVGFTAPSVDGQAKVIAEALAMARVESETISYVETHGTGTVLGDPIEIASLTQAFRPTDKKNFCAIASVKTNIGHLDAAAGVAGLIKTVLALKHQQIPPSLHFEQPNPQIDFANSPFYVNDKLSEWKSNGTPRRAGVSSFGIGGTNAHVILEEAPVWEQGRQRRQGRKYHLLVISAKTKSALETATANLANHLKQHLELNLADIAYTLGVGRRGFSDRRILVCQNLNDAVTVLETPVSERVFTKFTEPSGQQIAFMFPGQGTQYVNMGRELYETEIIFRKQVDYCCEFLKSYLKLDLRTLLYPHQQTEALTQQLQQTHITQSAVFVVEYALAQLWMAWGVRPNAMIGHSIGEYVAACIAGVFSLEEALILVANRGQLMQQLPSGTMMAVSLPEKKIQPMLGKKLSLAAINAPDMCVVSGLEEAVDDLQKRLIDQGVDCHRLHTSHAFHSSMMDSILLPFQEQVSKISLNSPKIPFVSNVTGTWITPAQATDPKYWARHLRQTVRFSEAIAELLQQPKRILLEVGPGRTLSTLANKQKAAQQVILSSLRHPQNQQSDVAFLLNTLGRLWLEGINVDWSEFYADEERHRIPLPTYPFERKRYWIEPILANDDNLSPKNEILVSQPEDIITNSIKVPDTQIVNQPIANTAIEQIISQHLQVMSKLVDLLPQGSLAREVLPSLGAIHQDGQIAQTSTNGSAFSGNQSTFTKAESEQQIKDRKINPTPKAASQQIEKESMMLSPRQQRHLDSLIAHFVKRTQESKRLTQAYRSCHANSRAVSGFFPFIKEMIYPIHAERGEGARLWDVDGNEYVDISMGFGTLLFGHSPSFAIAAIQEQSKQGILNGPQSRFAGQLAELICELTGAERTAFCNDGTEAVMAAVRIARSVTGRSKIALFAGSYHGGSDGVLVKGVRTNDGTLRSVPMTSGIPSSLAEDVMVLEYGTPESLNILKDNAHNLAAILVEPIQSSRPDFQPKEFLFQLRQLTQETGTVLIFDEVVTGFRMHPGGVQALWGIQADITTYGKAVAAGIPIGVVAGKAVFMDALDGGMWNYGDESYPQVKTTFFAGTFFKHPLIMGVAWATLNHIKNSGSKLQEELNQRTTQLAETLNSYFEQKQVPIRVVNFGSLFRFNCQTQLGNLFFYHLLAKGIYVWEGRTLYLSTAHTDKDVEQVISAVKESVVEMQAGGFFTSEQTSKNSGQTSANQTLTGSSLNLATESLSVTSNVKSADELFENLIEQIPNALGNTYAASRKKIEKTIADIWQELFGFDNVNIHDNFFELGGDSLTALQAISLLNKKLDLDIPIESIYEAPTINSLTNIVCPEQNEILSAKQSISRGQRRREKRNQR

SEQ ID NO: 23090 - protein, 397 aa, Neisseria gonorrhoeae FA 1090
MAFLKLTEQNVRGKTVLIRADMNVPFKGGKISDDTRIRASLASVKYCLDNGASVIVMTHLGRPTEGEFHPEDDVAPVAAHLGGLLGKDVKVLNDWRENKPALNAGDVVMLQNVRINKGEKKNDLELGKAYAALCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKTRRVNGLI

SEQ ID NO: 23091 - protein, 118 aa, Physcomitrella patens
SMEQGQKMKGPKRPREPRYEFKTRSEVDVIDDGYKWRKYGQKPVKSSPHPRNYYRCTTANCPVRKRVERSIEDPGLIVTSYEGTHTHPKINRPKNSSGVGWTSNEFEGPQDLWSQVQN

SEQ ID NO: 23092 - protein, 471 aa, Bacillus cereus G9241
MNQQVEQTDLKRTMKSRHLFMIALGGVIGTGLFMGSGQIVHNAGPGGAILAFLVGGFVMYLTMLCLGELSVAMPEAGSFQSYASKFISPGFGFVVGWMYWLNWAVTVGVELTTVSILMKRWFPDVSSWIWCVTFAAALFLVNALSAKAYAEAEFWFASVKVATIVVFIVLGGAVMFGLLDFNGKPAPMLHNFTENGGLFPNGALAVLLTMITVNYSFQGTELIGIASGESENPEKTIPKAIKNTIWRTLFFFVLAISVVVGLLPWQEANLVESPFVLVFDVAGVPYAADIMNFVIITAVLSVANSGLYANSRMLWAMAKQGMASPAFTKLTKKGVPLNALIFSLIFASLSLLTSVFAADTVFLVLTSIAAMAAVVVWMSIAASQFFFRRNFVKNGGDINDLKYRTPLYPLVPIVAFSLNFITFVSLAFIPDQRIALYCGIPFMVICYILYQVKYKKIVTFEQQQTIPQEIN

SEQ ID NO: 23093 - protein, 432 aa, Oryza sativa (japonica cultivar-group)
MSASTSPPPLSTGDKAGYGGRGGRPTRRSWAAPTAGEELDGVGDGGGAGWRRRGRTERRGRSCEPAGVWGRSCARGPPSSSSSSSATATASPAFSARRNFAGFTRRHPTPLAVVLELVFFYLPRAPAARRRRGARLAPRHPPLPPHPQLRDALRAAHPDLVFRLFFPDFLGDAATVAFLVNCSQKEAMDFKVASFLLLLLIVTCGAAQGQGNDFVVLDLKTTEVGEDASPMYKEQIALTKIPVTLLRSKHSSLCSACENITSEAVNFLSEKQIQDKIMTILHDTCSQTFSFEQKCLETMDSYATLVFAKIAEIKPDEFCKQYGLCRDMALLSAMKSESTCVFCHHIIDEIMSKLKDPDAEFEIIQLLLKECNKIEGHQQQCKRMVLQYVPLVLVNGEKFLEKNDVCAMIQACDAGKRKAFNLFSARKLVRDA

SEQ ID NO: 23094 - protein, 241 aa, Arabidopsis thaliana
MFSNIDHKAVAALLHGQGCANILKTVLDNCKVSSVSTEPLINTILDSFSLALSSVNSPNRQPHHESSSRDMAGLVPQRSSKKKICGVKGLEIYRDDSPNPRLDDGFTWRKYGQKTIKTSLYQRCYYRCAYAKDQNCYATKRVQMIQDSPPVYRTTYLGQHTCKAFGVHDNTYGSEMINFDQVVSESVMRQLATIGEQAVLMEDEANHIMNQEYDINDYLVDDEVFWGNEFPLFSSEDLMLF

SEQ ID NO: 23095 - protein, 397 aa, Oryza sativa (japonica cultivar-group)
MGEGHGWWSVNNLRPPFVEQLHNPASLFLPSSTTTSTTPSSSSSPLHSFSSLLLSNHYPLPSTATTSTAAAPWHDTGSRHGQHLQDSWNHILLGGLASGEEGYNKNWEGQVLFPTTPAAAAAEADHGSNSYNNIYSTTTTSHGSSTSDDASQLAVAARPSSSPWGGIHGHHPHHNALQQQASSPRSSCITSTTSLGSNGVLEFSNNTSPRECISTASGAAFKKARTQEPSPAQATVKVRKEKLGDRITALHQLVSPFGKTDTASVLLEAIGYIRFLHGQIEALSSPYLGNGGSSSNGGGGGGGGSNSKLQHQPEASRVQGERNSIFPEDPGQLLHDNAVKKRGQPDQDESCEEAKTMDLRSRGLCLVPVSCTVDVGVDAGPADYWAAPPAFGIGFGR

SEQ ID NO: 23096 - protein, 478 aa, Kluyveromyces lactis NRRL Y-1140
MGKVMGGSGRKQRHDPLLNDLDSQHGKLKRQGKKKIDAKDQKGHEDEEFVDAQQSRKILQLAREQQEELEEEDEQSLQTSSQGINRFCVANYADEDDVAEEEEAQGNNISDFEPEDEDDFEGYEEEEVVEIDEEDAEMFDQYFKTSADFNSANGSYNLADKIMASIREKEMELQYNEEEAGDASAVAEPAAPVDRTEGVALPPKVIQAYLAVGTIMQTWRHGKLPKLFKVLPSLNNWQDVLYVTNPEEWSPHAIYEGTKLFVSNLSSKEAQKFVIAVLLPRFREEIEFNEDHNLNYHVYRALKKSLYKPAAFFKGFLFPLVESGCNVREATIAASVLSKVSVPALHSAAALSYLLRLPFSPATTVFIKILLEKKYALPYQTVDECVFYFMRFREVTDGSTGQDAVRVLPVVWHKAFLAFAQRYKNDITQDQRDFLLETVRQRGHKEIGPEIRRELLAGDSREFVSDVGNKADLMFDVL

SEQ ID NO: 23097 - protein, 718 aa, Oryza sativa (japonica cultivar-group)
MSVPAIAVYTSPPGAVYTSSSSSELEASSRGSAPCATAAPPSPASSHRHQAIAGGLSCLFSSPTAAPRAAAAQDELGALWHDRSGEATAVGGGGGGGGYSYPQPSSPFKWRDMLHHSPVPLFHSPASSPASRSPSASWLAGRERERLFSSFVRNALGSCVDYAPVAALPLGVSAAVGVGAGELAFELDEHLSEAEPSCEPYARDLLAGAQARHRIFHDELVVKAFFEAERAHRGQTRASGDPYLQHCVETAVLLAKIGANATVVSAGLLHDTIDDSFMDYDQIFRMFGAGVADLVEGVSKLSHLSKLARDNNTASRTVEADRLHTMFLAMADARAVLIKLADRLHNMKTIEALPLVKQQRFAKETMEIFVPLANRLGIASWKDQLENICFKHLNPEEHKELSSKLVISFDEALLTSTLDKLDKGLRDEGISYHSLSGRHKSLYSIYSKMIKKNLTMDDVHDIHGLRLVVDTEQDCYQALDIVHKLWPRVAGRFKDYILHPKLNGYRSLHTVIMCEGIHPFEVQIRTKEMHLQAEYGFAAHWRYKEGGCKHSFVLQMVEWARWVLTWQCEAMSKERSSGLGRSDAIRPPCPFPSHSEDCPYSYTRQCNHDGPIFVIMLEHDKMSVQELPANSTVVDLMERVGANSPRCSPYSFPLKEELRPRVNHKPISDPNRKLCMGDVVELTPALPHKSLTEYREEIQRMYERGGFALATTRDGPAS

SEQ ID NO: 23098 - protein, 304 aa, Blastopirellula marina DSM 3645
MSATKFITALCTPLSDDDAIHVAGLEAHIEDQLDNGIDSLLVAGTMGFMQVLSMETYLQLVAESVRIGNERAELLVGVGDTGTSTTLARIRAVENLPVDGLVIVSPYFLKYTQAELIDYFTDLADASKKPLFLYDLPRLTGTKLEISTVLKLSEHPNIHGIKCSDDFAQSRPLLALQSDQFRVIIAQPTILDVLLKAGVREHLDGVFGFAPHWIRDMQTALGKRDWLAVTQIQNQFNELLAAMQSIDASIFSTTSELLNLRGIPGRMAPKPLRLLSPAEQERFRSLPIVQQALSSEAFACEAPR

SEQ ID NO: 23099 - protein, 202 aa, Triticum aestivum
  misc_feature (57)..(57): Xaa can be any naturally occurring amino acid
  misc_feature (87)..(87): Xaa can be any naturally occurring amino acid
  misc_feature (166)..(166): Xaa can be any naturally occurring amino acid
  unsure (1)..(202): unsure at all Xaa locations
ETGKKYTYVSAEMQGWRKTMEDACIHSLDLGDGNALFAVFDGHGGFEISKYCWKHLXKVLRDNEFYKKKDYRKALKETFRQIDEIIXSPTGQEELYKIRYSDDKPKQETSEGSREFIGGAVGCTANVVLVTPTHYYVANAGDSRSVLCRDGKAIDLSKDHIPDGPXEEARIKNAGGYITMGRVNGGLNLTRSFADFDYKRNQ

SEQ ID NO: 23100 - protein, 135 aa, Aeropyrum pernix
MAMVMLDTLANAMAAIKNAEMRGKGEAIIMPSSKLIANVLRILEKEGYIGGFEYIDDGRWGKFRVKLLGRINDIGVVKPRTPVSYRELAKMPEHLRKYLASRDVGLLILSTPQGVMTHREALKRKIGGIVIAYVY

SEQ ID NO: 23101 - protein, 333 aa, Medicago truncatula
MDPTNNQSNTQNSSDYPFSYQNQFPNSHPQNPNQFPNQYPQNPNQFLNQHPQNPNQFPNQNPQNMSNFGFASNFNHPSFVPNNFNPYFRSMMGYSSQTPPFNGYMPMVNENFQSVGEYPEFSSQINRGGMTRDNEVAPTPEDTTPKSKRNQQPSWNTEQNLVLISGWIKYGTCSVVGRNQTSESYWGKIAEYCNEHCSFDSPRDVVACRNRFNYMNKLINKWVGAYDSAKRMQGSGWSEDDVFKKAQELYGCGKNVQFTLMEEWRALRDQPRYGSQVGGNVDSGSSGSKRSYEDSVGSSARPMGRDAAKKKVRRKARARHWRRWKRNGFNSKS

SEQ ID NO: 23102 - protein, 354 aa, Chromobacterium violaceum ATCC 12472
MKIAILPGDGIGPEIIAQAERVLEVLRRDGLKIETEHAPLGGAAYDQYGVPYPEATQKLAREADAVLLGAVGGPAYDKLDRPLRPERGLLAIRKDLNLFANLRPAILYPELANASTLKPEVVAGLDIMIVRELTGDIYFGQPRGIAVNELGEREAYNTMRYSESEVRRIAHVAFGIAMKRNRKLCSVDKANVLETTEFWKEIMIEVAKEYPQVELSHMYVDNAAMQLVRNPKQFDVMVTGNIFGDILSDEASMLTGSIGMLPSASLDQNNKGLYEPSHGSAPDIAGQNLANPLATILSAAMMLRYSFGQEAAARRVEDAVKKVLAQGYRTADIYEAGCEKVSCSGMGDAVVAAM

SEQ ID NO: 23103 - protein, 645 aa, Medicago truncatula
MESKKKASSPLSLDQFISITTPLLDLEKDAEISSSIATGASRNLDTAQKRGSTILNLKCVDVQTGLMGKSLIELQSTKADVLPAHKFGTHDVVVLKLNKADLGSPALGQGVVYRLKDSSITVAFDDIPEDGLNSPLRLEKVANEVTYHRMKDALIQLSKGVHKGPASDLIPVLFGERQPTVSKKDVVFTSINKNLDYSQKDAISKALSSKNVFLLHGPPGTGKTTTVVEIILQEVKRGSKILACAASNIAVDNIVERLVPHRVKLVRIGHPARLLPQVVDSALDAQVLRGDNSGLANDIRKEMKVLNGKLLKTKEKNTRREIQKELRTLSREERKRQQLAVTDVIKTSDVILTTLIGASSKKLGNTSFDLVIIDEAAQALEVACWIPLLKGTRCILAGDHLQLPPTIQSVEAEKKGLGRTLFERLAELYGDEVTSMLTVQYRMHQLIMDWSSKELYNSKVKAHACVASHMLYDLEGVKKTSSTEPTLLLIDTAGCDMEEKKDEEDSTLNEGESEVAMAHAKRLVQSGVLPSDIGIITPYAAQVVLLKMLKNKENSLKDIEISTVDGFQGREKEAIIISMVRSNSKKEVGFLSDRRRMNVAVTRARRQCCIVCDTETVSSDGFLKRLIEYFEEHGEYQSASEYQNE

SEQ ID NO: 23104 - protein, 376 aa, Antirrhinum majus
MMDGRFPRQDVINEILLFSSVKSLLRFRCVSKSWCSLIKSNDFIDNHLLRRQTNGNVMVVKRYVRTPERDMFSFYNINSPKLEELLPDLPNPYFKNIKFDYDYFYLPQRVNLMGPCNGLICLAYGDCVLLSNSALREIKRLPPTPFANPEGYCTDIIGYGFGNTCNDCYKVVLIESVGPEDHHINIYVYYSDTNSWRHIEDDSTPIKYICHFPCNELFFKGAFHWNANSTDIFYADFILTFDIITEVFKEMAYPHCLAQFSNSFLSLMSLNECLAMVRYKEWMEEPELFDIWVMKQYGVRESWTKQYVIGPQVVVCSHVCWKNDECLIVEDGNGQLVSCAFRTNEIKKLPIYAVEETLRVLIVDESLISLNRVLNF

SEQ ID NO: 23105 - protein, 281 aa, Triticum aestivum
MAEQLISTAVHHTLPDSYVRSEADRPRLDEVVPDADIPVVDLANPDRAAVVAQIGAACSSHGFFQVLNHGLPLEVMLAAMAVAHDFFRLSPEEKAKLYSDDPAKKMRLSTSFNVRKETVHNWRDYLRLHCHPLEQFVPEWPANPPPFRDVMSTYCKEVRQLGFRLYAMISESLGLEQDYIKKVLGEQEQHMAVNFYPKCPSPELTYGLPAHTDPNALTILMMDEQVAGLQVLKEGRWIAVNPRPNALVINLGDQLQALSNGRYKSVWHRAVVNSDRPTETC

SEQ ID NO: 23106 - protein, 126 aa, Yarrowia lipolytica CLIB122
MRFAPKEPIQLDPPKDTPITLAELSLKDGVKSEQLWVGIKGDVFDVTRNSKAYGPGTNYHVFCGKDASKALGKSSLEEEDFAPAGEIISWQELTADLSEKDLKTLEEWYSYFSQRYNIVGKIDLQN

SEQ ID NO: 23107 - protein, 353 aa, Thiobacillus denitrificans ATCC 25259
MKIAVLPGDGIGPEIISQAVKVLEALKSEGAKIEMETAPIGGAGYDAAGDPLPEATLKLAREADAVLLGAVGGPQYDTLDRPLRPERGLLRIRKELNLFANLRPALLYPELASASSLKPEVVSGLDLMIVRELTGDVYFGQPRGIETRNGERVGFNTMLYSESEVRRVAHVAFGIAMKRGKKLCSVEKANVLECSELWKEIMIEVAKDYPEVELSHMYVDNAAMQLIRAPKQFDTIVTGNIFGDILSDAASMLSGSIGMLPSASLDEHNKGMYEPIHGSAPDIAGKNLANPLATILSVAMMYRYTFADLATADRIENAVKQVIAKGYRTGDIWTEGTQKVSCSEMGDAVVVAL

SEQ ID NO: 23108 - protein, 166 aa, Deinococcus radiodurans R1
MQTHIKINRGELLRGIEQDHTRQLPDFRPGDTVRVDTKVREGNRTRSQAFEGVVIAINGSGSRKSFTVRKISFGEGVERVFPFASPLVNQVTIVERGKVRRAKLYYLRELRGKAARIKSDRSRVMKDAARAQQDKANASASQAAAAQADVTVISAAPEVAPETQGE

SEQ ID NO: 23109 - protein, 49 aa, Triticum aestivum
QEEEENKRQRREKKKEKKKEQAGQNEPEDIDPDVAAMMGFGGFGTSSKK

SEQ ID NO: 23110 - protein, 433 aa, Myxococcus xanthus DK 1622
MAKDTLTITDNRTGKTYEVPIENGCIRTNALRQIKTGDDDFGLMGYDPAFLNTANCKSAITFIDGDKGILEYRGYPIEQLAEKSSFLEVAYLLLNGELPSEKELQQFNHLVTHHTYVHENVKSFMDGFRYDAHPMSMVSSTVAALSSFYPDAKNIKDPLSRRIQITRLIAKMPTIAAFSYRHTMGLPYIYPDNDLSYVANFLAMIKRIGTSTYKVHPVLERALDILFILHADHEQNCSTTSVRTVGSSEVDPYSAVSAGIGALYGPLHGGANEAVLRMLRDIGHVSKIPEFIKSVKSGEGEKKLMGFGHRVYKSYDPRAKVIKRVADEVFEVTGKNPLLEIAVELERIALEDEYFVKRKLYPNVDFYSGLIYEAMGFQVEMFPVLFAIPRTVGWCAQWEEMVTDNEQKIARPRQVFTGAPRRDYVPMDKRAVK

SEQ ID NO: 23111 - protein, 411 aa, Deinococcus radiodurans R1
MCPARSHLFVTPAGTFDRPFFAPWKKGRCYPLLTMSNIAKGLEGVLFTESKLTFINGSEGILTHLGIPIQEWAEKSTFEELSLALLDAKLPTAEELAKFDAELKANRAIPDQLVGIIRDMPKGVHPMQALRTAVSYLGLLDPQAEDITPEARRAISTRMIAQFSTIIAAINRAQEGQDIVAPRADLTHAGNFLYMLTGNEPTPEQARLFDIALVLHADHGMNASTFTAIATSSTLSDMYSCMVSAIGALKGPLHGGANEAVMTMLDEIGTVDKAEAYITGKLDNKEKIMGVGHRVYKYFDPRSRVLRDYAEHVANKEGKSNYYQILEAIEKIIVDRMGAKGIYPNVDFYSGTVYSDLGIKKEYFTPIFALARISGWCASVIEYSQDNRLLRPDAEYTGARDQHYVDIKDRQ

SEQ ID NO: 23112 - protein, 66 aa, Glycine max
  misc_feature (29)..(30): Xaa can be any naturally occurring amino acid
  misc_feature (34)..(34): Xaa can be any naturally occurring amino acid
  misc_feature (37)..(40): Xaa can be any naturally occurring amino acid
  misc_feature (42)..(43): Xaa can be any naturally occurring amino acid
  misc_feature (47)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (56)..(58): Xaa can be any naturally occurring amino acid
  misc_feature (61)..(63): Xaa can be any naturally occurring amino acid
  unsure (1)..(66): unsure at all Xaa locations
MVLALALGDLHIPHRAPDLPAKFKSMLVXXKIQXIIXXXXLXXNEIXDLXKXLTCXXXHIXXXPIN

SEQ ID NO: 23113 - protein, 444 aa, Brassica napus
MATITVVKARQIFDSRGNPTVEVDVHTSSGVKVTAAVPSGASTGIYEALGLRDGGSDYLGKGASKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGLHAGNKLAMQEFMILPVGASSFKEAMKMGVEVYHNLKSVIKKKYGQDATNVGDEGGFAPNIQENKEGLELLKTAIEKAGYTGKVVIGMDVAASEFYSSDKTYDLNSKEENNNGSQKISGDALKGLYKSFVSEYPIVSIEDPFDQDDWEHYAKMTAECGDNVQIVGDDLLVTNPKRVAKAIAEKSCNALLLKVNQIGSVTESIEAVKMSKRAGWGVMASHRSGETEDTFIADLSVGLSTGQIKTGAPCRSERLAKYNQLLRIEEELGSEAVYAGANFRKPVEPY

SEQ ID NO: 23114 - protein, 493 aa, Candida glabrata CBS 138
MAGKVGKVSKKSDDVSSLAAKIRARALENQKKMQAASRKDSESDSSDEEVERPAKKQAKDEKVEEPEEEVTFESFAQLNLVPELIQACQNLNFTKPTPIQARAIPPALAGSDVIGLAQTGSGKTAAFAIPILNKLWEDQQPYYACVLAPTRELAQQIKETFDSLGSLMGVRTTCIVGGMNMMDQARDLMRKPHIIIATPGRLMDHLENTKGFSLKNLKFLVMDEADRLLDMEFGPVLDRILKIIPTKGRTTYLFSATMTSKIDKLQRASLTNPVKCAVSNKYQTVDTLVQTLMVVPGGLKNTFLIYLLNEFIGKTVIIFTRTKANAERLSGLCNLLEFSATALHGDLNQNQRTGALDLFKAGKRSILVATDVAARGLDIPSVDIVINYDIPVDSKSYIHRVGRTARAGRSGKSISLVSQYDLELILRIEEVLGKKLPKESVDKNIILTLRDSVDKANGEVVMEMNRRNKEKQARGKGRRGRMMAKENMDREEK

SEQ ID NO: 23115 - protein, 340 aa, Cordyceps bassiana
MSRANPPNNASASRKISFNVSEQYDIQDVVGEGAYGVVCSAIHKPSGQKVAIKKITPFDHSMFCLRTLREMKLLRYFNHENIISILDIQKPRGFDSFNEVYLIQELMETDMHRVIRTQVLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVLFRTLFADTSDLALDLLEKLLAFNPVKRITVEEALKHPYLEPYHDPEDEPTAPPIPEEFFDFDKHKDN

SEQ ID NO: 23116 - protein, 528 aa, Aspergillus nidulans FGSC A4
MASLRGGSRALSWANQLLSRQRLSSKCASQRVAPPATAYSLRQYATTAKEASKPYYVTTPIFYVNAAPHVGHLYTMVLADILKRWRTLTGDNEAQLLTGTDEHGMKGLLGEIVTYAEQEMLQHRGYIYTSKHEGWYSVSDETFYPQSQVNLSLDPATGRKRMVSTETGKEVEWSSETNYHFRLSAFQDRLLELYKTDFITPTHYTEQVVKSVASGLSDLSISRPVERLTWGIPVPNDNTQTIYVWLDALVNYLTKAGYPFPPGEGSRLGWPADVHVVGKDIVRFHCVYWPAFLMALDLPLPRNVLVHAHWTMNREKMSKSTGNVVNPFFAIDRFGMDTMRFFLAHRGGLASDSDYDNRYIIRDYKKYLQQGLGNIAHRTIGCAKGKLRDYIINATSGNSPATADDQAYQKTLEQLSHKVAKCMEALDPRAALEEIVEVILLTNKYFHNSEPWQNPEEKQRVIFNAAESMRIMGILLQPFMPNKAKKLLDILKVDPSKRDLSDAGYARDSTYGEDVKKKILFPPLALEN

SEQ ID NO: 23117 - protein, 369 aa, Medicago truncatula
MDPNNNHFNNQNYSNYPFNYENPNNYPNPNQFFNQRPQNIPNFGFPPNFNQSSSVPKFHPYYGSMMRYPSQTPPFNGYMPMGNENFPSVDATQYPEFSTQITPGGMAVADEVTPEDSTPKSKRSKEPTWNTQQNLVLISAWIKYGTSSVVGRNQRGETYWGKIAEYCNEYCSFDSPRDLVACRNCFNYMSKIINKWIGAYESAKRMQGSGWSEDDVLTKAQELFAGGKNIQFTLNEEWHALRNQPRYGSLMGGNVGSGSSGSRRSHEDSVGSSARPMGREAAKKKGKMKSKGETLEKVEKEWVQFKELKEQEIEQLKELTLVKQQKNKLLQEKTQAKKMKMYLKLRDEEHVDDRKKELLEKLERELFEN

SEQ ID NO: 23118 - protein, 328 aa, Mycoplasma pneumoniae M129
MSPKTTKKIAILTSGGDAPGMNATLVYLTRYATSSEIEVFFVKNGYYGLYHDELVPAHQLDLSNSLFSAGTVIGSKRFVEFKELKVREQAAQNLKKRQIDYLVVIGGDGSYMGAKLLSELGVNCYCLPGTIDNDINSSEFTIGFLTALESIKVNVQAVYHTTKSHERVAIVEVMGRHCGDLAIFGALATNADFVVTPSNKMDLKQLESAVKKILQHQNHCVVIVSENIYGFDGYPSLTAIKQHFDANNMKCNLVSLGHTQRGFAPTSLELVQISLMAQHTINLIGQNKVNQVIGNKANVPVNYDFDQAFNMPPVDRSALIAVINKNII

SEQ ID NO: 23119 - protein, 130 aa, Carboxydothermus hydrogenoformans
  misc_feature (113)..(113): Xaa can be any naturally occurring amino acid
  unsure (1)..(130): unsure at all Xaa locations
IDYEKKLFTVDNITVKEGDYLSIDGSTGRVILGTVPMKDPELSPEFIKLLEWADELKRLEVRANADTPEDAQKAREFGAKGIGLCRTEHMFMGPERLPHVQRMILAETKEERXEALSHLLPMKEEDFYGF

SEQ ID NO: 23120 - protein, 232 aa, Thiobacillus denitrificans ATCC 25259
MAAARGRGIRPAQGENTVLPMPPDAPLDVHRPPADLRDRIALGFVKLVKAAADAFFGRRYGHRAVVLETIAAVPGMVGATLQHLRALRRMQGDRGWIRTLLEEAENERMHLMTFIHVAQPTQFERLLVVLAQAFFYNLYFFVYLASPKTAHRITGYLEEEAVHSYTEYLARVDGGACTNVAAPGIAIEYWALPADARLREVIVAVRDDEIRHREVNHAYADTLTRSSASGPE

SEQ ID NO: 23121 - protein, 451 aa, Oryza sativa (indica cultivar-group)
MSKAMQCFGFAGWEREERRGRSSAVAAAAATTRSLSARSNSSTSTDRDARRSGSECSLNVSSEISAESFGRYRQLSLPQRASNNLRIFTFQELKSATRGFSRSLVLGEGGFGCVYRGTIRSVLEPRRSVEVAIKQLGRKGLQVINNSQHGHKEWVTEVNVLGVVDHPNLVKLIGYCAEDDERGMQLLLVYEFMPNGSLADHLSSRSPRPASWAMRLRVALDTARGLKYLHEESEIKIIFRDLKPSNILIDENWNAKLSDFGLARLVSQDGSHVSTAVVGTIGYAAPEYIHTGRLSSKNDIWSYGVVLYELLTGRRPLDRNRPRGEQNLIEWVKPYSTDSKKLEIIMDPRLEGSYSLKSAANLASVANKCLVRHARHRPKMSEVLEMVQKIVDSTDLGTPEHPLISKSRELTRDEKKRKGLDLKRRFADIKAGGDQRWFTWQRWRPKLVRTQ

SEQ ID NO: 23122 - protein, 245 aa, Bacillus cereus G9241
MIKLVLIRHGQSLWNLENRFTGWTDVDLSENGLSEAREAGAILKKNGYTFDVAYTSVLKRAIRTLWIVLHEMDLAWVPVHKSWKLNERHYGALQGLNKDETAQKYGEEQVHIWRRSIDVRPPALTEDDPRYEMNDPRYKALKKGEFPLTECLVDTEKRVLAYWHSEIAPKLKNGNKVIISSHGNTIRSLVKYLDNLSSDGVVSLNIPTSIPLVYELDDDLRPIRHYYLSMDGEVPEGEIPKHISF

SEQ ID NO: 23123 - protein, 562 aa, Glycine max
MAPTTTVPIGTLPSGSVTGRLASVYSEVQKTRVDHALPLPSVLKHPFTILDGPPSSAAGNPDEIAKLFPHLFGQPSAALAPSGAVQTQKKLKIGVVLSGGQAPGGHNVISGIFDYLQERAPGSTLYGFKGGPAGIMKCKYVELTSEYIYPYRNQGGFDMICSGRDKIETPEQFKQAEETAKKLDLDGLVVIGGDDSNTNACLLAENFRSKNLKTSVIGCPKTIDGDLKCKEVPTSFGFDTACKIYSEMIGNVMIDARSTGKYYHFVRLMGRAASHITLECALQTHPNITIIGEEVAAKKLTLKNVTDYIVDVVCKRAEINYNYGVILIPEGLIDFIPEVQHLIAELNEILAHDTVDEGGLWKKKLTDQSLKLFDFLPQAIQEQLMLERDPHGNVQVAKIETEKMLIQMVETELEKRKQEGKYNGEFKGQSHFFGYEGRCGLPTNFDATYCYALGYGAGALLHSGKTGLISSVANLCAPVEEWTVGGTALTSLMDVERRHGKFKPVIKKAMVELEGAPFKKFASLRDEWALKNCYISPGPIQFSGPGSEVINHTLLLELEALA

SEQ ID NO: 23124 - protein, 365 aa, Triticum aestivum
  misc_feature (251)..(251): Xaa can be any naturally occurring amino acid
  misc_feature (292)..(292): Xaa can be any naturally occurring amino acid
  unsure (1)..(365): unsure at all Xaa locations
HQLVRVITPRYLCDTIEYSSYASNALGALPYGRPAGGRTSDFERPPGQVSGINAEPKANDQYLPPFVIVDESGKSVGPIVDGDAVVTFNFRADRMVMLAKALEFPDFDKFDRVRVPKIKYAGMLQYDGELKLPSKYLVSPPLIERTSGEYLVKNGVRTFACSETVKFGHVTFFWNGNRSGYFDETREEYVEIPSDSGITFNEQPKMKALEIAERTRDAILSGKFDQVRINLPNGDMVGHTGDIEATVVACXKAADEAVKMVLDAVEQVGGIYLVTADHGNAEDMVKRNKAGXPMLDKSGSIQILTSHTLQPVPVAIGGPGLHPGARFRSDIQTPGLANVAATVMNLHGFQAPADYETTLIEVVDK

SEQ ID NO: 23125 - protein, 635 aa, Deinococcus radiodurans R1
MSRFPTEDQTQTQTMTEVTNVSQEKSPLNLNFSREVKLVLVVLGMVALIGGWFVLTGQPDDQTVTAPVPVTTPAPETATTPETAPAGNAAPDGQTAGTATETTTTPGTTDESSGKKATGTAAKSQKGTQSGDGSDESLVATVPPLEGEGTATPPVPVPGGINPDRPLKTLSGADPFGSLTPSPGTGTAGGTAPATPVEAQTPETQSPETAPETQAPTAQSTTNSPAPVVLSSPAGSSVSGQGGVLDYSSRLDQGALPTPVIPVSPTEVRSPVTSAPVSGSSVNGDSVGSGMATAPTVVVSTPAQPTTTPSASSPVARNTAGQSGAGQNTGASRPASGTPSRASAPNVVVVRPPARVSGTSAAGATGSSRTGAAGTPAATPTRNQSASGTRPASGQTPPRVIAVAPAGGARTPAAPGNRPATAAPTRPSPSSTAPSKTVVVRPPVPVSGQQPPRVVTSPAAGVPAGNAAPAPTPPPVVAARVPQANTVPELVAQAGTSAAPATSGASAGTGTAGQAGNDAAGTAALPPLITAVGSEAAPASTATADAGSSTPAAPAATALDRLLAPGQVALSSVVLGPTNTAVFRTPQGFVVVEQGQTVPGLTGEDGTPVVLQKVETGAVTVALGTKVKSLELEQR

SEQ ID NO: 23126 - protein, 590 aa, Oryza sativa (japonica cultivar-group)
MEDGAAAREAERWEGYVDWRNRPAVRGRHGGMLAASFVLVVEVLENLAFLANASNLVTYLMNFMHYSPSQSATTVTNFMGTAFLLALLGGFLSDAFFTTYAIYLISAFVEFLGLVVLTIQARTPSLMPPGCAKVAGAACEPVSGPKKAMLFAGLYVTALGIGGIKGSLPSHGAEQFDEHAPRGRKGRSTFFNYFVFCLSVGALIAVTFAVWVEDNKGWQWGFGISTIAILLSIPVFVAGSRLYRNKVPTGSPLTTIAKVVLAAALARRGGAQSASNGAVIDRAPSPTGSTDMKEYCKPGDICGVADGAAEVATEPSQELVFLNRAVQRQPRCGALSCTVQEVEDVKIVLMVLPIFFSTIMLNSCLAQLSTFSVEQAATMDTRVGGLKVPPASLPVFPVTFIILLAPVYDHIIIPFARRATGTEMGITHLQRIGTGLVLSIVAMAVAAVVEVKRKNVASNAGMLDAAAPLPITFFWIAFQYLFLGSADLFTLAGLLEFFFSEAPARMRSLATSLSWASLALGYYLSSVLVTVVNSATGRGGRRAWLQGENLNHYHLERFYWVMCVLSTLNYLFFLFWAIRYKYRNAGVIKG

SEQ ID NO: 23127 - protein, 581 aa, Alteromonadales bacterium TW-7
MSEANIVDITPFLAKHQLPLKYQYLSEQYFVPLAHDILESKKLSTPLFVGINGCQGSGKTTLADFLVTWFSNNTSLNTVALSIDDFYLGKESRKQLAQDVHPLFVTRGVPGTHDTDLMNKTITQLLAGEVGIALPRFNKHHDDCVAEQDWVKNVAPVDIVFLEGWCVGSEPQPLFSLSEPLNELEQLNDKEGVWRRCINSCLANEYKSIFNKIDYKIMLKAPSFSDVFTWRKEQEQKLIAKSGVGTGTMTDEQLVYFISHFERITRENLNTLSRKANALIELDSNRDIVSMHLTSDDTLQPIIFTDLDGTLLDHTDYNTSNVSELLQQLQSAHIPVVFNTSKTFCEVVEIKNELNIQQPFIVENGAAVFIPQNYFELKPIGCKEVAGYWCYALASPLSSLLSDLDSLDAQYKAHYKLFSELSSEQISELTGLNNAQAKRAQTRDYSDPLYWYGSDELLDTFVNDVTALGYEIKIGGRFIHIAKNTDKSAAQQWLVKQFTQHFRKPLTVIALGDSDNDKQMLEHADIAIIINNPSSKKPVKLSHNKARYSQSPAPQGWVEEITTLPSISSILNTIEEQKSHG

SEQ ID NO: 23128 - protein, 582 aa, Oryza sativa (japonica cultivar-group)
MAASQRQSRLFRSPSTSRDPSTSRISTPRRRRCCRGGGGGSSSLPSPAMSVMPSIRRLLLAGAAVAVVVVSCAVVCAEASVHEYAGERFAGVGNGFVLHGGSEGVYASATAESFVRFEKVAFRRTPEAASVAEEDGNRTVTVAAVIFEAGDRDAVGAVSDVVGGERALCCTPGMARRGGCTEGAVVYRAPASSNATGRWPKVLAASFLPGSLVAAFPDETVAVARTGMYSLHFVHCDASLAAGQVVAAEGKTIWKNSRGYLPGRMAPLKPFYGAMSLAFAALAALWFARYARFWREVSPLQNFATAAIALGMVEVTTWYLDLAEFDASGVRPAGTTFWAATSGAVRAAACRVLALLVAMGYGVTRPALGCGNARVAALGAAFLAAAEVLDVGDNVGIVSDHSPARRLFFILPVAALNTVFIYWIFTSLSRTISKLKARRMTAKLEMYRKFANSLTIAVALSLGWITFEVHFKTTDEHNERWRVAWVIPAVWELISFFLLCTICILWTPSQNSMRFAYSREECEDDTEHNDEDDDVEDTRPLIRAGPLSYVDNWACYVTQDAKIILRTDSGVYAKAGEEYKRV

SEQ ID NO: 23129 - protein, 265 aa, Arabidopsis thaliana
MSSSREENVYLAKLAEQAERYEEMVEFMEKVAKTVDTDELTVEERNLLSVAYKNVIGARRASWRIISSIEQKEESRGNDDHVSIIKDYRGKIETELSKICDGILNLLDSHLVPTASLAESKVFYLKMKGDYHRYLAEFKTGAERKEAAESTLVAYKSAQDIALADLAPTHPIRLGLALNFSVFYYEILNSPDRACSLAKQAFDEAISELDTLGEESYKDSTLIMQLLRDNLTLWNSDINDEAGGDEIKEASKHEPEEGKPAETGQ

SEQ ID NO: 23130 - protein, 671 aa, Medicago truncatula
MAAAWSDSTTQKQNRPSQQLYVPQFRSNPNNNNIHPSPYYNNNRTHFPSNDSPHYNTFNRPTPRPTRGRGGYGFGHSPAPPRHYSRPEQQQPRYYDPSQNRSPFETNGEKVENGVVANFEAYESIPVEATGENVPPPVNLFAETELHEDLKNNIERCKYVKPTPVQRYAIPIAVAGRDLMACAQTGSGKTAAFCFPIISGIMKERLASGLLPRGGGVDSDVAFPTALILSPTRELSCQIHAEACKFAHQTGVKIAVVYGGAPIGQQLRILERGVDILVATPGRLVDLIERERVSLKKIKYLALDEADRMLDMGFEHQIRNIVQQMHMPPPGDRQTLLFSATFPDNIQKLASDFLSNYVFLAVGRVGSSTELIVQKIESVQDMEKRTRLVDLLRRNVVNGKLALTLVFVETKKGADALENWLCRINFPAIAIHGDKVQMERERALRSFKRGLTPIMVATDVASRGLDIPHVAHVINFDLPRDIDDYVHRIGRTGRAGQSGLATAFFSTKNMPMAKSLVGLLQEAKQEVPAWLVQYSECSAPGGRSSVGSQRSPWRGNYGGRDFRNATEPGMVENYNSYNSNYSNYGDNGYHNVPEQVQNYNYNGTYNNGDHAANSYTDASLDVTNSNNDCSFDNTNTVVAGGFNYTDAGLLEGSDGTNGPCGYASVVPTGWD

SEQ ID NO: 23131 - protein, 613 aa, Mycoplasma mobile 163K
MNTNKLDTLAINTLKVNGIAQILKANSGHPGIVLGAAKIMHNLFSNHINFNVENPNWINRDRFILSSGHGSALLYAQLRAIGLLDVKELHNFRQVDSKTPGHPEYLHTLGVEATTGPLGQGVAIAVGIALAEANLNARFNEISHFTYVLLGDGDLQEGVANEAMQFAGTNQLNKLILIHDSNRIQLDTPVENVSKVDIKKMVESFGFQHISATNENFNEAVEIAKKNSKPSFIEVRTIIGEDSIEAGTTKVHGTPLTKEDFSNLKKKLNWEYSDDFHLPIEVIEHYKKTLHTRSKKAFNNFKASKSLETFLATKSIDIKVELPKNKATRETGGLVIDFLNKNDIRWIGGSADVGSSTKGLGGDGDFSISNKKGRNIRYGVREFAMASIANGIALHSNFKTFVTTYFSFSDYLKPAARLSALMNLPVIYIFTHDSIQVGEDGPTHQPIEQLAMWRSIPNFKVYRPADEKEVLGAFKLALESKSNPSVLVLSRQAITSLEETNANKVSQGAYHVLKSSSEWTLVSTGADLANAYKIAKELKLNLVSLPSFDFKNISWDINKAISIETATTFGWTKFAKYNFGIDTFGASGKPDDVMKKFEMDLNSLLPKIKKLIK

SEQ ID NO: 23132 - protein, 121 aa, Triticum aestivum
MSAMETDAPDAPPPAPAADAGAGSSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 23133 - protein, 352 aa, Glycine max
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDPTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 23134 - protein, 829 aa, Oryza sativa (indica cultivar-group)
MASLPHCLSARPLVVAAAPGRPGPGPGPWLRGGARRRNAAFSAGNAGRRVGLRRSVASAVEVGVGEDEEGVEEEEEEVEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKGMGYEKYRDIVRQFIKGTDGFAGGFAECLCGSPHLYQVCIRIKAVTCICHYRYSFINQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSMKDETKGEIYVAFNASHLPAVVGLPERPGYRWEPLVDTGKPAPYDFLTDDLPDRAHAVHLFSHFLNSNLYPMLSYSSIILELQPDD

SEQ ID NO: 23135 - protein, 352 aa, Glycine max
MGEVDPAFIQEPQHRPNLSTIQAEGIPIIDLSPITNHTVSDPSAIESLVKEIGRACQEWGFFQVTNHGVPLTLRQNIEKASKLFFAQTLEEKRKVSRNESSPMGYYDTEHTKNVRDWKEVFDFLAKDLTFIPLTSDEHDDRVNQWTNQSPQYPPLFRVVTQEYIQEMEKLSFKLLELIALSLGLEAKRFEEFFIKDQTSFIRLNHYPPCPYPDLALGVGRHKDPGALTILAQDEVGGLEVRRKRDQEWIRVKPTPNAYIINIGDTVQVWSNDAYESVDHRVVVNSEKERLSIPFFFFPAHDTKVKPLEELINEQNPSKYRPYNWGKFLVHRGNSNFKKQNEENIQIHHYKIA

SEQ ID NO: 23136 - protein, 364 aa, Burkholderia xenovorans LB400
MKTYRIATIPGDGIGKEVIPAGAQVLEALARTSKSFAFEFENFGWGGDYYREHGVMMPADGLDAIRNKDAILFGSAGDPDIPDHITLWGLRLKICQGFDQYANVRPTRILPGIDGPLKRCKPGDLNWVIVRENSEGEYSGVGGRVHQGHPIEAATDVSILTRAGVERIMRFAFRLAQSRPRKLLTVITKSNAQRHAMVLWDEIALEISKEFPDVKWDKELVDASTARMINRPATLDTIVATNLHADILSDLAAALAGSLGIAPTGNIDPERRYPSMFEPIHGSAFDIMGKGLANPVGTFWSVVMLLEHLGEFDAAQRVMQAVEAVTADTSLHTGDLGGTATTAQVTAAVCAFIENAVSSAARAA

SEQ ID NO: 23137 - protein, 544 aa, Myxococcus xanthus DK 1622
MHRKTPFHLAPWAAALMLLASTASAGTLYRDPYLQKVGPDTATIAFRLAANCQAEVRYGEGAANQSAVSQDGGKLHAVVLTGLKPGTEYTYEVSACGLRTQLNRFRTAPVPGTRSVHFVAVGDFGTGGSNQKKVAAAMVKRQAGLFVALGDNAYAGGTEAEIQNNLFVPMEALLAQVPFFAALGNHEYVTNQGQPYLDNLYLPTNNPEGTERYYSFDWGHVHFVALDSNCAVGLASADRCTRDAQKAWLERDLAGSTQPWKIVFFHHPPWSSGEHGSQLAMRRHFGPIMEKYGVDLVLTGHDHNYERSKPMKGDAVAGSGEKGIPYLVVGGGGATLRKLPGSKPDWSVIRDNQAYGFLDVTVVDGTLTAQLLGVNGDPVDRFTLQKELPPQEQLPEGAMTLVVEGERGVAPHRAFFRATPSLEAATVTWDFGDGGTAEGEAAEHVFAIPGQYTVTATATQGTVKQTATALVQVAETPGEEPQTPDDGTTDPGSPEPRPGLPDSPGPPDDGMSSSNGGCTAGPTATLLPAALALLAAGLLHRRRK

SEQ ID NO: 23138 - protein, 352 aa, Arabidopsis thaliana
MKSSQMSETEFKVLLETFTFPADSAPFKSCHASTIVEVVKDHFLAAYFGGTREGAPDVKIWLQHFKDGQWDSPVIVDEEPGVPMYNPVLFKLPSHELLLFYKIGQEVQKWSGCMKRSYDKGITWTEREQLPPGILGPIKNKPILLEDGTLLCGSSVESWNSWGAWMEVTSDAGRTWRKKGPIYIQGKSLSVIQPVPYQTAAGNLRILLRSFTGIDRICISESLDGGENWSFAVPTVLPNPNSGIDGVKLKDGRLVLAYNTDSRGVLKLGVSLDDGDSWTDILTLEESPGMEYSYPAVIQAGDGNVHVTYTYNRTQIKHVVLKTATDIDSKPYRHGEAGGGHVNLDLYEPNIN

SEQ ID NO: 23139 - protein, 249 aa, Triticum aestivum
  misc_feature (202)..(202): Xaa can be any naturally occurring amino acid
  unsure (1)..(249): unsure at all Xaa locations
MSSSSSSKLFHSACKAARSFLASSPASASAPRAASSVLADGRNAALAALANLGRNSTLPAAYAHHTNAAASSHGYAWIAAIPAAVYMLQDQEVHAAEMERTFIAIKPDGVQRGLISEIVSRFERKGYKLVAIKLVVPSKQFAEKHYHDLKERPFFSGLCDFLSSGPVLAMVWEGEGVIKYGRKLIGATDPSKSEPGTIRGDXLAVVVGRNIIHGSDGPETAKDEIALWFQPKELVSYTSNEEKWIYGVN

SEQ ID NO: 23140 - protein, 392 aa, Oryza sativa (japonica cultivar-group)
MLAAAASVKLSTAGTATAPKMALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLVILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQAKQ

SEQ ID NO: 23141 - protein, 181 aa, Arabidopsis thaliana
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 23142 - protein, 461 aa, Mesembryanthemum crystallinum
MQSQSNDEDNNAHYDFDLFVIGAGSGGVRAARFSAKFGAKVGICELPFHPISSEVIGGVGGTCVIRGCVPKKILVYGASFSGELQDARNYGWELNENIDFNWKKLLQKKTDEILRLNNIYKRLLSNAGVKLYEGEGKIVSPNEVQVTQLDGTKLSYSAKHILIATGSRAQRPDIRGQELAITSDEALSLEELPKRAVILGGGYIAVEFASIWRGMGATVDLFFRRELPLRGFDDEMRAVAARNLEGRGVNMHPRTNLTELVKTDGGIKVRTDHGEELMADVVLFATGRSPNTKRLNLDAVGVNVDKTGAIKVDDYSQTSVPSIWAIGDVTNRMNLTPVALMEGTCFAKSLFGGQPTKPDYKDIPCAVFSIPPLSVVGLSEEQAIEQSNGDVLVFTSSFNPMRNTISQRQEKSVMKLVVDAETDRVLGASMCGPDAPEIMQGIAVALKCGATKAQFDSTVSR

SEQ ID NO: 23143 - protein, 120 aa, Roseovarius nubinhibens ISM
MTFDPATLRYDAAGLIPAIAQDAETGEILMMAWMSSEAVARTLETGRVTYWSRSRQSFWIKGETSGHVQELVEMRVDCDRDCLLVLIRQTGPACHTNRRSCFYTALRDGEEVEIMAPMAE

SEQ ID NO: 23144 - protein, 357 aa, Mycosphaerella graminicola
MAEFVRAQIFGTTFEITSRYTDLQPVGMGAFGLVCSAKDQLTGQAVAVKKIMKPFSTPVLSKRTYRELKLLKHLKHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITDLLGTPPDDVISTICSENTLRFVQSLPKRERQPLKNKFKNADPQAIELLERMLVFDPRKRVKAGEALADPYLSPYHDPTDEPEAEEKFDWSFNDADLPVDTWKIMMYSEILDYHNVDSANNGEGQENGGA

SEQ ID NO: 23145 - protein, 524 aa, Xanthobacter autotrophicus Py2
MSSPALDTAAQETVLIIDFGSQVTQLIARRVREEGVYSEVVPFQKGAEAIQRLKPKAIILSGGPASVIEGQSPKAPEEAFAAGVPVLGICYGEQCMAAQLGGAVEAGHHREFGRAELTVQKVVPLFEGVWRAGERHTVWMSHGDRVTALPEGFEVVATSDNAPFAAIADLSRNYYGVQFHPEVVHTPDGARLLSNFVRKVAKLEGAWTMGAFRERAIARIREQVGTGRVICGLSGGVDSSVAAVLIHEAIGDQLTCVFVDHGLMRQAEADEVVSLFRGHYNIPLVHVDASELFLKELEGVEDPEAKRKTIGRLFIDVFDAEARKVGGADFLAQGTLYPDVIESVSFAGGPSVTIKSHHNVGGLPERMNMKLVEPLRDLFKDEVRALGRELGLPESFVGRHPFPGPGLAIRCPGAITREKLDILRKADAIYLEEIRYAGLYDVIWQAFAVLLPVRTVGVMGDGRTYDHVLALRAVTSVDGMTADFYPFDMGFLGRTATRIINEVKGVNRVVYDVTSKPPGTIEWE

SEQ ID NO: 23146 - protein, 469 aa, Idiomarina loihiensis L2TR
MSANKIFDTIKEHDVKFVDLRFTDTKGKEQHVTIPVSQIDEDFFEEGKMFDGSSISGWKGINESDMVLMPDNESAVIDPFTDEVTLNVRCDILEPETMQGYSRDPRSIAKRAEDFLRSSGIADDAYFGPEPEFFLFNDVRFHTDMSGSFYKIDAEEAKWNSGREYSEGNLAHRPGVKGGYFPVPPVDSAHDIRGTMSLVMEDMGMVVEAHHHEVATAGQNEVATRFNTLTKKADELQVYKYVVHNVAHSYGMTATFMPKPLVGDNGSGMHVHMSLNKGGENLFAGDQYAGLSETALFYIGGIIKHARAINAFANASTNSYKRLVPGFEAPVMLAYSARNRSASIRIPLVSSAKGRRIEVRFPDPSANPYLAFTALLMAGLDGIRNKIHPGDAMDKDLYNLPPEEAKDIPTVCHSLEMALDALDKDRDFLKQGGVMDDDMIDAYIDLKYNEVETLKKTTHPVEFDMYYSV

SEQ ID NO: 23147 - protein, 239 aa, Pseudomonas putida GB-1
MPVKDPSKVVPQVPAESADAALKHIVDGFLRFHHDVFPDQQELFKKLATAQTPRAMFITCADSRIVPELITQSSPGDLFVTRNVGNVVPPYGQMNGGVSSAIEYAVLALKVHHIIICGHSDCGAMRAVLNPHSLDKMPTVGAWLRHAEVARTVVENNCSCGSEHETMQVLTKENVIAQLHHLRTHPSVASRLAAGQLYIHGWVYDIETSRIEAYDAASDSFLPLAAGEPVPCATPRGRY

SEQ ID NO: 23148 - protein, 305 aa, Alteromonadales bacterium TW-7
MRTLEQIKQASLITAIKTPYLANGEIDLAKYDKLVEIQIAAGVDGIVVGGTTGEGQLMNWEEHLMLIAHSANKYGNQLLIVGNTGSNNTREAIKASKYGFASGMHAALQINPYYGRTSIAGVKEHFKHVLDIGPAFIYNVAGRTGQDLTPDIIEPLAKHPNLIGVKECGGNERIAHYEQQGIACWSGNDDEAHDARHVHKAHGVISVTSNLIPGLFRQLMDTKNDALNSSLQPLMNWLFCEPNPIAINTALMMTGAVNPVFRLPYLPLNDEQQQIGLPLINQLNEADVVGGKARLLNSDEVLTLS

SEQ ID NO: 23149 - protein, 320 aa, Emericella nidulans
MDKSQQPSSFQQLEKLGEGTYATVFKGRNRQTGELVALKEIHLDSEEGTPSTAIREISLMKELKHESIVSLYDVIHTENKLMLVFEYMDKDLKKYMDTRGDRGQLDQATIKSFMHQLMSGIAFCHDNRVLHRDLKPQNLLINKKGQLKLGDFGLARAFGIPVNTFSNEVVTLWYRAPDVLLGSRTYNTSIDIWSAGCIMAELYTGRPLFPGTTNEDQLQKIFRLMGTPSERSWPGISQLPEYRANFHVYATQDLGLILPQIDPLGLDLLNRMLQLRPEMRIDAHGALQHPWFHDLPQLQAQLQQQQMAGYGGMMPPQQAY

SEQ ID NO: 23150 - protein, 820 aa, Dechloromonas aromatica RCB
MASLAPTFGRGAMTNHWVDIKNADVVLVMGGNAAEAHPVGFKWVIEAKKQNKAKLVVVDPRFTRSASVADFYAPIRTGTDIAFLGGVINYLLTNDKIHHEYVKAYTDFSFLVGNDYAFDDGIFSGYNPEKRSYDKASWNYVKGEDGYVKTDPTLQDPRCVYQLMKQHYSRYTPEMVEKICGTPKDAFLKVAEMMASTATGDRTMTILYALGWTQHSQGSQMIRTGAMVQMLLGNIGVAGGGMNALRGHSNIQGLTDLGLMSNLLPGYMTLPGEKETDYAAYIAKRAPKPMRPNQMSYWQNYEKFHVSLMKSWFGDAATKENNWGFDMLPKLDKVHDVLMVMDDMYQGKMNGYFCQGFNPLASFPNKAKLGAAMAKLKYMVIIDPLATETSEFWKNYGEYNDVDPAKIQTTVFRLPSSCFAEEDGSLVSSSRLLQWHWKGAEPPGEAKTDPAIMAGIFMKLKAMYKEKGGAYPDAILNLTWAYKDPYEPSPEEVAKEYNGKALVDLYDPKDPTKLIRKAGEQLDSFALLRDDGTTTSGCWIFSGAWTQAGNNMARRDNSDPWGNGQTLNWAWAWPVNRRILYNRASCDPSGKPFNPKRKQIWWNGTAWTGSDIPDFKADSNPADGMGPFIMNPEGIARFFAREMMAEGPFPEHYEPFETPIGTNPMNKNPKAISNPAARVFKGDMEVFGTAKDFPYAATTYRLTEHFHYWTKHAKINAILQPEQFVEIGEELAKEKGIASGDKVKVRSNRGFIKAVAVVTKRIKGLNVNGQKVHHVGIPIHWGFKGVARMGFLSNTLTPFVGDANSQTPEFKSFLVNIEKI

SEQ ID NO: 23151 - protein, 195 aa, Dechloromonas aromatica RCB
MNMNRRQFFKVCSAGLGGSSIALMGFSPTAALAEVRTYKLARATETRNTCPYCSVACGLLMYSIGDKSKNVHQEIIHIEGDPDNPVNRGSLCPKGAGLLDFVHSPNRLKHPEVREAGTNEWKRISWDEAFTRIATLMKEDRDANFIAKNADGVTVNRWLSTGFLAASASSNESGYITHKVVRSTGMIAFDNQARV

SEQ ID NO: 23152 - protein, 197 aa, Oceanobacter sp. RED65
MAQRTASVERNTSETEISVKVNIDGTGKTQFDTAMPFLEHMMDQIGRHGLIDLDIVCKGDNHIDDHHSAEDTGITLGQAFAKAIGDKKGIRRYGHAYVPLDEALSRVVIDFSGRPGLEYNIPFTRASIGGFDTELFYEFFQGFVNHAQVTLHIDNLKGHNAHHQIETVFKAFGRALRMALEMDPRMEGVIPSTKGSL

SEQ ID NO: 23153 - protein, 126 aa, Oceanobacter sp. RED65
MKEIINTNKAPEAIGTYSQAVKVGQTVYLSGQIPLVPETMEMVEGGIDQQIRRVFDNLTAVCEAAGGSLQDIAKLNIFLTDLSNFATVNTIMAEYFEQPYPARAAIGVAALPKNADVEMDGILELA

SEQ ID NO: 23154 - protein, 170 aa, Triticum aestivum
  misc_feature (134)..(134): Xaa can be any naturally occurring amino acid
  unsure (1)..(170): unsure at all Xaa locations
MAPTVMASSDTSVAPFQGLKSTAGLPVSRRSNGASLGSVRNGGRIRCMQVWPIEGIKKFETLSYLPPLSTEALLKQVDYLIRSKWVPCLEYSKVGFIFREHNASPGYYDGRYWTMWKLPMFGCTDATQVINELXEVKKDYPDAYVRIIGFDNMRQVQCVSFIAFKPPGCE

SEQ ID NO: 23155 - protein, 362 aa, Thiobacillus denitrificans ATCC 25259
MRLPELRQRLRDHGAAPCHAGRVLRAWVAGRPLDNRRQRAEDFLPLRLRNALPGLFDELRNLAQVHSEHPGEDGSARLLVRLADGQTVESVLLPRDGVCVSTQVGCAVGCVFCMTGRAGLLRQLSGAEIVAQVVLARSRRPVRKVVFMGMGEPAHNLDNVLDAIELLGLEGGIGHKNLVFSTVGDRRVFERLPQSTVKPARALSLHTTDRALRRRLLPRAPDIAPQELVELGEAYARRTGYPIQYQWTLLEGINDTEAELEGIARLLAGRYAVMNLIPYNATEADGFNRPSWARAAEMARRLHRRGVLAKLRHSAGQDVDGGCGQLRARALDAAPVLARRPLPSAETPAASPKAAASIGFPG

SEQ ID NO: 23156 - protein, 252 aa, Zea mays
  misc_feature (244)..(244): Xaa can be any naturally occurring amino acid
  unsure (1)..(252): unsure at all Xaa locations
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYEXLPDGQVIT

SEQ ID NO: 23157 - protein, 387 aa, Medicago truncatula
MISQVKYTSSLPFTNFGSSNFIPRPKLCTLPIVQHVGKNTNNLSLSSLKPLYISSTENFSFSTTKLTRRETECHAYEADRSQPLEINIDIAGEQAAQKLKIGLYFATWWALNVVFNIYNKKVLNAFPYPWLTSTLSLAAGSLIMLISWATRVAEAPKVNLEFWKALFPVAVAHTIGHVAATVSMSKVAVSFTHIIKSGEPAFSVLVSKFLLGEAFPLQVYLSLLPIIGGCALAAVTELNFNMIGFMGAMISNVAFVFRNIFSKKGMKGMSVSGMNYYACLSILSLLLLTPFAIAVEGPTMWAAGWQTAVSPNWWVAAQSVFYHLYNQVSYMSLDQISPLTFSIGNTMKRISVIVSSIIIFHTPIQPNNALGAAIAILGTFLYSQAKQ

SEQ ID NO: 23158 - protein, 111 aa, Ralstonia eutropha JMP134
MAGISTHVLDVSLGKPVSGMQIELFDMGTQPPKLIARARTNSDGRTDTPMLPATQARTGDFELRFWVADYFKTPDVFADIVPVRFTIADAAQHYHVPLLCSPWSFGTYRGS

SEQ ID NO: 23159 - protein, 540 aa, Medicago truncatula
MAVSASGQLMLSSTVQLREPGMVSSRNLKVVKFCNGEMMGRKIELHAATNGCTKNVYRKNISMSLTADVASESKLKNADVEKRDPSTVVAVILGGGAGTRLFPLTKRRAKPAVPIGGAYRLIDVPMSNCINSGINKVYILTQFNSASLNRHIARAYNSGTGVTFGDGYVEVLAATQTPGEQGKKWFQGTADAVRQFHWLFEDPRSKDIEDVLILSGDHLYRMDYMDFVKDHRESGADITLSCLPMDDSRASDFGLMKIDDKGRILSFSEKPKGAELKAMQVDTTVLGLSKDEALEKPYIASMGVYVFKKEILLNLLRWRFPTANDFGSEVIPASAKEFYMKAYLFNDYWEDIGTIRSFFDANLALTEHPSKFSFYDAAKPMYTSRRNLPPSKIDNSKVILHFHLLNLDIITFSPYQIVDSIISHGSFVNNAFIEHSVVGIRSRINSNVHLKDTMMLGADYYETEAEVAAQLAEGRVPIGIGENTKIKDCIIDKNARIGKNVVIANSEGVQEADRSSEGFYIRSGITVVLKNSTIEDGLVI

SEQ ID NO: 23160 - protein, 590 aa, Arabidopsis thaliana
MDICCKDIISDHSKKDIISDLPEALICHILSFLPIEDSALTSVLSKKWQHLFAFRPNLEFDDAVVYLNPDGERNETIFENFVDRVLSLQGDYPINKFSLTCRDFTDPTCVSRWISNVMERGVSDLDLRCIVYWDNGTMPPDIFVSKALVHLRIETGNGAFIDVEDVFLPNLKTLYLNKVLLRHSDNGFVKLITSCHVLEDLFIMNICWDGYLKRSLSSKTLKRLTFFCEDVHAVNPESVSFDTPNLVYFVYHDCVADKYKNMNFDSLVYASICLQMTSHQRTHASYEHLVGNATDFLLGISNVQILELFANTIEVLTFCCEQIPVFKNLVCLIIKTDQKAGWESLPVLLKNCPDLESLIFDGLHHNDTIKCEDVDGCLCKSSRGIPSCLSSSPVQFLTIWKFGEICDDYDDMEKQIELVMYFLETMPNLEEMKLFYDTQIYEDVISKLQMDLRRTLSLRSLFNARCYQPSCSGIIQRDDVHEEKPHYGSFLHQRSFSSSMILSQQHMMRSPSHFPLCSPFGVSTYRPMSTSHISGSDESGDVNHVAETLTDLVQQDTVIEVADAAIDSSIQLDFVQQIVHNVHSLTGLNW

SEQ ID NO: 23161 - protein, 291 aa, Desulfitobacterium hafniense Y51
MDRKRYELNKELAQMLKGGVIMDVTTPEQAKIAEAAGACAVMALERIPADIRAVGGVSRMSDPKMIKGIMEAVSIPVMAKCRIGHFVEAQILEAVEIDYIDESEVLSPADDVYHIDKTRFKVPFVCGAKDLGEALRRINEGAAMIRTKGEPGTGDIVQAVRHMRMINRQISRLAGMREDELFQEAKELQVPYDLVLYVHEHKRLPVVNFAAGGVATPGDAALMMQLGAEGVFVGSGIFKSGDPEKRAQAIVKAVTNYQDPKVLAELSEDLGEAMVGINEQEIELLMAERGK

SEQ ID NO: 23162 - protein, 294 aa, Medicago truncatula
MTSNEAKFPPQTQQTQPGKEHVMEPLPQTINPDHNPTNKLRGKVALVTGGDSGIGRAVCLIFAKEGATVAFTYVKGVEDRDKDDTLKMLLEAKTSDAQEPLAIAADIGYDENCKQVVELVVKEYGSSIDVLVNNAAEQHLRNSIEEITEQQLERVFRTNIFSHFFLVRHALKHMKEGSSIINSTSVNAYTGKAETLDYTSTKGAIVAFTRGLAQQLVSKGIRVNAVAPGPIWTPVQPATMPYEKIQNLGSDVPMKRAGQPCEIAPCYLFLASLQDSSYFTGQVLHPNGGVIVNA

SEQ ID NO: 23163 - protein, 285 aa, Desulfitobacterium hafniense Y51
MPTFLSENEHGLWMTEDERENLKIDYRIKEIIVEAKSTLQHVMILDSYSFGRMLVLDGAVQTTSLDGHIYNETISHVPLSIHPNPKKVLIIGGGDCGVAKEVCKYSSVEQIDVVEIDPMVVEVCLKHLPEVSGGLADPRVNFIFDDGVNYVQNSPTKYDIVIVDSSDPIGPAEVLIEKSFYRSIFNALEEDGLMVCQSQSPIFHGEVMEQIFERVHDIFPKTKMFTAVVPTYPGGLWSFTLGSKGYVIPNEARMKELDALYVNEQIMASCFSLPEFMNKQLSKYR

SEQ ID NO: 23164 - protein, 147 aa, Glomerella cingulata
MAFKRINKELTDLGRDPPSSCSAGPVGEDLFHWQATIMGPGDSPYSGGVFFLAIHFPTDYPFKPPKVNFTTRIYHPNINSNGSICLDILRDQWSPALTISKVLLSICSMLTDPNPDEPLVPEIAHVYKTDRARYEATAREWTRKYAI

SEQ ID NO: 23165 - protein, 516 aa, Candida albicans
MFTNSIISKSTTRLTQLSRQLSTTTMAPTSTKNSIKHFDYLVIGGGSGGVASARRAAKYGAKVLLIESNFKKFGGTCVNVGCVPKKVMWYTADLAHKKHDLYAYGLDKEPDSIKYGDFDWAKLKHKRDAYVTRLNGIYENNLKREKVDYAYGFAKFINSEGEVEVTLSGDQELPFLDEGKTYKKGEKLVFSADKNFDCHWWYSNCSSSVPGAELGTTSDGFFALEKQHKKVAIVGAGYIGVELSGVFSSLGSETHFFIRGDTVLRSFDEVIQNTVTDYYIDNLGINIHKQSTITKIEGSKDGKKVVHLKDGTSVEVDELIWTVGRKSLIDIGLDKVGVKINDKQQIVADEYQVTNNPKIFSLGDVVGKVELTPVAIAAGRRLSNRLFGGPEFAKDKLDYNNIPSVIFSHPEAGSIGLSTKEASEKYGEENLKIYQSKFTAMYYAMMDDQKDKSPTVYKIICAGPEEKVVGLHIVGDSSAEILQGFGVAIKMGATKKDFDNCVAIHPTSAEELVTMT

SEQ ID NO: 23166 - protein, 430 aa, Aeropyrum pernix K1
MSGDHGGGLWRDALALFIGGAQGGLRREFHSIEPLIVSWAKGSRIRDYRGREYIDFHMAFGAVALGHNDDDVAARVSEQLNRLVLHGAGVSDAEIEFAKMLIRKFPMYDKVLFTNSGSEAVMMAMRLARAYTGRDVVVKFDGNYHGWHDYSIYNIKNPASKGKTVESKGVPSATASTVEVLPYNDVDALEDYAERFGDRVAAYILEPVAHSMGVIPAEKGFVERLRKLCDTHGSLLIFDEIITFIRASDRGMQDYFGVRADLTTVGKAIANGMPVAAVLGGDNVMELLARGVVSSGTYSGHPLSMAAGVATLEKAEDVGLTRALRSRAEALAGILRDISEDLGVEAAVSQFGGSVSIYFGIDRRPKNLEEALRANGDAYRVFAREMRRRGILVTPNPLKRMHLAYSHSEEELEAFHRAAEEAVRVAKEYL

SEQ ID NO: 23167 - protein, 1102 aa, Anaplasma marginale str. St. Maries
MPKREDIETIIILGAGPIVIGQACEFDYSGTQACKVLKSEGYRIVLVNSNPATIMTDPGLADATYIEPITAEIIERIILKEKPNAILPTVGGQTALNVAMELVDRGVLSRNGVEMIGANQDAIRKAEDRSLFRKAVERVGAKCPKSTILKASDHIAQAMEYVGLPAVIRPSFTLGGIGGGIARTEEEFCEAVQRGFAMSPISEVQVDESIIGWKEFEMEVMRDCRDNCIVVCSIENIDPMGVHTGDSITVAPAITLRDEEYQRMRNVSFDILREIGVETGGSNVQFAVNPECEGEMVVIEMNPRVSRSSALASKATGFPIAKVAAKLAVGYTLDEIANDCAVSIPASFEPVMDYVVVKVPRFDFAKFRVPTQELSTSMKSVGEAMAIGRSFTEALQKAMCSLEAGYNGLNEFFPPGTHLEQVYAALAEPSPSRILMIADALRMGIGIDKINELTKYDPWFLKQIEIIVAYEQEVRNNGLPQTKAELLQLKKIGFSDARLAELGGRDVAYVENLRDTLSVKPVYKRIDTCAGEFRTNTAYMYGCYEGDAFGEPECESLVTNKDKVIILGSGPNRVGQGIEFDYTCVHAAHMIKQMGLEAIIINCNPETVSTDYDTSDRLYFSPLTRECVLDIISKESEGQATVKVIVQLGGQTPLKLAKVLQEKGINIVGTGFDSIDLAEDRQKFNGLLTKLGIKQPHSETCNSADEVLEKAQRVGFPVLLRPSYVLGGQFMSVVRTEQALATYLREHDKIFDSGSLLIDKFLTDAAEVDVDAICDGNQVYIAGIMEHIEEAGIHSGDSACSLPPYTLGENTIALVSQYTRQVALALNVRGLLNIQYAIQDGEVYLLEANPRASRTVPFVAKATGVPVAKLATAVMLGGRISISSDAPAVMSYTAVKEAVFSFSRFASADPRLGPEMKSTGEVMGIDQSFGMAFVKSQIAAGYALPTSGKVFLSVKDSDKPAAADLARSFVDLGFELFSTTGTAQYLDTLGIRTTRINKVREGRPHIVDMLNNDEIVLVINTSAGIKAVSDSADIRRTAIMRRIPHSTTLSGAKAIVLALRNLKSGGGPEVAPIQEYHDKNSGTLSECSVQWDPGKEEATTTW

SEQ ID NO: 23168 - protein, 464 aa, Shigella flexneri 2a str. 301
MVRSQLSRADAPCLLTSLRRQLMAMFGFPHWQLKSTSTESGVVAPDERLPFAQTAVMGVQHAVAMFGATVLMPILMGLDPNLSILMSGIGTLLFFFITGGRVPSYLGSSAAFVGVVIAATGFNGQGINPNISIALGGIIACGLVYTVIGLVVMKIGTRWIERLMPPVVTGAVVMAIGLNLAPIAVKSVSASAFDSWMAVMTVLCIGLVAVFTRGMIQRLLILVGLIVACLLYGVMTNVLGLGKAVDFTLVSYAAWFGLPHFSTPGFNGQAMMLIAPVAVILVAENLGHLKAVAGMTGRNMDPYMGRAFVGDGLATMLSGSVGGSGVTTYAENIGVMAVTKVYSTLVFVAAAVIAMLLGFSPKFGALIHTIPAAVIGGASIVVFGLIAVAGARIWVQNRVDLSQNANLIMVAVTFVLGAGDFALTLGGFTLGGIGTATFGAILLNALLSRRLVDVPPPEVVHQEP

SEQ ID NO: 23169 - protein, 458 aa, Aeropyrum pernix K1
MPETGPQRDKDGQREGRVLVHYTDIAGYLRQVEVPLRNVEKEFVASFDGSSVYGFTPVEDSDLLLKHVPETLVSVPWRSGLWRVIATVYNATRERSPRDPRLAAETAEKIMSSMGYRVKAGAEIEFFIFDKIGVDVLNPARGLGYIVESREQPGGQDGIFGQVKKSYHMPEPPDSLLDYRLMLTETLQRFKVDVAVSHHEVAVSQVEVSIGSRTSLARLGDDIMTVKWVSKVLARMDGRVATFMPKPIFGDNGSGMHIHLSLWSPGGENLFAGHGDSDLSETALHFIAGILEHARSLSAILSPTTNSYRRLVAGYEAPVYVAWGWRNRSAMIRIPASAGNIDAVRIEVRSPDPTANPYLALAALFMAGLDGVKKKLAPPDPYEGNLYKISPEELREKGIKTLPRNLDEALDELESDNDYLKPAFTREMLESYIEVKRKESEDTRLYPHPIEVYKYLNL

SEQ ID NO: 23170 - protein, 110 aa, Bacillus cereus G9241
MESRGFIFGCPVSYALGIGFIPVRKLGTLVGFDNENVKDILTINNDAIKPGQRVLITDDVLTTGRTIEAIIKLVEEAGGIISGIVFLVELTDLDGRKMLDGYDVLVLGID

SEQ ID NO: 23171 - protein, 308 aa, Magnaporthe grisea 70-15
MSTPFPVLVHPFKSPVPRQCAYESGSTTAKNALICIGGLGDGPHTLRYVRTISQRLEKEASLSYSVFEVRLSSAFDGFGTKRLSDDVAEISALVQYLRGIGREKIVLMGHSTGTQVWVPAIDCMEYTNYGRHNSAPVDGFIMQGTVSDREAFGPLVDKKELDQIISQAATLIRAGEENEMMPRNNPVSEVFGAPLTAYRLNSLLSPGGEDDFFSSDLTDDKIASFWANFRKPALVLPSGEDEHVPKSIDVEALLGRWKKLAPAGVISELSGLIPGASHTVRDPGAQEWMCDRIVQFLRNLETSHEVKL

SEQ ID NO: 23172 - protein, 454 aa, Saccharomyces bayanus
MSEPEFQQAYDEVVSSLEDSTLFEQHPKYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 23173 - protein, 146 aa, Ralstonia eutropha JMP134
MKTARQVVESKPTQAIFSIPPTATVYAALQLMAEKGIGAVLVMEHGKIVGILSERDYARKVILMQRSSRDTLVRDIMTSSVIYVSGDQSTDECMALMTKHRMRHLPVMNGEDLIGMLSIGDLVKDIISEQQFIIEQLEHYIHGGSR

SEQ ID NO: 23174 - protein, 381 aa, Arabidopsis thaliana
MSDDEEPPLKKNKLPVEEPTLIPSLPEELILSILARVSRLSYRSLSLVCKRFHSLLTSGEIYRFRSLSGYTENCLYVCLRFSHTGRSHRWFMLREKNKSSGYVLAPIPISHSPSLHASSIVAVGSKIYKIGGVMDGSSVSILDCWSHRWLEAPSMQMERDRPSANLIDGKIYVTGGCHRGSYNPSKWMEVFDLKTETWEPVLCRSDRLTFESYHERTNNLLVDGKLYIFWADKGVVYNPKDDTWDSLEVPEMDMCLTLFYCCVIENVLYDFFYEELDIKWYDTKARTWRSLLNGMRELHKFVRHASVTLADYGGKMVMFWDKFVASGDGLGFHKTMMWCAMIALERSDSGEIWGKVEWFGPVLPNQIPLEYAFEYVGSVKV

SEQ ID NO: 23175 - protein, 937 aa, Physcomitrella patens
MMLNRLETGSLASAFRGSREEFVVSRGRSPGRSQSIQVRASSGGDPAGWLQTASKQLGKLSSFGEKRKTATSTSTRGPSGDNVQYTGVATTMKKLKVLDLIDRVADIQDDTSEIVGGKRVTVQLVSKDVDPKTGESMKSSEVIFPNWAGLEGPAASLIDFVLEFTVPKSFGVPGAILVKNAHPNEFLLVSFELELHDKSKAHYVTNSWVYNTEKTGARIFFQNTAYLPDETPASLKALREQELINLRGDGTGERQIGDRIYDYAVYNDLGNIEQNEKFERPNLGGNDMYHFPRRMRTGRRNTTVEAKKFPGMVYETRKTKGDFYIPRDEAFERAKMSDFLADGFRSIGHSVSSKVTGFVTRKQEFDTVEEIKKLYAKKGEKVGGINNVLPDKEDIPEQEQYPLVFLQEVLKPDGKMEHPLLYPLPQLLQADDTSWRSNDEFAREFLAGLNPVMITRVKFPIRSSLDPAEFGDPTSAITKDHIEGSLEGLSVEEAVTSNRLFVVDYHDAFLPFVAKINAQQNSATYATRTLLFLSKDGILKLLAIELALPPKTVGEERITRVLTTRKDDQLWKVNWEWELAKAHVSNNDITAHQVFSHFSRCHAVTEAVIICSNRNLSKLHPLMQLLAPHFKSTLEINRQARATLIAAGGSIETHFTTRAYSLEMAAVNYKDTWTFESQALPTDLVARGMAVPDPDSPHGVRLVVEDYPYAADGLELWGALKAWHKEYVDIYYKDDAAVLQDSELMTWWTEMREKAHEDKKDSHGWPELNSKEALVDILTTVIWIPSCLHAAVNFGQYDFAGFMPHHPTLTRRLLPEHGNEKDKADFNKNPEKYYLTSISNIDSTTTAMSVYEVLSAHCPIEEYIGERRGNWTNNEKVLAAFKGFKESVNEADAVMRARNADPKLRNRGGPVKMPYQLLRPHSKPGVTSMGVPNSITI

SEQ ID NO: 23176 - protein, 491 aa, Alteromonadales bacterium TW-7
MEPSVSTPVYQNFINGHFLANQSGETFDVTNPATGEVIYSVEVADEFVQSAAIESAKQGFAQWSKMTPIERSRILLNAVAILRERNDELALIEVLDTGKPMQEANCVDIETGADVIEYFAGLAPAQVGQQQMVGEDFYYTRKEPLGICAGIGAWNYPLQIACWKSGPALAAGNAFIFKPSEETPLGAIKLAEIFVEAGVPAGVFNVVQGAGDVGQWLTAHSEIDKVSFTGEVGTGKKVVASASGTLKDVTMELGGKSPLVVFDDANIEQAVSAAMLGNFYTQGEICTNCTRIYVHKNIYQQFIDELKTRTEKNIIAGDPQDLNTNFGALISKKHQDLVMSYVNKGIEEGATLLTGGSTLSPESAPNGYFVAPTVFIDCNDEMTIVKEEIFGPVMSVLVFEDEDDVIARANGTHLGLAAGVFTSDIKRAHRVIHQLEAGICWINAYGNSPAEMPVGGYKQSGIGRENGIETLDHYTQTKSIYVGMADIESPF

SEQ ID NO: 23177 - protein, 69 aa, Glycine max
MFRRLRWFVGLNQKNWSTKRLVNVDHQPGPGTPNKLLPVLDAVHEVAIYIHRFHNLDLFEQGWYKIKVT

SEQ ID NO: 23178 - protein, 312 aa, Zea mays
MGISHPLSDEYDALRGAVLSPDTTPPSSPLAHRHLLEHEVTRMDTLAGIAIKYGVEISDIKRANSLVTDSQMFAHKSLLIPLPGMPMPSLNACGQRTIRTCAPNHRQKRDAPKSRQQGASSAMNTLQRYYGLTPPQKGGNTMDSSTELSVYHKGGGCQSNLNETLLNPSAAPGTDSSWNFEAPGFSATEGDGGAPKPEQDGSMRRRQKVEAESNAQGDFLVKAIKSLLISSVRLDTYAGSPGSSQKSGFRSVTVRKSPSAPSFADADNGVSMWSSSKWTFSHDSFTRPLLDGLPKPASARRTNQNRVGLKLN

SEQ ID NO: 23179 - protein, 366 aa, Roseovarius nubinhibens ISM
MDVMEAARRAEAEGRHIIHMEVGQPGTPAPEGARAALAQAMEGDAMGYTVALGLPALRERIAGLYKSWYGLDISPERVVVTSGSSGAFILAFTALFDAGDRVGIGMPGYPSYRQILKALDLVPVEIETKAENRLQPVAQDLEGHDLQGLMVASPANPSGTMLDHAALAELIEAARAQGASFISDEIYHGIEYDSKAVSALEISDEVYVINSFSKYFSMTGWRVGWMVVPQDHVRTVERLAQNLFICPPHASQVAALAAMGCDEELQANLEVYKVNRQLMIDGLPKAGFDRIAPPDGAFYVYADVSHLTEDSRAFAAEILEKAGVAVTPGLDFDPKRGHGTIRFSYARATEDIREGLRRLAEFMAAR

SEQ ID NO: 23180 - protein, 147 aa, Magnaporthe grisea
MALKRINKELTDLGRDPPSSCSAGPVGEDLFHWQATIMGPSDSPYAGGVFFLAIHFPTDYPFKPPKVNFTTRIYHPNINSNGSICLDILRDQWSPALTISKVLLSICSMLTDPNPDDPLVPEIAHVYRTARAQYEATAREWTPKYAI

SEQ ID NO: 23181 - protein, 401 aa, Alteromonadales bacterium TW-7
MQVTRDLFNDVMVPNYNPSAVIPVRGEGSRVWDQNDNEFIDFAGGIAVNCLGHCHPALVNALKEQGEKIWHLSNVMTNEPALRLAQKMVEATFADKVYFANSGAEANEAALKLARRFALDKFGAEKSQIIAFNKGFHGRTFFTVTVGGQAAYSDGFGPKPGDIMHCDYNDIEAFEALISDKTCAVMMEPLQGEGGIISPTDEFAKKVRELCTKHNALLIFDEVQTGVGRTGDLYAYEGLGVVPDILTTAKALGGGFPIGAMITRTAIAEHLKIGTHGSTYGGNPLACAVAEAAFDTVNTPDVLNGVKEREQLFRDGLNAINEKYNVFSEVRGKGLLIGAVLNEKFEGRARDFLVASANNGLMNLVAGMNVIRFTPSLVIPFEDIKEGLARFEKAVSDVVNG

SEQ ID NO: 23182 - protein, 681 aa, Methanothermobacter thermautotrophicus
MKLEYIPTVCPYCGCGCGLNVVTIDGKVEGVEPWKRHPLNEGKLCPKGNFSYQFVGRDDRLTKPLIKENGEFREASWDEATSLIASKLEEYRGEDPDSLAFLASARCTNEENYLLQKFARAVIGTQNVDHCARLCHGPSVAGLAKTFGSGAMTNSISDIEESSCIFIIGSNTAEQHPLIWRRVLRAKANGAKLIVADPRVSPTAKMADIYLPFKPGTDVPLMNAMMNVIIEEGLEDREFIEKRTKDFEKLKETVKNYKPEEAEKITLTPADKIREAAIEYAKADSAAILFAMGITQHITGTDNVVSTANLAMLTGNVGKRGAGVNPLRGQNNVQGACDMGALPAFYPGYQKVIEEDATEKMSCAWGCSDLKCTPGLTVVEMMNAAAEGKLKAMYIMGENPMVSDPDIQHVKESLENLEFLVVQDIFLTETAELADVVLPASAWSEKNGTYTSTERRVQYIRKAADAPGEAKDDWQIICEIANKMGADGFKFSSAEDIFEEIREVTPQYAGMNPERLVKPEGLHWPCPDETHPGTPILHTEQFATPDGLGIFFPVEYREPAETPDSEYPFILTTGRIIFHYHTGTMTRRSETLDREVPTGFVEINDEDALELGIKNGDMVKVKTRRGEIEITARVTPEIMKGVLFIPFHFAECAANMLTSADELDPEAKMPELKVSAASISK

SEQ ID NO: 23183 - protein, 128 aa, Shigella flexneri 2a str. 301
MPKSVIIPAGSSAPLAPFVPGTLADGVVYVSGTLAFDQHNNVLFADDPKAQTRHVLETIRKVIETAGGTMADVTFNSIFITDWKNYAAINEIYAEFFPGDKPARFYIQCGLVKPDALVEIATIAHIAK

SEQ ID NO: 23184 - protein, 516 aa, Zea mays
MASALSSLGPTALLICALLCTFLSSEVGFVRQATALGINYGQVANNLPPPAQVVQLLSSLRIGKVRIYDVNPQVLTAFAGTGIELVVTVPDDLVPGMASSASQALQWVSASLRPYFPATRVTGIAVGNEVFTGDDEQLKASLVPAMRNLHAALAQLGMDAYVRVSTANSLAVLATSYPPSQGVFTQAAAPYMAQLLRFLAETSSPFWGHAYPYFAYKDDPTKVSLDYALSNPSHVGAVDPFTKLQYTSMLYAQVDAVTFAAARLGYGGVPVHVSETGWPSKGDANEAGATVENARQYNRNLLMRQVSGEGTPLRPRLRLEVYLFALFNEDMKPGPASERNYGLYQPDMSMVYNVGLSQLATTSAASLSLATSPAARTTSSFSLVELHLTGNNAYASSFDAGCWEGLCRPPRRRICGHPAYHPTRIAPPVTAKSARPPTARPAEWPGFCGPKASKTKGETHRSNPRGDQEKPGKLVRSEKIYARRKKGGLRCLGELASPSQREESWLYSPCVDKPVV

SEQ ID NO: 23185 - protein, 274 aa, Pseudomonas putida GB-1
MDQYVVFGNPIGHSKSPLIHRLFAEQTGQDMEYATLLAPLDEFSDCARGFFKQGSGGNVTVPFKEEAYRLCDSLTPRAQRAGAVNTLSKLADGTLQGDNTDGAGLVRDLTVNAGVVLAGKRILILGAGGAVRGVLEPILAHKPQSLVIANRTVEKAEQLAREFDELGPVVASGFAWLQEPVDVIINATSASLAGEMPPIADSLVEAGRTVCYDMMYGKEPTPFCQWAADLGAAKVLDGLGMLAEQAAEAFFIWRGVRPDTAPVLAELRRQLARG

SEQ ID NO: 23186 - protein, 544 aa, Debaryomyces hansenii CBS767
MADYSSVKYRSGRIQTINAEQEIVLKQVWAHYLKYFGYEVNISSEDIKFKESFIPSTTTIEYGESTGELGFSNGLVKTNTRGSLNSNASLKSSTKKKGFFQKGHAEPPKIPAGSKRMRDIEAQCTTERYIPVIDASEEFKYMYYDYYKQGYESEDESGDDVSDMNSMDTFITASTSITDPGSYELVQGLGKQNVSAQSLGLAPRSFQLKPNTKIIPCLSRYKPEELHASLFKALRNDLFDNYLLRFVRARKFKYDEAIAMLSKSLDWRHNTLEADDFLLEGDAPSYMNGTNKGFIKNFTVGKCYTRGVDKQKNPIVLFKARLNYPSDSPLEGTKRYALVIIEWSRLNLKDISDSRDQCSVIFDLTGFSLKNNDLPAIKFLAEIFEAHFPEILGSILIHNAPWIFSTIWNLIKNWLDPVVASKIHFTKSTKDLNQFIDSDNLPESMGGKDPYAGEYPEPKAEDCHPPKPKDAVYRQLKKERDENLVKFLETTKRWIESTDSDVSARYLQDKIDLGTKIAQLYVDLDPYVRIPGIYDRNGSIDLSI

SEQ ID NO: 23187 - protein, 249 aa, Zea mays
  misc_feature (223)..(223): Xaa can be any naturally occurring amino acid
  misc_feature (235)..(235): Xaa can be any naturally occurring amino acid
  misc_feature (241)..(241): Xaa can be any naturally occurring amino acid
  unsure (1)..(249): unsure at all Xaa locations
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDVKEKLSYIAXLDYDQGMETSKXSSSVEXSYELPDGQ

SEQ ID NO: 23188 - protein, 454 aa, Saccharomyces monacensis
MSEPEFQQAYDEVVSSLEDSTLFEQHPKYKKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQFAALKVIELGGTVVSLSDSKGCIISETGITSEQIADISSAKVNFKSLEQIVGEYSTFTENKVQYISGARPWTHVQKVDIALPCATQNEVSGDEAKALVAQGVKFVAEGSNMGSTPEAIAVFETARATASTLKESVWYGPPKAANLGGVAVSGLEMAQNSQRITWSSERVDQELKKIMVNCFNECIDSAKKYTKEGNALPSLVKGANIASFIKVSDAMFDQGDVF

SEQ ID NO: 23189 - protein, 440 aa, Arabidopsis thaliana
  misc_feature (138)..(138): Xaa can be any naturally occurring amino acid
  misc_feature (349)..(349): Xaa can be any naturally occurring amino acid
  misc_feature (397)..(397): Xaa can be any naturally occurring amino acid
  misc_feature (408)..(408): Xaa can be any naturally occurring amino acid
  misc_feature (423)..(423): Xaa can be any naturally occurring amino acid
  unsure (1)..(440): unsure at all Xaa locations
MSSSGQTQFRYTQTPSKVVHLRNLPWECVEEELIDLCKRFGKIVNTKSNVGANRNQAFVEFADLNQAISMVSYYASSSEPAQIRGKTVYIQYSNRHEIVNNQSPGDVPGNVLLVTFEGVESHEVSIDVIHLMLMPLYXNLSGESLEIVSCSSFSYLCSIMPIIGQVFSAFGFVHKIATFEKAAGFQALVQFTDVETASAARSALDGRSIPRYLLSAHVGSCSLRMSYSAHTDLNIKFQSHRSRDYTNPYLPVNQTAMDGSMQPALGADGKKVESQSNVLLGLIENMQYAVTVDVLHTVFSAYGTVQKIAIFEKNGSTQALIQYSDIPTAAMAKEALEGHCIYDGGYCFXSDKSRDYTLPDLSLLVAQKGPAVSGSAPPAGWQNPQAQSQYSGYGGSXHICTHHLIPTXGFTLRSTSLLWMRYXCLLKISDFAANGEYFHV

SEQ ID NO: 23190 - protein, 275 aa, Bacillus subtilis
SELWYTEKQTKNFGITMKVNKTLHTEQTEFQHLEMVETEEFGNMLFLDGMVMTSEKDEFVYHEMVAHVPLFTHPNPEHVLVVGGGDGGVIREILKHPSVKKATLVDIDGKVIEYSKKFLPSIAGKLDDPRVDVQVDDGFMHIAKSENQYDVIMVDSTEPVGPAVNLFTKGFYAGIAKALKEDGIFVAQTDNPWFTPELITNVQRDVKEIFPITKLYTANIPTYPSGLWTFTIGSKKYDPLAVEDSRFFDIETKYYTKDIHKAAFVLPKFVSDLIK

SEQ ID NO: 23191 - protein, 447 aa, Mycobacterium tuberculosis H37Rv
MNELLHLAPNVWPRNTTRDEVGVVCIAGIPLTQLAQEYGTPLFVIDEDDFRSRCRETAAAFGSGANVHYAAKAFLCSEVARWISEEGLCLDVCTGGELAVALHASFPPERITLHGNNKSVSELTAAVKAGVGHIVVDSMTEIERLDAIAGEAGIVQDVLVRLTVGVEAHTHEFISTAHEDQKFGLSVASGAAMAAVRRVFATDHLRLVGLHSHIGSQIFDVDGFELAAHRVIGLLRDVVGEFGPEKTAQIATVDLGGGLGISYLPSDDPPPIAELAAKLGTIVSDESTAVGLPTPKLVVEPGRAIAGPGTITLYEVGTVKDVDVSATAHRRYVSVDGGMSDNIRTALYGAQYDVRLVSRVSDAPPVPARLVGKHCESGDIIVRDTWVPDDIRPGDLVAVAATGAYCYSLSSRYNMVGRPAVVAVHAGNARLVLRRETVDDLLSLEVR

SEQ ID NO: 23192 - protein, 609 aa, Saccharomyces uvarum
MPLSEDFGSSGKKEASPDSISIRSFSAVNNLQSSSSEKNYSGQTTRNNKLIHRFVDSFKRAEGSTTHTKQINENTSDLEGDVNSFTSDSKLKKSMKSRHVVMMTLGTGIGTGLLVANAKGLHYGGPAALVIGYFLVSFVTYFMIQAAGEMAVTYPTLPANFNAYSSIFISKPFGFATVWVYCFQWLTVLPLELITAAMTIKFWNDTINPDIFILIFFVFLLFIHFFGVKGYGETEFIFNCCKILMIAGFIILSVVINCGGAGNDGYIGGKYWRNPGAFAGDTSAGRFKNVCYILVTAYFSFGGMELFALSVQEQANPRKTTPVAAKRSIYRILVIYLLTMILIGFNVPYNDDQLMGAGGSATHASPYVLAASIHGVKVVPHIINAVILISVISVANSSLYAGPRLMCSLAQQGYGPKFLDYVDREGRPLIALIVCSVFGVIGFVAASSKEEVVFAWLAAIAGLSELFTWTSIMLSHLRFRQAMKVQGRSLDELGYKATTGIWGSAYGVFFNILVFIAQFWVALAPLNNGGKCSAESFFQSYLAFPIWIAFYLGYMIYNRDFTFLNPLDKIDLDFHRHIYDPELMRQEDLENEERKRDMSLMRKTYLFWC

SEQ ID NO: 23193 - protein, 273 aa, Datura stramonium
MEESKVSMMNCNNEGRWSLKGTTALVTGGSKGIGYAIVEELAGLGARVYTCSRNEKELDECLEIWREKGLNVEGSVCDLLSRTERDKLMQTVAHVFDGKLNILVNNAGVVIHKEAKDFTEKDYNIIMGTNFEAAYHLSQIAYPLLKASQNGNVIFLSSIAGFSALPSVSLYSASKGAINQMTKSLACEWAKDNIRVNSVAPGVILTPLVETAIKKNPHQKEEIDNFIVKTPMGRAGKPQEVSALIAFLCFPAASYITGQIIWADGGFTANGGF

SEQ ID NO: 23194 - protein, 118 aa, Glycine max
  misc_feature (8)..(9): Xaa can be any naturally occurring amino acid
  misc_feature (73)..(73): Xaa can be any naturally occurring amino acid
  misc_feature (106)..(106): Xaa can be any naturally occurring amino acid
  unsure (1)..(118): unsure at all Xaa locations
MASTTFRXXGVAAAAAAFIALAAFGSASASKTAFVKSTVKAHDVVIFSKSYCPYCKRAKAVFKELELKKDPYXVELDQREDGGDIQDALSDMVGRRTVPQVFIRGXHLGGSDDIVDAY

SEQ ID NO: 23195 - protein, 260 aa, Datura stramonium
MAGRWNLEGCTALVTGGSRGIGYGIVEELASLGASVYTCSRNQKELNDCLTQWRSKGFKVEASVCDLSSRSERQELMNTVANHFHGKLNILVNNAGIVIYKEAKDYTVEDYSLIMSINFEAAYHLSVLAHPFLKASERGNVVFISSVSGALAVPYEAVYGATKGAMDQLTRCLAFEWAKDNIRVNGVGPGVIATSLVEMTIQDPEQKENLNKLIDRCALRRMGEPKELAAMVAFLCFPAASYVTGQIIYVDGGLMANCGF

SEQ ID NO: 23196 - protein, 260 aa, Hyoscyamus niger
MAGRWNLEGCTALVTGGSRGIGYGIVEELANLGASVYTCSRNQKELDECLTQWRSKGFNVEASVCDLSSRSEREEFMKTVSNHFHGKLNILVNNAGIVIYKEAKDYTMEDYSHIMSINFEAAYHLSVLAHPFLKASERGNVVFISSISGASALPYEAVYGATKGAMDQLTRCLAFEWAKDNIRVNGVGPGVIATSMVEMTIQDPEQKENLDKLIDRCALRRMGEPKELAAVVAFLCFPAASYVTGQIIYVDGGFMANGGF

SEQ ID NO: 23197 - protein, 268 aa, Datura stramonium
MAGREIGGGDRRWSLRGMTALVTGGTRGIGYAIVEELANFGAEVYTCSRSQNDLDECLEKWRRKGFKVSGPVCDVSSISQRQTLMESVTSSFNGKLNILINNAGTTIPKEATNFTAEDYSIIMGTNFEASYNLCQLAHPLLKASGNASIVFNSSAAGVIAVPLSSIYAASKGAINQVTKSLACEWAKDSIRVNAVAPWIINTPIIEAACQVPSQKKNIESLIGRAPMKRAGEPSEVSSLVTYLCLPTASYITGQIICVDGGYTVNGFI

SEQ ID NO: 23198 - protein, 414 aa, Idiomarina loihiensis L2TR
MTDFRQQALDYHEYPTPGKISVELTTPAETSKDLALAYSPGVAEPVREIAQDPDAAYRYTAKGNMVAVITNGTAILGLGNLGPLASKPVMEGKALLFKRFAGLDSIDIEVNHRTTQDFINTVANIADTFGGINLEDIKAPECFEIEQALIERCNVPVFHDDQHGTAIVTAAGMLNALEIQGKNLAESRIVCLGAGAAAIACMELLIKCGAQREHIYMLDSKGVIHTRRDDLNEYKQLFANNTDKRTLKDVIEGADIFVGVSGPNLLSAEELKLMAPNPVLFACSNPDPEIKPETAMAARDDLIMGTGRSDYPNQVNNVLCFPFMFRGALDVRATAINDEMKVAAVEAIRQLAKEPVPESVLKAAGVKELTFGRDYIIPKPIDPRLCPRVSRAVAEAAVKSGAAKIDLPKNYMQD

SEQ ID NO: 23199 - protein, 406 aa, Xanthobacter autotrophicus Py2
MSVAQKPAPKFIPKDPLTLHPETRLVHGGTTRSPYGETSEALFLTQGFVYDNAESCEARFKGEDPGFVYSRYGNPTTAMFEERMALLEGAEAARATASGMAAVNAALLCQLSAGDHVVAARALFGSCRWILEDFLPRFGIETTLVDGTDLAAWQAAARPSTKVFFLESPTNPTLELIDIAAVAQIAHAAGARLVVDNVFATPLLQHPFELGADIVVYSTTKHVDGQGRCLGGVILSSQQFVTDHLQTFLRQTGPSISPFNAWIMLKGLETLALRVERMQASAGRIADALAGLPKIETVLYPGRADHPQAELARRQMKGGGTLVTFVVEGGKEGAFRFANALGLIRISNNLGDAKSLITHPATTTHQRFTPEARAEMGISDGLLRLSVGLEHPDDLIADLATAAGAL

SEQ ID NO: 23200 - protein, 463 aa, Pseudomonas fluorescens PfO-1
MSSTQSSNGLEQGLKPRHVTMLSIAGVIGAGLFVGSGHAIAAAGPAVLLAYAAAGALVVLVMRMLGEMAVASPDTGSFSTYADRAIGHWAGFTIGWLYWWFWVLVIPLEANAAATILHAWFPGVDIWAFALIITMLLTVTNLFSVKNYGEFEFWFALLKVVAIIGFIILGVAAIFGFLPNSQVSGVSHIFDTQGFLPNGMGAVLGAILTTMFSFMGTEIVTIAAAESKNPGKQISKATNSVIWRIGLFYLVSIFIVVALVPWNDPVLASVGSYQTVLERMGIPNAKMIVDIVVLVAVTSCLNSALYTSSRMLFSLGKRGDAPVMSTRTNKSGTPYWAVMLSTGAAFLCTFANYVAPAAVFEFLLASSGAIALLVYLVIAISQLRMRKQRMARGEKIVFSMWLFPGLTYAVIAFIVAALTIMLFQDAHRVEILATGLLSLVVVATGLLVARRRKMENRGAAVLN

SEQ ID NO: 23201 - protein, 687 aa, Alteromonadales bacterium TW-7
MSNQFEVTHGLVEPLGSSLHLNGVNFSLYAPKATQAYVCLFDKSGHSEILKVAMNINEGGIWSIHIAPLNTGALYGFRVEGEYNPDNGLLFNEHKLLIDPYGKDLFGEFTWSERHYGQMPIGTKSTVNNAIDIPKSKVSSIDLYEHKKPNHRWSKTVIYECHVKGTTCRYPKIPKTLQGKFLGLSHPHFIDHLKSFGVTAIELLPVHAFISEQFLTGKGLQNYWGYNTLNFFTPHKDYLVNDDINEFKQMVKELHAADIEVILDVVYNHTAEAGNDGPILSLRGLDNLAYYRTVEAQPSVYINDTGCGNTINIDHPKTLQLVLDSLRYWVEVMGVDGFRFDLATILGRSKAGFSSAHTFLQTIAQDPVLNKVKLISEPWDIGPGGYQLGAFPPPWREWNDQYRDVIRRFWKGDEGIIANVAKRLHGSFDIFEHSHRGPLNSINFITSHDGFTLADLVSYEHKHNEANGENNRDGHSANYSFNCGAEGFSTDEKIAALRLQQQKNFLLTLILSKGVPMIAAGSEMAHSQGGNNNAYCQNNRTSWLAWKDSQLNHSLTRFIDDALKIRRAHSAFKHSVFLDDIDERFTVKWFTETGDTMTDSHWHENSRQFLMYSLLDKQNKHALLIVFNANKKSVSCQLPPSPINASWQMVLSSVNNASLTTHQDVPVEISAQSSWVFSANLEDVANG

SEQ ID NO: 23202 - protein, 275 aa, Zea mays
  misc_feature (201)..(201): Xaa can be any naturally occurring amino acid
  misc_feature (223)..(223): Xaa can be any naturally occurring amino acid
  misc_feature (239)..(239): Xaa can be any naturally occurring amino acid
  unsure (1)..(275): unsure at all Xaa locations
SESESEAASLRPGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLKEGAMCEPLSVGVHACRRAGVGPQNGXCLVVGARPIGLVSLLAARAFAXTRGGVDVDNHALARAXSLGAEPALRVSPPPEDLAAKLNASPRPGLGIHATLD

SEQ ID NO: 23203 - protein, 433 aa, Alteromonadales bacterium TW-7
MPNYANRYISSLTRETYALILAGGRGSRLHELTDWRAKPAVYFGGKHRIIDFPLSNCINSGVRRVGIATQYKSHSLIRHVNRAWGHFKKELGESVEILPASQRHGDEWYCGTADAVFQNMDIIRHELPKYVMILSGDHVYRMDYGALLAEHVQKGADMTVCCIEVPVEEAADTFGVMTVDEESRVCRFDEKPAMPSSVPGKPGTCLASMGNYIFNTEFLFEQLKKDAENEGSGRDFGHDIIPAIIEEHNVFAFPFRDPQQEGQPYWRDVGTLDSFWEANMELVMPEPQLDLYDPAWPIWTYQEQLPPAKFIFDDDDRRGMALDSTVSGGCIISGSAVRKSLLFSNVHVRSFCEIEQSVILPGAIINRGCKIKRAIIDRSCEIPAGLEIGFDRKTDEENGFRVSKKGIVLVTRDMLSELAKKLERQTQENKKLA

SEQ ID NO: 23204 - protein, 436 aa, Pseudomonas putida GB-1
MNPRLAAARALAAVLSGKASLNSSLPAQLDKVDERDRGLTQDLAFGTARWQPRLDLLAAQLLQKPFKAADADVQALLLVGLYQLFYTRIPAHAAIGETVGCADKLKKPWAKGLLNAVLRRAQREGEELLASMERDPVVRTAHPRWLQKALKAFWPAQWEAICAANNAHPPMILRVNRRHHSRDAYLALLAEAGIGASACQYSRDGIVLAEACDVRGLPGFAEGWVSVQDEAAQLSADLLELAPGQRVLDACCAPGGKTCHLLEAEAGLAHVVAIDLEAKRLIRVRENLDRLKLDAELIACDARDTASWWDGKPFQRILLDAPCSATGVIRRHPDIKLTRQADDIPALAALQGELLDALWPTLEVGGMLLYATCSSLPTENTEVIDAFLARTPGARELDLATEAGLRQPHGRQLLAQEGGHDGFYYAKLIKIAASRG

SEQ ID NO: 23205 - protein, 164 aa, Glycine max
FGSSKVSDVELDQISLLPNAEYLLTSFLSIWEKADLIKVSDVELEFLTGSDKIDDESALSLWHPNLKLLLVTLGEHGSRYYTENFKGSVDAFHVNTVDTTGAGDSFVGALLSKIVDDQSILEDEPRLREVLKYANACGAITTTQKGAIPALPKEEDALKLIKGA

SEQ ID NO: 23206 - protein, 267 aa, Dechloromonas aromatica RCB
MAPMKPHSASIDAALDAVAEQLRHARSALFITGAGISVDSGLPTYRGVGGLYDSETTEEGLRIEDALSGEVFSMRPDITWKYLIQIEENCRGAQPNAAHRAIACLERHLDRVMVFTQNVDGLHRAAGSHEIVEIHGNLQELMCTACSHEEAATDMSEREVPPLCPACGAVLRPKVVLFGEALPEDELDRFIEAFQEGFDIVFSIGTSSIFPYIVQPVVLAAASGIPTVEINPARTKLSDTVDYYLPLGAAEAMSGIVERLGLDPDDC

SEQ ID NO: 23207 - protein, 545 aa, Azoarcus sp. EbN1
MTEPFTPPHRLSAWSTLENHAARLRTMRIAELFEHDAARFATLSFGHRGLLLDLSKQSIDAPALAALVDLAGQARLPDGIEALFAGEHLNFTEDRAVLHMALRGACAAPLEDAATLAQSQQRMRAFTVALRSGTMTGATGKPIRLVVNLGIGGSDLGPRMAAQALVPTGLRATPEVRFVANIDRRELDEALADADPASTLFVVSSKSFATAETLANAQAARAWLQAGLGAGCDPALHFTAVSNATDAAAAFGIPAERVFPLPEWVGGRYSVWSTIGLPLMIAIGASEFDAFLAGARAMDEHFRTAPPGENLPVLMGLAGLWNTDFLGIESLALLPYAHGLRSFAAWLQQLEMESNGKRCLRDGSGSVIHTSPIVWGGVGTVGQHAFHQLFYQGTRRVALDFIVPVAAADDVSQRSLVENAFAQSAALMSGRDLDTALASLRAKGLAESEAAVLAPHLVCPGNQPSTTVLLPALDAFSLGQLMALYEHKVFVQGWIWGINSFDQYGVELGKEMARSLSAGSGENHDASTAGLMAAAEAMRRTPDRS

SEQ ID NO: 23208 - protein, 417 aa, Oceanobacter sp. RED65
MTDVFDYQNGELFAEQCAVSDLADRYGSPLYIYSRKAFSEHYLEYANAFKNEDALICYAVKANSNIAVLNVLAKLGAGFDIVSVGELERVLKAGGDPSKIVFSGVAKTADEMRRALAVGVHCFNVESESELERLNAVAEEMGVKAPLSLRVNPDVDAQTHPYISTGLKENKFGVDIDTAKQVYAKAKGMQGIEIKGVDCHIGSQLTQLEPFMDALDRVLVLVDELKEQAIELEHIDLGGGLGVTYDDEVPPTPQEFADAVLPKLAGRNLKLVLEPGRSIAANAGIFVTQVEFLKSNGDKHFAIIDGGMNDLIRPSLYSAWQRIVEVQPREKTPKQNYDVVGPVCETGDFLGKDRELAILPGDLLAVKSAGAYGFVMASNYNTRNKPAEVMVDGDQSHLIRRRETISDQLMLEALIQD

SEQ ID NO: 23209 - protein, 382 aa, Mycobacterium sp. JLS
MRDHQVVVIGAGPSGVAAALSLRDRGLRPVLIDRADHVGSSWKARYDRLKLNTGRRTSHMPNRPYPDGTGVFPTRDQVVAHLDRHAHEDGIELLLETTVTRIDRHPAGWCLSTSTGDLTARQVVVATGYEHSPRIPEWPGMRSYPGEVSHSAQYRNPRPYTGRRVLVVGAGSSAMEIVHDVATGGAESAWLAVRTVPHIMIRSLPGGFPSDYLATPLFDAPTWLADAVSRVGQRIDVGDLAEYGLPTPSEGVFARGKRLGRAPVIVDREVVRAIRARVFEVVPTVARFDGATVELVDGRRLRPDAVICATGYTRGLDAMVGHLGVLDDKGLPRSCGVAAAAPGLRFVGFLSRPGLISYVAKQSQHVARHIADELDRTPTLIR

SEQ ID NO: 23210 - protein, 94 aa, Brassica napus
LQILATGALGGRFDHEAGNLNVLYRYPDTRIILLSDDCLIQLLPKTHRHEIRIQPSLQGPHCGLIPIGAPSAKTTTTGLQWDLSKLHQTDLSVV

SEQ ID NO: 23211 - protein, 247 aa, Zea mays
MRVAATRTAAAAAAHPPSAFLLLLVLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKQGGHEPGWREVPVEDPVVKDAAHHAVKSIQERSNSLFPYELLEILRAHAQVVEDFAKFDILMKLKRGSKEEKIKAEVHKSLEGAFVLNQHQPAEHDESSSQ

SEQ ID NO: 23212 - protein, 389 aa, Streptococcus pneumoniae R6
MDLTKRFNKQLDKIQVSLIRQFDQVISEIPGVLRLTLGEPDFTTPDHVKEAAKRAIDQNQSYYTGMSGLLTLRQAASDFVKEKYQLDYAPENEILVTIGATEALSATLTAILEEGDKVLLPAPAYPGYEPIVNLVGAEIVEIDTTENGFVLTPEMLEKAILEQGDKLKAVILNYPANPTGITYSREQLEALAAVLRKYEIFVVCDEVYSELTYTGEAHVSLGTMLRDQAIIINGLSKSHAMTGWRLGLIFAPATFTAQLIKSHQYLVTAANTMAQHAAVEALTAGKNDAEPMKKEYIQRRDYIIEKMTALGFEIIKPDGAFYIFAKIPAGYNQDSFAFLKDFAQKKAVAFIPGAAFGRYGEGYVRLSYAASMETIKEAMKRLEEYMREA

SEQ ID NO: 23213 - protein, 367 aa, Caulobacter crescentus CB15
MTSPKQSDLLILGLETSCDETAASVVRRAADGTVTVLSSVIGTQFEKHAPFGGVVPEIAARAHVESIDAIAAEAVRAAGVGFGDLDGVAATAGPGLVGGVMVGLAFGKAVALARGAPLVAVNHLEGHAVSARLGADIAYPFLLLLVSGGHCQLLEVSGVGACKRLGTTIDDAAGEAFDKIAKSLGLPYPGGPALEKLAVGGDPTRYALPRALLGRKDCDFSFSGLKTAAARIAETLTTDDARRDLAAGVQAAIARQLSERVDRAMKLYKDSHDPEDLRFVVAGGVAANGAVRAALLADCEKNGFSFAAPPLAYCTDNAAMIALAGAERLALGIFDDLDAIARPRWPLDEAAALANPANAYGRKGAKA

SEQ ID NO: 23214 - protein, 459 aa, Glycine max
SKCKWIYASIAGLGSMLSSSITSSTSISLMSTMATSLLSVKTFSLSELEKATDKFSSKRVLGEGGFGRVYSGTLEDGAEIAVKMLTRDNHQNGDREFIAEVEMLSRLHHRNLVKLIGICIEGRRRCLVYELVRNGSVESHLHGDDKIKGMLDWEARMKIALGAARGLAYLHEDSNPRVIHRDFKASNVLLEDDFTPKVSDFGLAREATEGSNHISTRVMGTFGYVAPEYAMTGHLLVKSDVYSYGVVLLELLTGRKPVDMSQPQGQENLVTWARPMLTSREGVEQLVDPSLAGSYNFDDMAKVAAIASMCVHSEVTQRPFMGEVVQALKLIYNDTDETCGDYCSQKDSSAQESDFRGDLAPSDSSWWNAGGLTPRITYGQASSFITMEYSSGPLEEMENRPFSTSSLIGDEISLPIRHGNRSGPLRTVRNKLSLYRFTGSRSEHGGPSSKPNWNDGYWV

SEQ ID NO: 23215 - protein, 307 aa, Porphyra yezoensis
MAFITSGAAAVSGASLTARRAFTGAAVCPVPSGRTSPAAATWSMSAGGLRTFLVGGNWKCNLSKDAITSLCKELAAAPDLETDKVEVVLAPPTPYLDHTRSVLRQDFEVAAQNIWVGGPGAYTGETAAEMIKDVGCTWVILGHSERRNLLQIRESDDFIAQKTKTALSHGLKVMFCIGETLEEREEGRTLDVCVRQLHALAETIGADDWKDVVIAYEPVWAIGTGKIATPDQVEEVHEKIRHYLAGDVNDKVAQETRILYGGSVSPGNCNELAQLPDVDGFLVGGASLKASFLEVIESFKSDLAATV

SEQ ID NO: 23216 - protein, 367 aa, Oryza sativa (japonica cultivar-group)
MAMERLISSPLLPRRPPRAAFSRPPPSLAAAPPHHRAGGAASGYGSRPPLASLLLSRHHHHHQPPVLAANPAADVAAGEAVPPATATASRRFLQKVASAAAATLLATIALTLIQPAWAPPALASFHSAAKAGGGIFKSELLSSAWTGFLAGCLHTLSGPDHLAALAPLSIGRSRVESAAVGALWGCGHDAGQVIFGLLFLSLKDRLHIEVIRTWGTRVVGLTLLVIGALGIREATEVPTPCVALENGGGGGGAHRGPLDALPATRKKITFATFATGIVHGLQPDALMMVLPALALPSRVAGAAFLGMFLVGTVVAMGSYTVLIGSCTEALKERVPRITEKLTWAASLVAISMGLGILISQSLGFSLY

SEQ ID NO: 23217 - protein, 577 aa, Pyrobaculum aerophilum str. IM2
MSVQIFEKYIKNRVWTKNYDESVPPEVEIRPSPLFSYLDRQAGENAGRTAYIYFGNKIPYKAVGEHSDRIAAALREWGIGKGDVVALYMPNTPAFPVIYYGALKLGAVVTPMNPLYTPREVAWQAKDANARVIFVADVLYKNIEEAAKMYQFDRIVVVELVEYMPALIKPLAKRRIKPPKVAYSGRVIPYKSLLSYSPTSYRASINPSEDLAALMYTGGTTGLPKGAEITHGNISANLQQLKPLYDVVKKKRGLDSLVMMGLLPWYHIYGQVTVMHYGIFDGATVVVMPRPDIEQLMKWVQKYNVQVLHGVPTLYNMIINHPRAGQFNLKSLAFCISGAAPLPVEVARKFEQLTGALLREGYGLTETAVVTHVNPLYGKVKPGSIGLPIPSTYAAIADPAKPELLPPNQVGEIVISGPQVFKGYHNRPEENAQAFFECCGLRWFRTGDMGYMDEEGYFYVVDRKKDLIKYKGYSVFSREIEEVLYQHPCVKEAAVIGVPHPEAGEIPKAFIVLRDECKGKVRPEDIIKWTEDKLAHYKRPRAVEFREELPKSAVGKILKRELKAEELRKLQEAAQKT

SEQ ID NO: 23218 - protein, 136 aa, Oryza sativa
MAALLGRRFGMAAAALIALAALGSAASGTASKSSFVKSTVKAHDVVIFSKSYCPYCRRAKAVFKELELKKEPYVVELDQREDGWEIQDALSDMVGRRTVPQVFVHGKHLGGSDDTVEAYESGKLAKLLNIDVKEDL

SEQ ID NO: 23219 - protein, 282 aa, Chlamydomonas reinhardtii
MQLCKVQRASAARSSRASRSQRVEVVCASSAKFFVGGNWKCNGSVANVAKLVDELNAGTIPRGVDVVVAPPFIYIDYVMQHLDRDKYQLSAQNAWIGGNGAFTGEVSAEQLTDFGVPWVILGHSERRSLFGESNEVVAKKTSHALAAGLGVIACIGETLEQRNSGSVFKVLDAQMDALVDEVKDWTKVVLAYEPVWAIGTGVVASPEQAQEVHAYLRQYCAKKLGAAVADKLRIIYGGSVSDTNCKDLSKQEDIDGFLVGGASLKGAAFVTICNAAGPKAKP

SEQ ID NO: 23220 - protein, 221 aa, Methanocaldococcus jannaschii DSM 2661
MHLVGVLDIAKDILKANKRLADKNRKLLNKHGVVAFDFMGAIGSGKTLLIEKLIDNLKDKYKIACIAGDVIAKFDAERMEKHGAKVVPLNTGKECHLDAHLVGHALEDLNLDEIDLLFIENVGNLICPADFDLGTHKRIVVISTTEGDDTIEKHPGIMKTADLIVINKIDLADAVGADIKKMENDAKRINPDAEVVLLSLKTMEGFDKVLEFIEKSVKEVK

SEQ ID NO: 23221 - protein, 589 aa, Glycine max
MKSSLILLFMICGGVIATPPEDPIRCSSKNTDCTITNTYGVFPDRSICHAGEVMYPNTEEELISAVASASKNKRKVKAATRFSHSIPKLVCPDGENGLLISTKNLNKILKIDKEARTMTVQSGVSLREIISKGAEAGLALPYTPYWWGLTIGGLMGTGAHGSTLWGKGSAVHEYVVELRIVTPAGRLEGYAKVRNLDESHQQHLNAARVSLGVLGVISQVTLKLEPLFKRSLTYLTKDDSDLGDELVTFGRKHEFADVTWYPSQQKAVYRIDDRVSINKSGNGLYDFFPFRPTLSAALTVVRATEELQEATRDANGKCVGAKLITATLSGIGYGLSNNDDKGIFLGYPIVGFSNRMQASGTCLDSLNDGLITACPWDSRIKGEFFHQTAFSIPLSAVKNFIEDVQKLVELEPKSLCGLETANGILMRYVTASSAYLGKSEDAVDFDITYYRSKDPLAPRLFQDILEEIEQIGLFKYGGLPHWGKNRNLAFLGAIKKYHNADKFLKVKEEYDPQGLFSSLWTDQMLGLQEGVTILKDGCAMEGMCICSQDSHCAPKKGYFCRPGRIYKEARVCTRDVKKTKEADDVKDEL

SEQ ID NO: 23222 - protein, 331 aa, Gloeobacter violaceus PCC 7421
MNTVAQVLRPAVERSEALALYRDMVLGRTFEDTCAQMYYRGKLFGFVHLYNGQEAVSTGIIKALRPDDYVTSTYRDHVHALSKGVSARSVMAELFGKATGCSKGRGGSMHLFSAEHNFLGGFAFIGEGIPIACGAAFTAKYQGTDRVSASFFGDGTTNNGQFFECLNMAALWKLPILFVVENNLWSIGMYHPRASSVVEIYKKADAFGIPGVRVDGMDVLAVRAVAKEAVERARTGGGPTLIECTTYRFRGHSLADPDELRDPAEKAHWRKQDPLPRLRVWLEEQGLASVEDLKRIEQEVRAEVDDAVQFAEDSPEPPLDELYRFQFAEDD

SEQ ID NO: 23223 - protein, 153 aa, Zea mays
  misc_feature (39)..(39): Xaa can be any naturally occurring amino acid
  misc_feature (51)..(51): Xaa can be any naturally occurring amino acid
  misc_feature (65)..(65): Xaa can be any naturally occurring amino acid
  unsure (1)..(153): unsure at all Xaa locations
MSGRGKVEKGLDKVGAKCHRKVLRDNIQGITKPAIHKLXRRGGVKRISGLXIYEETRGVLQDLPXNVIRDSDTYTENARHKSVTAMDVCYSLKYQGHTLYGFRRVSRPHTLRGELSWLRSTMGYELCACSSMRCLYPRCFLWNMCCITPVSNT

SEQ ID NO: 23224 - protein, 255 aa, Euglena longa
MPRKFFVGGNWKRNGTRDTISKIVEEFNKGPSVADADVEVVIGVPFVYADFTQEKLRKDWKLSVQNCWIGKGGAFTGEVSAEMIKDAGIPWVILGHSERRHLPELKESDETVAIKVAYALANGLKVMACIGELLEEREKGQTQAVNERQLKAIAAKLKEEDWKNVVIAYEPVWAIGTGKVATPEQAQEVHEQVRAWVASNVSPSVAAEVRILYGGSVTAKNSVELAGKPDVDGFLVGGASLKPEFLDIVAAYKHK

SEQ ID NO: 23225 - protein, 327 aa, Gloeobacter violaceus PCC 7421
MPVKLFYEALKDAMAEEMRRDPNVYVLGEDVGHYGGSYKATKDLYKEFGELRLLDTPICENAFTGLAVGSAMTGLRPIIEGMNMGFLLLAFNQIANNGGMLRYTSGGQFKIPMVVRGPGGVGKQLGAEHSQRLEGYFNNVPGLKIVHTSTVYNAKGLLKAAIRDDNPVMFFEHVLLYNLKEDIPEEEYLLPLDKAEMVKEGRDVTVLTYGRMRHHCTEALQELAARDIDVEVIDLISLKPLDLETIGRSLKKTHRVVIVEEDMKSGGVGAEIVASIDEHYFDYLDAPVLRLASKDVPVPYNGRMEATVIPQPQDIVRAVEEMALRAH

SEQ ID NO: 23226 - protein, 401 aa, Kluyvera ascorbata
MADSSPERRFTRIDRLPPYVFNITAELKMAARRRGEDIIDFSMGNPDGATPPHIVEKLCTVAQRPDTHGYSTSRGIPRLRRAISRWYQERYDVEIDPEDEAIVTIGSKEGLAHLMLATLDHGDTVLVPNPSYPIHIYGAVIAGAQVRSVPLVEGVDFFNELERAIRESYPKPKMMILGFPSNPTAQCVELEFFEKVVALAKRYDVLVVHDLAYADIVFDGWKAPSIMQVPGARDVAVEFFTLSKSYNMAGWRIGFMVGNKTLVNALARIKSYHDYGTFTPLQVAAIAALEGDQQCVLDIAAQYKRRRDVLVKGLHEAGWMVDMPKASMYVWAKIPEQYAHMGSLEFAKKMLQDAKVCVSPGIGFGDYGDTHVRFALIENRDRIRQAIRGIKAMFRADGLLP

SEQ ID NO: 23227 - protein, 197 aa, Pseudomonas fluorescens PfO-1
MAERKASVERDTLETQIKASINLDGTGKARFNIGVPFLEHMLDQIARHGLIDLDIECKGDLHIDDHHTVEDVGITLGQAFAQAIGDKKGIRRYGHAYVPLDEALSRVVIDFSGRPGLQMHVPYTRATVGGFDVDLFQEFFQGFVNHALVSLHIDNLRGTNTHHQIETVFKAFGRALRMAVELDERMAGQMPSTKGVL

SEQ ID NO: 23228 - protein, 391 aa, Arabidopsis thaliana
MTMMFDLTQDLVKEILSRVPITSLGAVRSTCKGWNALSKDRILCKAKPKQQFHQGFMLSDYRLRSMRFNISGTFKENGEEFVNLSVKEIGNFLNKVEISHMYYCGGILLCVTTDTRLVIWNPYLGQIRWIQLKTETMYSTFCLRYDNNKNHKILRFLDNKQGSYEIYDLKSYSWRAFDVIPKWDIDDDGQSASVKGNTYFRTIDETPNLLICFDFTAERFGKLLDPPFQHGWMSLSWVREEKLVALYQHLDTSMIEIWITTKIEPNALSWTSFLKCYIEQLIALDFWFDIDYNNFFIDEEKKLAVVIDKVESEDCKRSNSHINSYIIGDDGYLKKMNSLGNTARSYTAIMLSSCYVSSLVQIDDPIARRRRRERNSKRKEKKRKGTTNNKV

SEQ ID NO: 23229 - protein, 356 aa, Euglena longa
MGYYTVTTQVQENYVQSWYKGKLAPFVGGCLLATCLSLSFSGETAQQNYAVSAKPAVHAIPLTAMGVGTRSGVPQTAAQKRFPSRSSALQMAAAVWAPSAKMPRKFIVGGNWKCNGDRPSINALVQALNTGESAIGSGVEVVVAPPMLYGDYARGLLRPDFGVAFQNCWTGGNGAFTGEVSANMIKDAGFDWVILGHSERRSLPEIMETDATVATKTAYALKAGLKVILCIGETLDARQSGKTDEVNARQLAAVAEKVSDWSNIVIAYEPVWAIGTGVVATPEQAQETHAQIRKWLAENLSPQVAQQMRIMYGGSANAANADSLAKQPDVDGFLVGGASLKPEFLKIAESWKSKVE

SEQ ID NO: 23230 - protein, 309 aa, Thermus thermophilus HB27
MLEVVTAGEPLVALVPQEPGHLRGKRLLEVYVGGAEVNVAVALARLGVKVGFVGRVGEDELGAMVEERLRAEGVDLTHFRRAPGFTGLYLREYLPLGQGRVFYYRKGSAGSALAPGAFDPDYLEGVRFLHLSGITPALSPEARAFSLWAMEEAKRRGVRVSLDVNYRQTLWPPEEARGFLERALPGVDLLFLSEEEAELLFGRVEEALRALSAPEVVLKRGAKGAWAFVDGRRAEGSAFVVEAVDPVGAGDAFAAGYLAGAVWGLPVEERLRLANLLGASVAASRGDHEGAPYREDLEVLLKATQTFMR

SEQ ID NO: 23231 - protein, 681 aa, Coccidioides immitis RS
MLFFAHELVPEGKYTVPLLFTLTSEVGINLASTQKSGMEFYRSSEELDPSSDSAKAYASTSYEDHLSRRELSFVTSHREPLSAAERARRNINAKLANPLAGLSHAALRGRGERYARKHQIGDEEDIRAFAMGAVLAQDPKHYENMEGLTEEELEVLRHEFTHKWSQPKLLYLVIVLCSVSAAVQGMVNGAQIFYKAQFGINDDDYRSTWLSGLTNSAPYLCCALIGCWLTVPFNHVFGRRGTIFITCCFSAITCFWQGFVNTWWHMFVARFALGFGIGPKSATVPIYAAETTPPAIRGALVMQWQMWTAFGIMLGYASDIIFFKVPDPPGVVGLGWRLMMGSAMFPAVLVCFMVFLCPESPRWYISKDAHHKAYMSMCRLRFNKIQAARDLFYMHTLLEAESTMKLGQPKIVELITVPRNRRAMLASEIVMFMQQFCGVNVIAYYSSEVFLEAGFSQISALAASLGFGMINWLFAIPAVYTIDTFGRRNLLLLTFPLMGIFLLLTGFSFWIPSDTAPRARLGCVALGIYLFGIVYSPGEGPVPFTYSAEAYPLYVRAYGMALATSTTWFFNWMLAITWPSLVRAFSPQGAFSWYAGWNIIGFVLILLFLPETKGKTLEELDQVFSVPTHLHAKWALKHLVSVFRRYILFQKYVKVEEFGKEQENQARGMSMSTVERRLDIE

SEQ ID NO: 23232 - protein, 530 aa, Chlamydophila abortus
MDRKGFLDSPSTKILQDLAVAPVDLTTPGIISQERVERFSLSIGGFTLSYATERVDEGVVSALTDLASERGLVSSMQAMQSGEVVNYIDNFPSESRPALHTATRAWVKEIPLTGNAEDIALRSKIEAQRLKDFLHQYRDAFTTIVQIGIGGSELGPKALHRALKGCCPSDKKVYFVSNIDPDNAAEVLQEIDCSKTLVVTVSKSGTTLETAVNEEFIADHFLKQGLHFRDHFIAVTCEGSPMDDRSKYLEVFHIWDSIGGRYSSTSMVGGVVLGFAYGFDVFFQLLEGAAAMDLAALAPQMSENLPMLAAMLGIWNRNFLGYPTSVIVPYSAGLEYFPAHLQQCGMESNGKSIAQTGEIIGFATSPILWGEVGTNSQHSFFQCLHQGSDVIPIEFIGFLDNQRGRDIVISGSTSSQKLFANMVAQSIALAKGRENTNPNKSFRGNRPSSLLVAERLTPYTMGALLAFYEHKIVFQGFCWGINSFDQEGVTLGKDLANQVLGIMQGQAKEGACLEAEALLKLFNSTQKKKS

SEQ ID NO: 23233 - protein, 302 aa, Coprinopsis cinerea okayama7#130
MSRHEHPIQRMLTANAQWAEDVQRAEPSFFEQSAKGQSPHTLWIGCADSRVPDSIVTGSKPGEIFVHRNIANQLKLDDYNALSVLRYAVDYLGVEHVVVVGHTECGGAAACLAAAQDVNLDLDKPIATVGSLPPDSSLNRWLEPLTRLAVSLELSSTPHEEALPLVVEENVKMQVENLAKTHAITEAWTKGTRKGQDVWIHGWVYDISTGKLRDLNVSRGPPPKKPLAETPVCAEPEEYIPVDEPVYGQPSDYIHVDNALPYYYEEPEEYNPIKAGPAHYGVSEEYAQVDKPPKAGPIQVFA

SEQ ID NO: 23234 - protein, 549 aa, Haemophilus influenzae 86-028NP
MKNINPTHTQAWKSLEAHKAELSNTTIQDLFKQEKNRFDDYSLTFNNQILVDFSKNNINQTTLSHLRQLAQECALDSAKEAMFTGEKINRTENRAVLHTALRNRTNTPVLVDGKDVMPEVNAVLAKMKDFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNNMFEFWDWVGGRYSLWSAIGLSIALSIGFENFEALLNGAHEMDKHFRTTPIEKNIPTTLALVGLWNTNFLGAQTEAILPYDQYLHRFAAYFQQGNMESNGKYVDRDGNVINNYQTGPIIWGEPGTNGQHAFYQLIHQGTTLIPCDFIAPAQSHNPLADHHNKLLSNFFAQTEALAFGKTKEEVEAEFVKAGKSLDDVKNIVPFKVFTGNKPTNSILVQKITPFTLGALIAMYEHKIFVQGVIFNIFSFDQWGVELGKQLANRILPELTDSEKVASHDSSTNGLINQFKAWR

SEQ ID NO: 23235 - protein, 468 aa, Roseovarius nubinhibens ISM
MIDAKGIEYLYLQFVSVTGKIMGKGIPADHWESVAKKGFQLVYGATVNLFTNRAGEYLGYGPEAAELIGIPEPETFMQLPWAPTIGRFYCTLFRNREEKENPGGYLTSDCRGNLRRMHDDFEKKHGRRLRIGTEPEMMWLKFDENGKPRDGYSKPYCYHIDQFESLRPVSMQVIRYARQMGLDMIQGDHEDAPGQLELNWMFDDVLRNADRLTTYRQICAQVARENGIFACFMTKPFMGVSASGCHHNMSLWRGGEDEFVKCGNDPDDLPGMAENYMYVRGGENTFMPDDDDPQMPGKEGLEAIGGVVHHLQALTAVGCSTVNSYRRLWDTGFWAPVFADWGFQNRTTGLRVSAPGRFEYRSVDSMVNPYLMGTTLLAAMDDGIDNQLDPGAPEERNIYAAIKAGKEVKKLPMSLGEALEFLKNSEVVRRGMPGEMYRLYDEYKQDEYARFMSTVTDWDKDTYMECLP

SEQ ID NO: 23236 - protein, 511 aa, Candidatus Desulfococcus oleovorans Hxd3
MTKATPPCMLMILDGWGLNPETKGNAVAAARTPHLDRLFSEYPHTRLVCSGEAVGLPPGYMGNSEVGHLNIGAGRVVYQELMRINVAIQDGSFFKNTVIVQLMDQVTKKQGRLHLIGLLSDGGVHSHLDHLKALVRMASNKNLPVLIHTILDGRDTPPDSGKTYMADLCEFLADYPSASVATVCGRFYAMDRDTRWDRTKKAYDLYTLGEGTRESDPVTAVKNAYLRGETDEFVTPVIIASGSQDGGTVADNDGILFFNFRADRMREIVRAFTDPDFSFFNRKKTPAVAPPVCMTLYDKTFPLPVAFPPENPPNTLGEVISRQGYSQLRIAETEKYAHVTYFFNGGVETPFTGEDRKLIPSPREVATYDMKPEMSAPQVANTLAEEIIKQKYDFIVVNFANMDMVGHTGIFAAAVAACETVDACIGKIIPLFLKSGGVVLVTADHGNSEQMEDQNGHPFTAHTTNPVPLILVDENRKQIILKEGKLADIGPTILFIMKIDQPAEMTGNSLL

SEQ ID NO: 23237 - protein, 374 aa, Debaryomyces hansenii CBS767
MFRTCMARSQRAIRIQNVLRPNILSVTPVFLNQTSTVRFNSTKSSEIADKVSEIKNELTSFDHQASPTGYVSDMTSDQLGYLDSIGLAQGYGPTALIERLLEYSHVYTGLPWWATIIVTTVAVRSVMFPLYVKASINGAKMAKIKPELDQVMQELREAENPQEQVQAAHKRKALMKDNDVHMSHQMFPVLQLPIAYGFFQGLRKMANHPVEGFSTQGNAWFADLTQVDPYCGLQIISAAVVVSMVRLGGETGAAAMNPMMKKVMTYVPILSIFITKELSAAVVLYFAANSIFSFIQALVLRNKYFRKFAKMPPIVAPASIPGAKQPPATVSEWWKEFNQNMNQNVGKKMKESNTKLGAIHKRKSGISNGFIKKH

SEQ ID NO: 23238 - protein, 354 aa, Thermobifida fusca YX
MSARTVKLAVIPGDGIGPEVVAEGLKVLSAVAPRHGLTLDTTEYELGAQRWHATGEVLPDAVEEELRQHDAILLGAVGDPTVPSGVLERGLLLRLRFNFSHYVNLRPVRLYPGVTTPLAGVAPEDIDMLVVREGTEGPYAGMGGVLRKGTPHEIATQDSVNTRLGVERVVRYAFAKAAERPCHKLTLVHKDNVLTYAGELWQRVVREVGAEYPQVEVDYLHVDAATMFFVTQPRRFDVVVTDNLFGDIITDLGAAVAGGIGLAASGNINPEGDFPSMFEPVHGSAPDIAGQGKADPTATILSVSLMLEHLGYADAAAQIDQAVAEDLQERAKNGGVRSTTQIGDDIAQRVAEQG

SEQ ID NO: 23239 - protein, 564 aa, Arabidopsis thaliana
MAIAEEEAALIEDSVSDSVDHRGLPAGKSSTGGWRSAWYIIGVEVGERFAYFGIGSNLITYLTGPLGQSTATAAVNVNTWSGTASILPVLGAFIADAYLGRYRTIVVASLIYILGLGLLTLSSILILMGLSEQRQHNRNASAKPFFWVNILFFCSLYLVAIGQGGHKPCVQAFGADQFDVGDPKERISRGSFFNWWFLSLSAGITLSIIVVVYVQDNVNWALGFGIPCLFMVMALALFLFGRKTYRYPRGDREGKNNAFARIVRVFLVAFKNRKLKLTHSGQLEVGSYKKCKGQLEFLAKALLPGEGGVEPCSSRDVEDAMALVRLIPIWITSVVSTIPYAQYATFFTKQGVTVDRKILPGFEIPPASFQALIGLSIFISVPTYERVFLPLARLITKKPSGITMLQRIGAGMVLSSLNMVVAALVEMKRLETAKEHGLVDRPDATIPMSIWWFVPQYLLLGMIDVFSLVGTQEFFYDQVPTELRSIGLALSLSAMGLASFLSGFLITVINWATGKNGGDSWFNTNLNRAHVDYFYWLLAAFTAIGFLAFLLLSRLYVYRRVDQV

SEQ ID NO: 23240 - protein, 377 aa, Brassica napus
MAEGEEIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTTAEREIVRDIKEKLAYVALDYEQELDTAKSSSSVEKNYELPDGQVITIGAERFRCPEVLFQPSLIGMEAPGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 23241 - protein, 253 aa, Staphylococcus aureus subsp. aureus NCTC 8325
MRTPIIAGNWKMNKTVQEAKDFVNTLPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 23242 - protein, 345 aa, Burkholderia xenovorans LB400
MLSPVGGHRSRVLPASGTIGPSTFHALCMGTIVSIGSINLDLQMRVDHPVGSAETQRAHDFSRLAGGKAANVAYLARRFGHDAQLLGMVGDDRFADEAVAPLRDLGIDVSRVRTAAGQPTAVSMIFVPDNGKKTIVLASNANDAWQRADIDAALEAIDAAPAHSVLAVDCEMSVDACAAVLAAAQRRALCVVLDPAPPQRAQSGALRALWRAVHALTPNEEEAAALTGIEIADQAGAVRAARALHREGFELVCVKRSDGGCIAVSRDGVLAVQVKPVEALDTTGAGDAFTGALAVSLVERRAFADAVRLATAAANLTVMAWGSQTALPDRARADAFAAGLQCEWL

SEQ ID NO: 23243 - protein, 1168 aa, Arabidopsis thaliana
MVSGVGGSGGGRGGKEEPSSSHTPNNRRGGEQAQSSGTKSLRPRSNTESMSKAIQQYTVDARLHAVFEQSGESGKSFDYSQSLKTTTYGSSVPEQQITAYLSRIQRGGYIQPFGCMIAVDESSFRIIGYSENAREMLGLMPQSVPTLEKPEILAMGTDVRSLFTSSSSILLERAFVAREITLLNPVWIHSKNTGKPFYAILHRIDVGVVIDLEPARTEDPALSIAGAVQSQKLAVRAISQLQALPGGDIKLLCDTVVESVRDLTGYDRVMVYKFHEDEHGEVVAESKRDDLEPYIGLHYPATDIPQASRFLFKQNRVRMIVDCNATPVLVVQDDRLTQSMCLVGSTLRAPHGCHSQYMANMGSIASLAMAVIINGNEDDGSNVASGRSSMRLWGLVVCHHTSSRCIPFPLRYACEFLMQAFGLQLNMELQLALQMSEKRVLRTQTLLCDMLLRDSPAGIVTQSPSIMDLVKCDGAAFLYHGKYYPLGVAPSEVQIKDVVEWLLANHADSTGLSTDSLGDAGYPGAAALGDAVCGMAVAYITKRDFLFWFRSHTAKEIKWGGAKHHPEDKDDGQRMHPRSSFQAFLEVVKSRSQPWETAEMDAIHSLQLILRDSFKESEAAMNSKVVDGVVQPCRDMAGEQGIDELGAVAREMVRLIETATVPIFAVDAGGCINGWNAKIAELTGLSVEEAMGKSLVSDLIYKENEATVNKLLSRALRGDEEKNVEVKLKTFSPELQGKAVFVVVNACSSKDYLNNIVGVCFVGQDVTSQKIVMDKFINIQGDYKAIVHSPNPLIPPIFAADENTCCLEWNMAMEKLTGWSRSEVIGKMIVGEVFGSCCMLKGPDALTKFMIVLHNAIGGQDTDKFPFPFFDRNGKFVQALLTANKRVSLEGKVIGAFCFLQIPSPELQQALAVQRRQDTECFTKAKELAYICQVIKNPLSGMRFANSLLEATDLNEDQKQLLETSVSCEKQISRIIGDMDLESIEDGSFVLKREEFFLGSVINAIVSQAMFLLRDRGLQLIRDIPEEIKSIEVFGDQIRIQQLLAEFLLSIIRYAPSQEWVEIHLSQVSKQMADGFAAIRTEFRMACPGEGLPPELVRDMFHSSRWTSPEGLGLSVCRKILKLMNGEVQYIRESERSYFLIILELPVPRKRPLSTASGSGDMMLMMPY

SEQ ID NO: 23244 - protein, 609 aa, Arabidopsis thaliana
MYYLPSSCLVLFLFFSLFYHLPCASSKQTLGWCESQFQCGNITAGFPFWGGNRPEVCGHPLLELHCLDNITSLTISDHLYHVLSINHTYNTLRVARTDFLQSICLSPFPFANATLPPEIFDILPTYKSVTLYRCYPVIPDLARYGCPAIGSVSVSDNLENPVSCEARFTVNIPTSFVPNEKRLNITSLVRDVRNGFEVRLRIDENSCQECSSSHKYCGFTGTLPLETKCRPLNLPTPTIAGVSLLPFLVLTLVVHIIRKQKTSNDKGQQDLKEHIPKPRIKALIQLKQYSYEQVKRITNSFAEVVGRGGFGIVYRGTLSDGRMVAVKVLKDLKGNNGEDFINEVASMSQTSHVNIVTLLGFCSEGYKRAIIYEFMENGSLDKFISSKKSSTMDWRELYGIALGVARGLEYLHHGCRTRIVHFDIKPQNVLLDDNLSPKVSDFGLAKLCERKESILSLMDTRGTIGYIAPEVFSRVYGSVSHKSDVYSYGMLVLDIIGARNKTSTEDTTSSTSSMYFPEWIYKDLEKGDNGRLIVNRSEEDEIAKKMTLVGLWCIQPWPLDRPAMNRVVEMMEGNLDALEVPPRPVLQCSVVPHLDSSWISEENSISSEI

SEQ ID NO: 23245 - protein, 756 aa, Bruguiera gymnorhiza
MGTDAGEVVETLPHCYSCKVHQSICRELRKVVDRIERLFPNIEASRPRCRLGIEVLCLLNDALDRAKQVLQYCSESSKLYLALNGDVIVSRCQKSRNLLEQSLDQIQTMVPVILAAEISQVIDDLRVAKFVLDHSDEEAGKAVRELLQQHTSMSDAVESEIKVLRFAASRLCITTPKDLLIEKRSIKKLVNKVRDNDPTKKKILIYLLHLLKKYGNSILGEQGENLNSQQEELFADGSSVSSQAAEVGPCTACKQIVAEAEMSNIPPAPPEEYKCPLSKRLMYDPVVIASGQTFERIWIQKWFDEGNDTCPKTLVKLDHQSLMPNTALKDLISKWCEKYGVTILDPNSQAFQSLDTSSTSVASFGISMNDLHLPLDISNVSLGSSDASYCSDSPRTKIAERSNLMSMQRNNGYSAFQSRANTNKTCLDFLSRLAKLGWESKCEMIEDVKSHLEDNVQPFHHISFENFVEPLIKFLRDAKYQHDVRAQRAGSKLLLAFVSKKRSGISWLHEDTFDLLASMLDSELVEEALAILEVLSSDKDSRSKITASGALVYILRILDSEREEFQEGAVRILHNLSSNNEVCSQILSLNCIPKLVPFINQGQLASHCMGLLKNLCDIEDARVSVAETNGCVAAIAKLLERESCEEQDHAVAILLSLCSQRVQYCNLVMDEGVIPSLFVISINGSEKGKASALELLRQLRDVDFDNEQKCSGYDVGVTEDSHQCKEKKISSRKTRFLGISLFSNWKSSSVASKKKR

SEQ ID NO: 23246 - protein, 431 aa, Thermus thermophilus HB27
MTENAEKFLWGVATSAYQIEGATQEDGRGPSIWDAFAQRPGAIRDGSTGEPACDHYRRYEEDIALMQSLGVRAYRFSVAWPRILPEGRGRINPKGLAFYDRLVDRLLASGITPFLTLYHWDLPLALEERGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRFFLDPILGKGYPESPFRDPPPVPILSRDLELVARPLDFLGVNYYAPVRVAPGTGTLPVRYLPPEGPATAMGWEVYPEGLHHLLKRLGREVPWPLYVTENGAAYPDLWTGEAVVEDPERVAYLEAHVEAALRAREEGVDLRGYFVWSLMDNFEWAFGYTRRFGLYYVDFPSQRRIPKRSALWYRERIARAQT

SEQ ID NO: 23247 - protein, 247 aa, Zea mays
MDSRLAIPALLLLASAPSAAAAADGGKVSLELYYESLCPYCSRFIVNRLAGIFEDGLIDAVHLRLVPYGNAHVASNSKISCQHGPYECLLNTVEACAIDAWPDLDVHFSFIYCVEDLVVKRQYKDWESCFEKLGLDAKPVTECYKSEHGHKLELKYANQTDALEPPHRYVPWVVVDGQPLLEDYENFEAYICKAYKGTPPKACEGLERLQMALETAAEARNGVSYNSGVSKLATAEDEGGEHKVGEY

SEQ ID NO: 23248 - protein, 508 aa, Pseudomonas fluorescens PfO-1
MTTTPKPLVLMILDGFGHSDSPESNAVYAAKKPVLDRLWATVPNGLISGSGMDVGLPDGQMGNSEVGHMNLGAGRVVYQDFTRVTKAIRDGEFFENPTICAAVDKAVAAGKAVHFMGLLSDGGVHSHQDHLIAMAELAFKRGAEKIYLHAFLDGRDTPPKSAASSIELLDATFQALGKGRIASLIGRYYAMDRDNRWDRVAQAYNLIVDGKGEINAATAQEGLEAAYARGESDEFVKATSIGEPVKVEDGDAVVFMNFRADRARELSRVFVEDGFKEFERARQPKVQYVGLTQYAESIPAPAAFAPGSLENVLGDYLAKNGKTQLRIAETEKYAHVTFFFSGGREEPFPGEERILIPSPKVATYDLQPEMSAPEVTDRIVEAIENQRYDVIVVNYANGDMVGHSGVFEAAVKAVECLDTCVGRIVEALEKVGGEALITADHGNVEQMADESTGQAHTAHTTEPVPFIYVGKRDLKVREGGVLADVAPTMLKLLGLEKPAEMTGTSILV

SEQ ID NO: 23249 - protein, 429 aa, Bifidobacterium longum DJO10A
MSNIFQWQLHGDGKTLAPGEVVEPDERLTWVRTAGIGAQHVIAMFGATFLVPILTGFDPSTTLFFTAMSTALFLLINRNVLPSYLGSSFGFIAPITAVTTANKGIAVASFGIMVTGILLALVGVLVHYAGSKWIDIIMPPVVNGAIVAIIGFNLAPSVWTNFQAAPDTALVTLLAVLLVAVLFKGLLGRLNILVGVIIGYVYACIRGQVDFSAIGDAAWIGFPKFHLPQADFSILPMFIPVVLVLVAENVGHVKSVAQMTGRDYDNQIGTALMADGLGTTLAGFGGGSGTTTYGENIGVMAATKVYSTAAYWCAAAFALILSLCPKFGAVINTIPAGVLGGVTTLLYGMIGMIGIRIWVENKVNFDKPLNIMVAAITMIIAIGQFAFTVGGISFNGIAIGTIVILVAYHGLKAIGKATGTIAKDDPDIL

SEQ ID NO: 23250 - protein, 886 aa, Xanthobacter autotrophicus Py2
MTKWVYTFGDGKAEGKADMKNLLGGKGANLAEMSNLGLPVPPGFTIPTEVCTYYYAHGQTYPAELKGDVEAALAQVGQLTGKSFGDAANPLLVSVRSGARASMPGMMDTVLNLGLNDETVEAVARLAGDRRFAYDSYRRFITMYSDVVLGVSHHHFEEILEHYKLQKGFNLDTELSADDWAALVVKYKEKVAAELGKPFPQDPHEQLWGAIGAVFSSWMNARAITYRRLHSIPESWGTAVNVQSMVFGNMGETSATGVAFTRNPSTGENALYGEFLVNAQGEDVVAGIRTPQDLTEKARKTAGSDKPSMELALPEAFKEFERISHVLENHYRDMQDLEFTVEKGKLWMLQTRSGKRTAKAALRIAVELAAEGLITEEEAIGRVDPAALDQLLHPAIDPKAERKVIATGLPASPGAAAGAIVFTADEAEAAKEKGQKVILVRVETSPEDIHGMHAAQGILTARGGMTSHAAVVARGMGKPCVSGAGSLRIDAAAQTLTVNGQVFKKGDHITIDGGTGQVLSGEVAMLQPELSGEFATLMGWADKVRKLKVRANAETPADARMARSFGAEGIGLSRTEHMFFDAGRILAVREMILADDEAGRRAALAKLLPMQRDDFVELFEIMKGLPVTIRLLDPPLHEFLPHTAEETEEVAKSLGVDVERIERRNKELHEVNPMLGFRGCRIAIAFPEIAEMQARAIFEAAIIAAKKTGEAVVPEIMVPLIATKAEFDIVDAVIRKTADAVEKETGAKLTFQVGTMIELPRAALRAEEIAKGAEFFSFGTNDLTQTTFGVSRDDAGTFLGPYVQKGIIEVDPFVSIDVDGVGELVKIGVERGRKSRPDIKLGICGEHGGDPASVAFCHEVGLNYVSCSPFRVPIARLAAAQAALKK

SEQ ID NO: 23251 - protein, 373 aa, Thermobifida fusca YX
MSNGTTTSGLTFDIRLSTERKTPQEREAILENPGFGKVFTDHMVTIRYTADRGWHDARLEPYGPLSLDPATSVLHYAQEIFEGLKAYRHPDGSIACFRPEANAARFNSSAKRMAMPELPEELFLGAIDTLLTYDGDWVPTQADTSLYLRPFMISTDVGLGVNSPSSSYLFVLIASPSGGYFANGVKPVTVWLCEDYTRAAPGGTGAAKFGGNYAASFLAQAQAVEQGCDQVVWLDAVEHRWVEEMGGMNLFFVFGSGENARLLTPELTGTLLPGITRDSLLKLAPDLGYPVEEGRISTDEWREAAASGELTEVFACGTAAVITPVSHVKSRQGEFQIGDGTPGPITMRLREELVGLQYGTRPDSHGWIRKFGR

SEQ ID NO: 23252 - protein, 340 aa, Coprinopsis cinerea okayama7#130
MAPIRVRHPGGVCTIQVPLDNDSYTVGDLQQEIYKASDILPSRQSLKSGYPPRSLTLVPELPISSLDLKSGEQLIVQGAVESSARGTSAAASPPPRAAAAVPTSPPRQSQTASINGPSKKSGPETVQVDGGYLIHRVVPDDNSCLFSSLALIFEGSISNAQKLRRAVVDGIKADPETWNEAILGMPPSRYIDTISKPTSWGGAIELSILAKHYNTEIASIDVETGRIDKFSPPEAPGELSRCFVIYSGIHYDAISFSPMEEAPDEWHQKLFPVKPGKDDDDAIIVAAKKLADALRAKKAYTNTATFDLKCEVCGQGLKGEKEARAHAEQTGHVRFGEYTK

SEQ ID NO: 23253 - protein, 263 aa, Oryza sativa (indica cultivar-group)
MEGRVLRRSVTLADQLAAVGPAGTAAATASAGSCNLRDLLKLRDEDDLAAGRRAAVTLASAMAAERLTVAPASSAAAAAAAARTLLDIIRDDQLPTSSGGGGEGGDPLVRRAVSLPAPVTATPPPPPPPPETPPRQLPAVSPPTVGEEEEEEQGERVSLMALLEQTERQWSAGSGATVQQHLASPSAATSASVSAAAEDEAEAEAGKGAAGGGCCCVCMARAKGAAFIPCGHTFCRTCARELLAGRGRCPLCNAAILDVLDIF

SEQ ID NO: 23254 - protein, 263 aa, Oryza sativa (indica cultivar-group)
MEGRVLRRSVTLADQLAAVGPAGTAAATAAAGSCNLRDLLKLRDEDDLAAGRRAAVTLASAMAAERLTVAPASSAAAAASPARTLLDIIRDDQLRSSSGAVGEGGDPLVRRAVSLPAPVTATPPPPPPPPETPPRQLPSVSPPTVGEEEEEEQGERVSLMALLEQTERQWSAGSGATVQQHLASPSAAASASVSAAAEDEAEAEAGKGAAGGGCCCVCMARAKGAAFIPCGHTFCRTCARELLAGRGRCPLCNAAILDVLDIF

SEQ ID NO: 23255 - protein, 207 aa, Brassica napus
VDPRVRQTVGFGNNAALLSAVITGSINVLSTFVGIYLVDRTGRRFLLLQSSVHMLISQLIIGIILAKDLGITGTLGKAQAMVVVVFVCAYVMGFAWSWGPLGWLIPSETFPLETRSAGFAVAVSCNMLFTFVIAQAFLSMLCGMRSGIFFFFSAWIIVMGLFALFFIPETKGVAIDDVRERVWKPHWFWKRYMLAEDDHQDVEKRTE

SEQ ID NO: 23256 - protein, 227 aa, Acidobacteria bacterium Ellin345
MSGEPRLVEVRKNILKQNDIVASALRERFRESGVFVVSMVSSPGSGKTALLEKTLKLLSKNFRVAALVGDLATENDAHRLARSGAPVKQIVTGTVCHLEAAMVEKALEGWNPDELDFLFVENVGNLVCPSSYDLGENLRLVLSSVTEGEDKPLKYPTIFNSADVAVITKMDLAAAVEFDETTSVQNILAVRPGMEIFKVSAKTGAGMDEFLEFLQARLNETKVAKTI

SEQ ID NO: 23257 - protein, 293 aa, Triticum aestivum
MDQYEKVEKIGEGTYGVVYKAKDRYTNETIALKKIRLEQEDEGVPSTAIREISLLKEMQHRNIVRLQDVVHNEKCIYLVFEYLDLDLKKHMDSSADFKNHHIVKSFLYQILHGIAYCHSHRVLHRDLKPQNLLIDRRTNSLKLADFGLARAFGIPVRTFTHEVVTLWYRAPEILLGARQYSTPVDVWSVGCIFAEMVNQKPLFPGDSEIDELFKIFRIMGTPNEETWPGVSSLPDYKSAFPKWPSVDLATVVPTLEPLGLDLLSKMLCLDPTRRINARTALEHEYFKDLDVSS

SEQ ID NO: 23258 - protein, 455 aa, Anaplasma marginale str. St. Maries
MARARGVPVHQFVDEISGAFRNLVGVSGFRCNDFIRTTEERHKRAVLALWERLRGNNQIYLGHYAGFYSVRDETFYQERDLVDGKAPTGAEVEWLEEPGYFFKLSEWQESLLKFYADNPEFVIPEGKFNEVISFVESGLRDLSVSRSKKSLSWGIEVPHDSDHIIYIWVDALCCYLALLGFPETEGEYKRYWGSDGAVSTHVVGKDILRFHAVYWPALLMAADLPLPKQIVAHGWWLNEGQKISKSIGNVIDPFALIEQYGLDNCRYFLLSETPVGNDASFSGASLVERINCDLANNFGNLVQRTITLVHRECGGKIPEVEGMMQGEEAPINYEAVLVQYVEYMAEYRFFEALKFVMNLSSVANEYIARRAPWKLFKEDRKSAQAVVFKLLEYIRCIGIMLQPFVPDSASKILDQISLPADRRTFEHFSEFCRGGVSLGTPTPVFGKLYSTQSEG

SEQ ID NO: 23259 - protein, 1814 aa, Ustilago maydis 521
MNTKSNASFGLPPVALNTASPSQTTNPTTSDRPTLITSQFPGQALYLTHPQRLSLLSIKIDATTSITTTRAAVLAQQQLSPSLPPPSPPPPPPSAVYRHASTSKLHSHQPPPSSFHTNASHKSSRSRPLSHDFTQKARDALNDFGRLANRRQSAIERANGAETLARVADGLGSKRASSHDDRARPTSSHPLILQQDSNHQPPSFAPPKLPLDPTSQQHLTSQDAQVVRSHATRSFTLLPQSDLRFLSHSIPLSIHASITTSSDPSTIIPSPLEFTTASHNGSSPYSTSALDPSQLLLKVEPPAELARQSWSRSTSFLTPQNASQYHTSEHHSVKFRYRLRLCAKTASPTSYLFPHTERNDAPPPSTPLALALGQVLFLSAASPEKLIEAIESPSSSIASSELAALEGISRVQLTPSSYPLSSTVTRGASEFDFEWTWKSLARSSSSNASRCCCAFVEISPDGKSATLLAAISLFIQLPPSVPLLSNMLSSTQADTIPHQRLSSSDSLAIIAALNLDQEPSLRTDTAPALSSFHQDSHPTSFIAPSSTQHGSTRLLIDRTELALEDLVNDSPIFRAALVNLERRTASIKKASKAVLRASQEARLRIFRLIEAEQAVDTALQALVGMAPETIGRLQDQLLRQARIATMQHQREQASVIESCLERPLAQIVELCRLAQDGFKLFENESKTYYSQTQKWLANRSSNADPSNTPAIGNDAHRQDRADQKQKLRELRFEQARLDLFAMLQRLHGGRAEAHLARSILQLTQWLVDFPNKPHWPSHTQTSSLSALDASLLDALDHQALQLQEVESRSRQVADRARMLEHALGKIGDADIDILGAHRFEIDQTSPAPSNFNGAVSSKTRKFKSFLGVFAAGIQSSPLTLSKNASPNTESAVKQVELVAPVDGAQLPYQHPRRRHSMKEKFNHVRQPDVGNTSPFKSHAPSSWVYNNLPAAPRRGSELHESSRLRDDAASDQLSLHASQDASEGASSMAGAHELSRTSTAEQGLGIFEPASANTVQEYGLSPAPGQCSGPIAPSLTTGSDRKKEGVLWVSTKSVTGPVGADAPRGINRSNHWRECWVVLSGSGQISEFADWKNAKALEPTNPLIDLRFATVREARGVDRRFAFEIVTRDSRRLFQAPDEEAMRDWMRAISKAIESLLNGTSSVRKLDRAVRASPFRSSDSVQQRPADFDEDEEVPGVGEGNDFAVRKLLDRTTRSSTQSMNDLAASAKAQDSDRKDRAKLGAHLAGLSESHAESSVQSSRRRSQHQRGISNKTPISGYLGAGKLGLTASDVAALHRRDGTQLSDDASISSKSTSGEQDAEFDRQIEAVVHKSYGSRDDTGTSHSGFSFNSAVSGVDEMGKFKANASARATSSSSPSKATSAANASVTSTATSTKMSRSAEIAAISRRPENRHCADCQESDPRWASWMLANQPCCIFICIRCSGVHRSLGVHISKVKSVDLDDWTEEQLQAARDWGNVRANALWEHSKPAGLLPLPSDRKEFWRRKYTDQEWKDPNPKILRDARPCYNSITDAPDNNHDATPTRRSALITEASPDVVTPQSKSQSHAQELGLRIMPSDQTASSNGSAKFPDVPGSPRPNGPRPLPQQRSVTMQASAISSLSSPTAGKLAGVKPNLTSPDSPNKQDRADWTARQTSFASDDEALTGLVASMMTEYASLRQDFPKESYPSCAPSIPTSTSAPPMSSLTSTNPHVSKAMLAARADRRLFPCLASTEAVETLPSNNAKVQVSSPPSTFFVSDMGAHTSSRMLFDGPGRGEAAWDATSEIGTDHHEGRSTESLPAITNPPARFDAFASHA

SEQ ID NO: 23260 - protein, 545 aa, Caulobacter crescentus CB15
MHDRAGLRALPEDLVDLDALIGAYFEIKPDVSNPAQKVVFGTSGHRGSSLDGAFNEAHILAVTQAIVEYRAAQGVTGPLFVGRDTHGLSEPAWRSVLEVLAANGVEALVDSRDGFTPTPAVSHAILTHNRQGGRQADGLLLTPSHNPPRDGGIKYNPPSGGPAGSDATSAIAARANELLAQGLAGVKRVPFETARKAVGDYDFLGRYVDDLPAVIDIAAIRAAKVRIGADPLGGAAVAYWGAIAERHALDLTVVNDAVDPRWAFMPLDTDGKIRMDCSSSSAMANLIGIMKGGAAYDVATGNDADADRHGIVTPDGGLMNPNHYLAAAISYLFSHRPGWGADTAVGKTLVSSSMIDRVVSGLGRRLLEVPVGFKYFVPGLLDGSVGFGGEESAGAAFLRHDGGVWTTDKDGIQLALLAAEIQAVTGKSASQLYAGLTDQYGAPAYARVDAPASREEKARLSKLSPSDVSAKTLAGEAITDILTAAPGNGEAIGGLKVCTQNAWFAARPSGTEDVYKVYAESFLGADHLKQVQAEAREVVAGALKG

SEQ ID NO: 23261 - protein, 223 aa, Arabidopsis thaliana
MDSSMSTKKKTKLSVRNQTCFKKSSLSSSSTAKKTTNLSMREETMFKKALELSTLCDIEVCVIYYGRDGELIKTWPEDQSKVRDMAERFSKLHERERRKKRTNLSLFLRKKILDDNKLSEKVLEMKDSLESGLRVLQDKLLLLQPENQTELGQSRAVSSTTNPLSSPEDHHHQQWTEPLVTGVSNTEQDLSTSPLSNHQSKYSVFVYNHDSGSFYQVPDSICF

SEQ ID NO: 23262 - protein, 222 aa, Candida albicans SC5314
MADNSDDYSYDYEYLYKIVLIGDSGVGKSNLLSRFTRDEFNLESRSTIGVEFATRTLEIDGKRVKAQIWDTAGQERYRAITSAYYRGAVGALIVYDIAKTESYESVSRWLKELKEHADANIIIELVGNKSDLDHLRAVPTEEAKNFAMENNLLFTEASALSSDNVDLSFHQLLKNIYEMISKHQLENNDSKQTNTAGGPTISLTPAPQEKKNKNNGWLLLRH

SEQ ID NO: 23263 - protein, 425 aa, Clostridium perfringens SM101
MDRNKEIFEESKKYMPGGVNSPVRSFGSVGINPPVIKSGKGAMIKDENGNEYIDFVLAWGPMILGHCDEDVVEAIKKTSEESIAFGASTKLELDLAKILCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYEALLIFDEVMCGFRVAYKGAQTLFDVKPDLVTYAKIMGGGLPCGAYGGRREIMENLSPLGGVYQAGTMSGNPIVMSAGLATVKKLYENPSYYDHIEKIGSKLEKGIIEIAKKKGLGLVVNRQGGMMTLFFTDLKEVKCYDDVKTCDGERFKRYFLHMLNKGFNIPPSQFEAMFLSVKHTEEHIDKFLEAFESFEG

SEQ ID NO: 23264 - protein, 283 aa, Gloeobacter violaceus PCC 7421
MTANVVSGAGGVAGWRALNWPTLGFLVLMHGLALLAPWFFNWQALAVALGLHWLIGSLGICLGYHRLLTHRSFRVPRGLECVFAMLGALALQGGPIFWVAAHRLHHAHADDDARDPHSSGRGFWWSHVLWLLYRHPELSDGQTHRKYAPDLARQPFYRWLNRYHLLLQIPLAVLLFALGGWPFVVYGVFVRAVVLWHTTWLINSAAHLAGYRTSEVPDSSRNLWWAALLTYGEGWHNNHHAQPNAARAGLRWWEVDMTWWVIRALEMAGLATQVVPPRPNPVR

SEQ ID NO: 23265 - protein, 468 aa, Pseudomonas fluorescens PfO-1
MSKSVQLIKDHDVKWIDLRFTDTKGTQHHVTMPARDALEDDFFEVGKMFDGSSIAGWKGIEASDMILLPDDETAVLDPFTEEPTLILVCDIIEPSTMQGYDRDPRAIARRAEEYLKTTGIGDTVFAGPEPEFFIFDEVKFKSDISGSMFKIYSEQGSWMSDQDVEGGNKGHRPGVKGGYFPVPPFDHDHEIRTSMCNALEEMGLTVEVHHHEVATAGQNEIGVKFNTLVKKADETQTLKYVVHNVADAYGRTATFMPKPLYGDNGSGMHVHMSISKDGKNTFAGEGYAGLSDTALYFIGGIIKHGKALNGFTNPATNSYKRLVPGFEAPVMLAYSARNRSASIRIPYVNSPKGRRIEARFPDPAANPYLAFAALLMAGLDGIQNKIHPGDAADKNLYDLPPEEAKEIPQVCGSLKEALEELDKGRAFLTKGGVFSDDFIDAYIALKSEEEIKVRTFVHPLEYELYYSC

SEQ ID NO: 23266 - protein, 658 aa, Coprinopsis cinerea okayama7#130
MFSSLRRPTSNVVARHLQVRFSSSSSQSKPRFSRVVGGAKTVAKYGGYLCLSSVIGVATLGVGILVHDAFTYNDRHVDRVPVSPLALNPVKGGPKNLPIVSVQFGDEENEDMQKLLDRPKLVIVGGGWGAMGVLKTLYPGDYHVTVVSTDTYTTFTPLLPSAAVGTVSVRSLIEPIRKLIARLRGHFIAGKAVDLVMNDRLLEVELTHNGKKQNVYVPYDKLVIAVGSSSSTHGVPGLEHCFQLKTIGDAQAIRRRVMDNFEAASLPTTSPEERKRLLSFVICGGGPTGVETAAEIYDFCQEDIMNYPEQFPKICREDVSIHVIQSREHILNTYSEEISKFAEAKFARDKVNLITLARVAGVTPDSVLYTTKRKDESGNLVTEQHSIPTNFVLWSTGIAMNPFTKRVSNLLPNQAHKKAIETDAHLRVIGAPEGEVYAIGDCATIETSIISHFMDLVETCDKDKNGKIDFDEWELMVKRIKAKIPMAEDHLVQVRELFQMYDIDSDETLSLNELVKLLEEVGNRITSLPATAQVASQQGKYLGAKLHKLARKASATANSSDTTSPAPSGTASVIHSRPIFPNDESIAKPFKYFHLGSLAYIGNAAVFDFGKYSLMGGLAAMYAWRSIYWNEQVSARTRALLMIDWIIRGIWGRDLSRI

SEQ ID NO: 23267 - protein, 488 aa, Escherichia coli
MKKVNHWINGKNVAGNDYFQTTNPATGEVLADVASGGEAEINQAVAAAKEAFPKWANLPMKERARLMRRLGDLIDQNVPEIAAMETADTGLPIHQTKNVLIPRASHNFEFFAEVCQQMNGKTYPVVDKMLNYTLVQPVGVCALVSPWNVPFMTATWKVAPCLALGNTAVLKMSELSPLTADRLGELALEAGIPAGVLNVVQGYGATAGDALVRHHDVRAVSFTGGTATGRNIMKNAGLKKYSMELGGKSPVLIFEDADIERALDAALFTIFSINGERCTAGSRIFIQQSIYPEFVKRFAERANRLRVGDPNDPNTQVGALISQQHWEKVSGYIRLGIEEGATLLAGGPDKPSDLPAHLKGGNFLRPTVLADVDNRMRVAQEEIFGPVACLLPFKDEAEGLRLANDVEYGLASYIWTQDVSKVLRLARGIEAGMVFVNTQNVRDLRQPFGGVKASGTGREGGEYSFEVFAEMKNVCISMGDHPIPKWGV

SEQ ID NO: 23268 - protein, 297 aa, Coprinopsis cinerea okayama7#130
MATVLKTQKANASKGKRKADDMEVDDAGAEMQVKRKKNKQRVLLLSSRGVTHRMRHLMNDIEALLPHVKKDAKLDSKNQLHLLPELADLNNCNNTLYFEARRHEDLYLWAAKTPNGPSIKMHMQNIHTMDELKLTGNCLKGSRGLLSFDASFDETEWGRLTKEIFTHIFGVPPGARKAKPFIDHILTFSILDNKIWFRNFQIVEKDPLQPNGPPQTSLVEIGPRFVLTPIRIFEGAFHGATVYSNPEFISPAAVRSAIRRQQGSKYGQRKKAEEESARRKEFRRREEDELAVSKVFA

SEQ ID NO: 23269 - protein, 405 aa, Aeropyrum pernix K1
MPQKDPTLDIQERVVEIEGETAFAYLAVARKLIQEGRRVISFGIGQPDFPTPHHIREAAKKALDEGFTGYTETAGIPELREAIAWYLNSRYGADVSPEEVIATTGAKTAIFLGMALYLRPGDEVIIPDPSYYAYAQVAKLFGARPVYVPMKFEPGLGFRFDIEGIERAVSEKTRMIVVNNPHNPTGSVFPPDQVEAIHDIARRRGLIILADEIYDNFLYTEKPFKSTLSLPDWRENLVYVNGFSKTFSMTGWRLGYVVLRREVIPKALDLAVTIYSCPPSIAQKAGVAALRGDWGPVREMVEEFRSRARILYDILSQAEGIEPYLPEGAFYMFPRVAGLLRKTGLSVEQLAEKLLYSYGVLVLPGTSFPESVGREHVRLSFATATSDVKEGAEIIVRASRELSSG

SEQ ID NO: 23270 - protein, 466 aa, Acidobacteria bacterium Ellin345
MAPLDLSPADFRALSRKISDFTADYLERLPNLPAFPLNVSGEAVNALFSAEVPIAPMGERAFDPLADVFALSRPNSPRFFGYVFGSGLPIAALGDFAASVLNQNVTAWRSGPAAVTIERTVVGWLAEAIGCSGFSGSLTGGGSQANLMALCMAREAKAPANENGAQGGVIYCSDEAHMSMPKAAMMLGLGQKNVRRIPVNDRFQMDISHLRDAIMRDLREGNRPIAVVASAGTVATGSIDPLPEIADICSEHNLWMHVDGAYGALAAMTVPEKFVGLNRADSLSLDPHKWLYQPAGCGCLLYRDPAAAQRAFSHTEDYARSLSTDPIESFAFFESSMELSRPFRALKIWLSLRYFGLQAFQQRIAEDLRLARILADSVSAEPQLELLAPVELSAVCFRYVRKNADLDHLNLEILQRIIQRGKVCISNATIRGQFALRACVVNHRSTEEDVKAVVSEVLHAANEVSG

SEQ ID NO: 23271 - protein, 334 aa, Phytophthora infestans
MAASPNKKLREASQLDQLKQFTTVVADTGDFEQINKYKPQDATTNPSLLFKAAQMEQYSALVDDAVSYGKGLSADLSEKERLGYVIDKLSVNFGLEILKVVPGYVSTEVDARLSFDTESTIARAHRIIDLYEKAGIKKDRILIKIASTWEGIQACKHLQKEGISCNMTLLFGFAQAVGCAEAGATLISPFVGRILDWHKAKTGKSSYESHEDPGVVSVTKIYQYYKKYDYKTIVMGASFRNTGEITELAGCDRLTISPALLEELTKSTATLAKKLDAETAGKAYTGEKLSYDEKDFRLSMNEDAMATEKLAEGIRGFSADIVKLEQILKTKLGA

SEQ ID NO: 23272 - protein, 412 aa, Aeropyrum pernix K1
MGRIVQVKLPDIGEGIAEGEIVEWLVEEGAVVKQFSPLVRVLTAKATVEIPSPYTGRVVRLLAKPGDVVRVGDPIIEIEVEEGEAPKAPEAAEKPSATVEPPKAEEAAAPPPQAAPAILVRAPPRVRRLARQLGVDLARVRGTGPRGAITEDDVRRAAAMLATAPKPEAPPPVAEEAEERIPVRGIKRSMAQSMSLSKSKIPHAYIAEEVDFTELSKLREALKRDAEEKGVRLTYLPFVFKAVAKAIRKYPLVNSEFDEEKMEIVVKKAVNIGFAVDTPHGLVVPVVKNVEKKGLFAIAREIADLTAKAREMRLSLEEVSGATFTITNVGSIGSVIGFPVIYPPNVAILGVHRLVERPVYVDGELKPRKIGFVSLSFDHRALEGAYATRFLMEVKRLLENPALLFAEDYEFR

SEQ ID NO: 23273 - protein, 375 aa, Sinorhizobium meliloti 1021
MRTRAALAVQAGKPLVVTEVELEGPRAGEVLVEVKATGICHTDDFTLSGADPEGLFPAILGHEGAGIVVDVGPGVTSVKKGDHVIPLYTPECRSCPSCLSRKTNLCTAIRATQGQGLMPDGSSRFSINGDKIHHYMGCSTFSNFTVLPEIALAKVNPDAPFDKICYIGCGVTTGIGAVINTAKVEIGATAIVFGLGGIGLNVIQGLRLAGADMIIGVDLNNDKKPWGEKFGMTHFVNPKEVGDDIVPYLVNLTKRGADQIGGADYTFDCTGNTKVMRQALEASHRGWGKSVIIGVAGAGQEISTRPFQLVTGRTWMGTAFGGARGRTDVPKIVDWYMEGKIEIDPMITHTMPLEDINKGFELMHSGESIRSVVLY

SEQ ID NO: 23274 - protein, 130 aa, Methanocaldococcus jannaschii DSM 2661
MSLMDPLANALNHISNCERVGKKVVYIKPASKLIGRVLKVMQDNGYIGEFEFIEDGRAGIFKVELIGKINKCGAIKPRFPVKKFGYEKFEKRYLPARDFGILIVSTTQGVMSHEEAKKRGLGGRLLAYVY

SEQ ID NO: 23275 - protein, 336 aa, Pseudomonas fluorescens PfO-1
MSRVTLSRYLIEQTRSNNTPADLRFLIEVVARACKEISHAVSKGALGGVLGSMGTENVQGEVQKKLDVLSNEILLEANEWGGHLAGMASEEMDNAYQIPGKYPKGAYLLVFDPLDGSSNIDINAPVGTIFSVLRCPNEYLSQNEALDEKAFLQPGTQQVAAGYAIYGPQTMLVLTLGHGVKGFTLDREMGSFVLTHEDITIPESTQEFAINMSNQRHWEAPVQRYVSELLAGEEGPLKKNYNMRWVAAMVADVHRILTRGGLFMYPRDSREPSKPGKLRLMYEANPMSFLVEQAGGASTDGHQRILDIKPEGLHQRVAVFLGSKEEVARATAYHKE

SEQ ID NO: 23276 - protein, 374 aa, Arabidopsis thaliana
MATSLQTKYTLNPITNNIPRSHRPSFLRVTSTTNSQPNHEMKLVVEQRLVNPPLSNDPTLQSTWTHRLWVAAGCTTVFVSFSKSIIGAFGSHLWLEPSLAGFAGYILADLGSGVYHWATDNYGDESTPLVGIHIEDSQDHHKCPWTITKRQFANNLHFMARGTTLIVLPLDLAFDDHVVHGFLFHAWAHGTKSKLPPLVVGLQDIGLLVSRIHHMNHHRAPYNNNYCVVSGVWNKVLDESNVFKAMEMVLYIQLGKLLIVMEATSQPCFSHNSSLHSTRKQPAKPWKKPVTGLPQRMHPKVYRVEPVNFKELVQRLTGAEDVEQEVHQVEAKPVKISDDTTTAKDNPFAFDLSPSSSRFWEAFPLLSPANLSRW

SEQ ID NO: 23277 - protein, 248 aa, Roseovarius nubinhibens ISM
MRRKLAAGNWKMNGDSATLDELATLAQRHAEASVDLLICPPATLISRAVSCAGPIRIGGQDCHAAPSGAHTGDISAAQLRDAGATAVILGHSERREDHDEDSDQVREKARAAHAADLLTVICLGESLAQREAQNTLDIIGAQLALSVPDSATGENTVIAYEPIWAIGTGLVPDTDQIGEVHDFIRARLERRFGAGVGRSVRLLYGGSVKPENAASIFAVSNVDGALVGGASLKAADFSPIVSALEASA

SEQ ID NO: 23278 - protein, 335 aa, Oryza sativa (japonica cultivar-group)
MVVLAKGELEQIALPAAHPPPADVRAIDLSATGPARAAEARALVAACEEQGFFRVTGHGVPPGLVRAAEAAAARFFALPQPDKEAAAGAPLGYASKRIGSAGDLGWIEYLLLCLAPAAAAAALPCAATSPTPPCPLRELLREYSAAVRRVACGVLELMAEGLGVGPADALARLVAREDSDSILRVNHYPPRPDQLGGGGGPNLTGFGEHTDPQIISVLRSNGAPGLEISLRDGAWASVPHDGDGDSFFVNVGDTLQVLTNGRFRSVKHRVVVNSEKSRVSMVFFGGPPPGERLAPLPALLGDGGRSRYREFTWKEYKGSGCKGRLADDRLCRFEN

SEQ ID NO: 23279 - protein, 706 aa, Bifidobacterium longum DJO10A
MYPLGASYDGAGVNFALYSQVAQKVELCLFDEHDAETRIEMTERNSYVWHNYIPGLHPGQRYGYRVYGPYDPVHGLRCNPNKLLLDPYAKAIEGNIDGDESLFSYWFKSPDDNSAMNDLDSAAHTMKSAVINPYFDWGNDQHPYISYHDSVIYEAHVRGMTNLNMDVPPDIRGTYAGLAYPSVIEYLKKLGITAIELMPIHQFVNDSFLQEKGLSNYWGYNTIGFFAPHNAYSSSGERGEQVNEFKSMVKAYHRAGMEVILDVVYNHTAEGNHMGPTLSFKGIDNASYYRLVEGDQQHYFDTTGTGNSLLMRSPHALQLITDSLRYWVTEMHVDGFRFDLAATLARQFQEVDKLSAFFDIVEQDPIISRVKLIAEPWDLGSGGYQVGGFPSSWSEWNGRYRDTVRDFWRSQPSTLPEFASRLMGSSDLYQVNGRRPVASVNFITAHDGFTMNDLVSYNEKHNEANGEGNRDGESNNRSWNCGVEGPTNIPDVNDLRQRQMRNMFATLLFSQGIPMICGGDEVARTQQGNNNAYCQDNEISWTNWHLDKGRKELLAFVSKLIHLRLDHPVLHRRRFFTGREPGDDSNMIPQVEWFDHTGSIMDMDDWQNTHAFSMMIYLNGSDIPEVDWYGNRMVDNDFILIFNAHYEPIMFTLPDERYGRKWQLVVDTHNPDGPELSYEAGFMITAQSRSFLMLMSDKKPKKPMGL

SEQ ID NO: 23280 - protein, 1075 aa, Candidatus Desulfococcus oleovorans Hxd3
MPKRTDIEKILIIGAGPIIISQACEFDYSGTQACKALKEEGYSVVLVNSNPATIMTDPEFADATYIEPVTPEAVAAIIEKERPCAILPTLGGQTGLNTAVAVAEMGVLEKFNVEMIGASLSAIKKAEDRDLFRKAMNNIGLRIPRSGIATSMDQVRAIADEIGLPLIVRPSFTLGGTGGGVAHTQAELDALSAGGLEASLINQVMIEESVVGWKEYELEVMRDRADNVVIICSIENLDPMGVHTGESITVAPIQTLSDKEYQVMRDASIAIMREIGVDTGGSNVQFAVNPANGEMVVVEMNPRVSRSSALASKATGFPIAKIAAKLAVGYTLDEIANDITGETRAAFEPTLDYCVVKIPRWTFEKFPETKDELSTSMKSVGETMAIGRTFKEALQKGIRSLEISRFGLGADGADKIDPSIQEITDKLATPNSERLFYLRYALQKGFTIDDIYRLTRIDPWFLDQIEKILFVEKTLIEHKDNLSADLLWRAKREGFSDVQLAHITGKTEEEIRALRYEAGLRPVYKLVDTCAAEFKAATPYYYSTYETENEARVSDRKKVVILGGGPNRIGQGIEFDYCCVHASFALREEGVESIMVNSNPETVSTDYDTSDKLYFEPLTVEDVLHIIDTEKCDGVIVQFGGQTPLNIAEALARAGAPIIGTSPESIRRSEDRKFFAAMLSKLGLLQPPNGTAVNVEEAAAIAQNLGYPVIVRPSFVLGGRAMKIVYTPAELANFARHAIKASPKHPILVDKFLEDAIELDVDAISDTTGHTVIGGIMEHIEEAGIHSGDSACVLPPHSVKPHVIDEIIRATKAMAAELKVVGLMNVQYAVKGDTLYVIEVNPRASRTVPFVSKATGVALAKAATKVMLGRTLKELGIVDDAWRTAHIAVKEAVFPFNRFPDVDTLLGPEMKSTGEVMGLDMDFGAAFAKAQLGAGQKLPVKGNVFISVQDKDKRATAGIARQLSDAGFEIVATAGTAAFLKEQRIAVRPINKVSDGHPHVVDAIVNGEIQLVINTGTGQDSQVKRDGYMIRRTTLRCQVPYATTLPGALAVCRGILQLKKQALGVKSIQEYHQKP

SEQ ID NO: 23281 - protein, 402 aa, Mycobacterium sp. JLS
MTLQQRWSAVMMNNYGTPALALASGDGAVVTDTDGRSYVDLLGGIAVNILGHRHPAVIEAVTRQLNTLGHTSNLYATEPGIALAEALVGHLGAPARVFFCNSGTEANEVAFKITRLTGRTKIVAAQGAFHGRTMGSLALTGQPSKQAPFEPLPGYVTHVPFGDIDELARAVTSETAAVFLEPIMGEGGVVVPPAGYLAAAREITTRHGALLIVDEVQTGVGRTGVFYAHQHDGITPDVVTLAKGLGGGLPIGACLAVGAVGDLLTPGLHGSTFGGNPVCTAAALAVLKVLADDDLVTRAGVLGKTLSHGIEELNHPLVDHVRGRGLLIGIALRAAAAKPAEAAARAAGFLVNAAAPDVIRLAPPLVVTEAQIDDFLGALPGVLDTAAGGGESTPAASEVADS

SEQ ID NO: 23282 - protein, 372 aa, Shigella flexneri 2a str. 301
MKYDLIIIGSGSVGAAAGYYATRAGLNVLMTDAHMPPHQHGSHHGDTRLIRHAYGEGEKYVPLVLRAQTLWDELSRHNEDDPIFVRSGVINLGPADSAFLANVAHSAEQWQLNVEKLDAQGIMARWPEIRVPDNYIGLFETDSGFLRSELAIKTWIQLAKEAGCAQLFNCPVTAIRHDDDGVTIETVDGEYQAKKAIVCAGTWVKDLLPELPVQPVRKVFAWYQADGRYSVKNKFPAFTGELPNGDQYYGFPAENDALKIGKHNGGQVIHSADERVPFAEVASDGSEAFPFLRNVLPGIGCCLYGAACTYDNSPDEDFIIDTLPGHDNTLLITGLSGHGFKFASVLGEIAADFAQDQKSDFDLTPFRLSRFQ

SEQ ID NO: 23283 - protein, 538 aa, Oryza sativa (indica cultivar-group)
MGVLGDGSGWCFCSGGAKLERIKNSVLAAKGAAVAAVSFPAGGGGGGRGGSGFLIHRALLLTTHGTIPSAAAAAAAEVRLSHGRLPARLVPQRFFITSPILDLTIVGLDVVNDELNSHGQQPHFLKTCLNPSLDLGSTVLLLGHTKRKDLTIGEGKVIITTDNLIKFSTDEVAWYPGSAGFDMHGNLAFMVCDPMKLAPSTPTGYASASSAALLSAKKDVPTQFGMPIPAVCGWLKQHWNGNLEDVSKPMMPPARLISTGQRSECSSVGRLNYIKTMEREGGDGMSSSQIPPRLTQHHGSCSSASAKISCGENDSVDSHSIHEQQDLTSQMHEPKIEQSASLMDNNFPPGHPRSIRLPLPLKHMMSHENKIKPNPSFSHEAQLANVRINCGTLHNVAYQENCWSEAQSSSSPPDISELGDERGGFSSGEETMYSAETRESRNIPSPKEKNPKMVGRSQSFVNHSKWDSPKSVESSKGAPSKSHTFIPLRKPHLQAAAISQKSQDFFSPTVSSSMKKRNLSQIPMKPRQSAQVTSKWII

SEQ ID NO: 23284 - protein, 1469 aa, Gibberella moniliformis
MGQDLPNLRTSPSDATPTRTTRAASSAAPSEQNSIANSDPPFSPWSVGSDKQLGYHSAASDISGDRVFPIRSVISVDPNSSKIASEDYFPTLPERDGRSIPVHIPGAPRADTGSDLRRSDTVPANYHSRAHSERIDTLMRRKNTMSGPMSSIQLDANRHGSSTTPLQLDISTSDNETETEESGPTGHSVPAAAPSGHEADVSSAGQSNADVPLVTSRFTHVVTDDGHAVITGRDGVLQRCEDEPIHTPGAIQTFGALVALREENDGCFVARYISENSERMLGYTPKQLFQLKNFLDILTEEQQDNLLDHIDFIRDEDADPAINGPEVFSLSIRSPKRKSTKLWCAIHINPAHPDLIICEFELDEDAEYPLRPVDELTPDTPHDTLQSNPTLEEIEDSTEVLSKPLRILRSARKRRGEQGAMQVFDIMSQVQEQLSSAPNLEAFLKILVGIVKELTGFHRVMIYQFDSSFNGKVVTELVDTSMTRDLYKGLHFPASDIPRQARDLYKLNKVRLLYDRDQDTSRIVCRTKEDLDVPLDMSHSYLRAMSPIHIKYLKNMAVRSSMSISINAFNELWGLISCHSYGNHGMRVSFPIRKMCRLVGDTASRNIERLSYASRLQARKLINTAPTDKNPSGYIIASSEDLLKLFDADFGLLSIKGETKIMGLVEQSQEALAMLEYLRMRQLTSVVASQDVKEDFPDLRYPPGFQVVAGLLYVPLSVGGNDFIVFFRKGQIKEVKWAGNPYEKFVREGTAGYLEPRKSFKTWNETVVGKCREWNEEQVETAAVLCLVYGKFIEVWRQKEMALQNSKLTRLLLANSAHEVRTPLNAIINYLEIALEGSLDQETRENLARSHSASKSLIYVINDLLDLTKTEEGQNLVKDEVFDLASCIREATGPFLNDAKRKGIHYTVVQHPGLPQFVHGDERRIRQALSNVTANAVAHTHSGYVKVEVFVSEVKDRQAVVDFVIEDSGIGMSASQLDTLFRDLEQVSSEEAPMSGTKLEEMPREMRTLGLGLAVVARIVRNMDGQLRLKSEVGQGSRFVVQLPFLLSNECPSSHGNENLPTSVPTNKSTNSAESANTATSAPLSLTAAPEGEITLVDRVSSMTSAVEGGDASMKGSRASQRSMSSHGSHQSDADRLIDAISTPLSLNDREGSEYPLPASVRSGGSSMRPTSRGAVSLSGRSVSPPQSPVATKPHSEPGSTGVVDSKTPIRAVKIPDEYSDVPQRPQPSEHSRVLFEMKGNDRPVTKAATESITSGGTQMTESQHLEVLVAEDDPINMKILRKRLERVGHGVHHTANGEDCAAAYRERSKEFDVVLMDMQMPIVDGLTSTKMIRSMEASGEHQGHSSLANSNYRIPIFAVSASLVEREKQTYVDAGFDGWILKPIDFKRLNTLLAGISDEEVRKSCLYEPGQWERGGWFLSRAVLGGSVTSDETTPKAVPDAKDKDIGNTVAAEEAKAESDASEPAPST

SEQ ID NO: 23285 - protein, 467 aa, Debaryomyces hansenii CBS767
MSALIAASRSTMAFRAVACTKQYSAGYLQLARLYSSGKFPPHTVINMPALSPTMTQGNIGSWSKSVGDELHAGEAIAEIETDKASMDFEFQEDGYLAKILLGDGTKDVPVGKPIAVYVEESEDVQAFESFTAEDAGDASTEAKAPEPEKESKAEESKPEASEKKSKSESAPAQSKPVAGRIFASPLAKTIALDKGIALKNIKGSGPNGRIVAKDVENFKAPAAAAAAAPSATAAAYEDVPISNMRKTIATRLTQSTQESPSYIVQSQISVSKLLKLRQSLNAAADGRYKLSINDLLIKAIALANLRVPEANSAWLLDQGVIRTYSNVDVSVAVATPTGLITPIIKNAHTKGLSAISNEIKELGKKAKAGKLAPEEYQGGTITISNLGMNHAVNSFTSIINPPQSAIVAIGTVDKKAVPSNVNEQGFVFDDVMTITGTFDHRTVDGALGGEWIKALKTIVENPLEMLV

SEQ ID NO: 23286 - protein, 514 aa, Coprinopsis cinerea okayama7#130
MTNGSSGAGGGMPKHGKVISKLNLPGTTLYEDSSILREEFVRLVVQTLRDVGYIESAATLEAESGYELEAPKVTQFRQYILDGMWLKAEEALDHLNVVDEDDLLDAKFLIKQQKYLELLEAKKTTAALHVLRNELAPLNVDSDHLHTLSSLIMCSEPEDLRRRAQWDGASGDSRRQLLISLHSKLFVKGGFPNVTTTILNVHTDEVWNMEWSHDGRYLASAGKDKMAIIWKMGSTVESGSPQDWTAHVTIPEHPDPIGALAWSVDDTVLVTSAEHLIKMWKAKTGVCIRTLSGHSDTISSLQWLPDGSGFFSGALDRKIVHWDADGKLVDDWGTTAIRITGFCITPDGTRLVAVGMEHIYTPNGHAPDGRGQADGTGSHEASSGSSKGGNKMIVYDIKTKQILWSVRLEGELTSVKVSPNSQYALINHAPEVIYLYDIQNFRLANKYVGQQQGQHIIKSCFGDDHTIRIWEAPPPETLPALPPPQHLESSAMSNGKGKGRVRQPWEDEVDNGIS

SEQ ID NO: 23287 - protein, 254 aa, Oceanicola granulosus HTCC2516
MAEPHGAKFADPELPDLDLSRAALFLDFDGTLVDLADTPSGVAVPSGMPDLMRRLDAATDGRLVIVTGRPISVVSQFLGGYEGNVIGCHGAEERYDGETNPHPLAESDVVHRLGDMVEAFAATHEGLIAERKPTGVVLHFRQVPEQEPDAYAFLHALETAHEDFDLHHSKMAYELRPKGISKDASIKRMMKTAAFAGRCPVFFGDDVTDEPALEWVAGQQDGLAVKVGPGETGANYRLPEPAAVRDQLELWLED

SEQ ID NO: 23288 - protein, 466 aa, Acidobacteria bacterium Ellin345
MSLSTMIPGAIATPRTYVNEVLALVKAKNPAEKEFHQAVQEVLESLIPALERHPEYISHKILERVTEPERLLMFRVPWFDDKGEIQVNRGFRIEMNSAIGPYKGGLRFHPSVNLGILKFLAFEQVFKNSLTTLPMGGGKGGSDFDPKGKSDNEVMRFCQSFMTELQRHIGPDTDVPAGDIGVGGREIGFLFGQYKRLRNEFTGVLTGKGLNWGGSLIRPEATGYGCVYFAEEMLKTVKQTLEGKVCLVSGSGNVSQYTIEKLLDLGAKPIACSDSNGIIHDPAGIDREKLAYILDLKNTKRGRISDYAEKFKTAKYIPVDPKLDHNPLWDIKADCAFPSATQNEINAKDAKNLIKNGCKVVSEGANMPSTLEATNLFLEAGVLYGPAKAANAGGVATSGLEMAQNSARLAWTREEVDHRLHNIMIAIHKNCFETAEKYGKPGNLVVGANIGGFLKIADSMLDQGLV

SEQ ID NO: 23289 - protein, 388 aa, Zea mays
MATAGKVIKCKAAVAWEAGKPLSIEEVEVAPPQAMEVRVKILFTSLCHTDVYFWEAKGQTPVFPRIFGHEAGGRLKILDFASIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 23290 - protein, 416 aa, Oceanicola granulosus HTCC2516
MERLTQRSMAFVLAGGRGSRLKELTDRRVKPAVYFGGKTRIVDFALSNAMNSGIRKIALATQYKAHSLIRHCQRGWNFFRAERNEFLDILPASQRMGGEAWYRGTADAVTQNFDIVDDYDVDYVIILAGDHIYKMDYEIMLRQHVETGADVTIGCLTVPRMEATAFGVMAVDDNGQITDFLEKPADPPGTPDDPDVALASMGIYVFSWKLLRELLLKDADDPDSSHDFGNDLIPDLVKNGKAIAHRFDISCVRDAGAPAYWKDVGTVDAFWEANIDLTNFTPDLDLWDTKWPIWTYSEGVPPAKFIHDERDRRGVAISSMVSGGCIISGTEVRNSLLFTQVHTNSYAVLDHAVVLPHVVVHRSARLRKVVIDSGVEVPEGLVVGEDPLVDQEFFRVTEKGVTLITQPMIEKWKAAQ

SEQ ID NO: 23291 - protein, 681 aa, Oceanicola granulosus HTCC2516
MGATFDGDGVNFAVFSQHAQRIALCLFDEDGRETLNINLPERSGHVWHGYIPGLRPGQLYGYRAHGPYRPDEGHRFNAHKLLLDPYARRLHGKLTWDGSLFGYDVDARHADLTFDTRDSAAHMPRCVVVEEDDGFDWQGDRPLETPMEETVIYEAHVKGLTMLKPGLEQRGTYAALASDPMLEHLTKLGITAIQLLPIHAFLDDEHLLEKGLVNYWGYQTIGFFAPDPRYLSGDDLREIKEMVRRFHAAGIEVILDVVYNHTGEGNHLGPTLSFRGLDNRSYYRLAESPRYYFNDSGTGNSLNVAHPMVLRMVLDSLRHWVETYHVDGFRFDLATSMGRTEHGFDRDAPFFQAIAQDPVLSRVKLTGEPWDVGPGGYQLGAFPNPWCEHNDKYRDEVRSFWRGDADRVRALSARVAGSAMHFDHDGRAASASVNFLSCHDGFTLMDTVSYNHKHNEANGENNADGHDHNASDNCGVEGPTDDPDILEARARRRRNMLATLLLSQGTPMLLAGDELGNSQGGNNNAYCQDNEIGWVTWDGADPAFLDFARQIIHFRRTHPTLRQKRFLHARERLFDGVPDLFWRNRDGSEMTDADWTDPDRRHLIAELRTASGTPAYANVSYAIMAIFNVGGALTVTLPPPKEGWTWIRELDTADPSLGPFAVTKPLKVHANSVVALILRPQ

SEQ ID NO: 23292 - protein, 357 aa, Triticum aestivum
MESTGVARRTSTVQELASALGKPDVPAQYVSRGHHENDQQPAAVPVPVIDIGRLFNQDGAAAADDEAAKLRQALESWGLFLVTNHGVDTSVMDGMMVASREFFRQPPEEKQRYTNLIGGERFQLEGYGTDRVNSSEQILDWSDRLYLKVEPEDERSLALWPAHPQTFRNLLHEFTTKCRVVKDGLVRAMARLLELDNDYIIEQFGEKADTYARFSYYPECPRPELVFGLKPHSDGSVLTVLMVDDTVGGLQILRDGVWFDVPIVPHTLLINIGDQTEIMSNGIFKSPVHRVVTNAEKERLSLALFYSLDPEREIEPATQLVDGKRPALYRKVKVKDYIAGLFEHVSQGTMVIDTVKI

SEQ ID NO: 23293 - protein, 543 aa, Oceanicola granulosus HTCC2516
MQAIHVDTKPIEGQKPGTSGLRKKTRVFMEPHFLENYVQSIFDGIGGITGKTLVVGGDGRYFNDRAIQVILRMMAANGAARAIVGQGGILSTPAASHLIRKRGTDGGLILSASHNPGGPDEDFGLKYNGPNGGPASEGVTDRIFARTREIDGYRIVEAHDVDIGTVGERALGDMAVEVVDPVADYAALMEELFDFDKIKGLLSSGFTLRFDAMHAVTGPYAKAILEDRLGAAEGSVVNAVPSPDFGGGHPDPNPIWAHELMATMTSPEAPDFGAASDGDGDRNMIVGKGAYVTPSDSLAVLVANATLAPAYREGLKGVARSMPTSGAADRVAEALGIDCYETPTGWKFFGNLLDAGRATICGEESAGTGSDHVREKDGLWAVLLWLNILAEKRQPVSQLMAEHWAEYGRNYYSRHDYEAVEADVAAGIMDDLRAALPDLPGREVGGLTVDAADEFSYTDPVDESVARQQGLRIFFEGGGRAVFRLSGTGTEGATIRVYLERLETDSDRLQMGAQEALAPIIAAAEAISGVRARSGRDAPDVIT

SEQ ID NO: 23294 - protein, 325 aa, Aeropyrum pernix K1
MPVMNMVQALNTALREEMRRDKSVVVLGEDVGRRGGVFLVTEGLIDEFGEERVIDTPLTEMGIVAFAIGMAMYGLRPVAEIQFIDFIYEAFDQIVNNAAWYRFRSGGMYNVPLVIRGPCCGGIRGGMHHSQSNEPYFIHTPGLYVVMPSTPYDAKGLLKSSIRSDDAVIFLEPKSIYRTIREEVPDNDYTIPLGQARLVQEGSDVTLVTWGAMVHLAKEAAELLREKRGWSIEIIDLRTLQPWDKDMVVKSLEKTGRLVIVHEARKILGPGAEIAAYISENYIDLLRGPVKRVASYDTPYPLAHEKLYLPNLAKIYRAVTEVMQW

SEQ ID NO: 23295 - protein, 174 aa, Photobacterium profundum SS9
MIRNSIKSISDYPKPGILFRDVTSLMEDPEAYRATMQVLIERYSNTGITKVIGTEARGFLFGAPLALELGVGFVPVRKPGKLPREVISESYELEYGKDILEIHVDAIVEGDKVLLVDDLLATGGTIEATTKLARRLGGVVEDAAFVINLPDIGGAERLKGIGLNVFSICDFDGH

SEQ ID NO: 23296 - protein, 385 aa, Oryza sativa
IPGPGFLISIAYIDPGNFETDLQAGAQYKYELLWIILIASCAALIIQSLAARLGVVTGKPPGPSIAEVEYPKATNFILWILAELAVVACDIPEVIGTAFALNMLFKSLCGVVILITGLSTLMLLLLQQYGVRKLEFLIAILVSLIATCFLVELGYSKPNSSVVVRGLFVPELKGNGATGLAISLLGAMVMPHNLFLHSELVLSRKEKRSVHGIKEACRFYMIESAFLALTIAFLINISIISVNNTVCGSDNLSPEDQMNCSDLDLNKASFLLKNVLGNWSSKLFAVALLASGQSSTITGTYAGQYVMQGFLDLRMTPWIRNLLTRSLAILPSLIVSIIGGSSAAGQLIIIASMILTFEPSFASSSTPKIHKQQDKNGAAHKFKTR

SEQ ID NO: 23297 - protein, 337 aa, Pyrus communis
MGVESVERERESNEGTIPAEFIRSENEQPGITTVHGKVLEVPTIDFSDPDEEKLTVQITEASSNWGMYQIVNHDIPSEVISKLQAVGKEFFELPQEEKEAYAKPPDPGSIEGYGTKLFKEISEGDITKKGWVDNLFNKIWPPSVINYQFWPKNPPSYREANEEYAKHMHKVVEKLFRLLSLGLGLEGQELKKAAGGDNLEYLLKINYYPPCPRPDLALGVVAHTDMSTVTILVPNDVQGLQACKDGRWYDVKYIPNALVIHIGDQMEIMSNGKFKSVLHRTTVNKDKTRISWPVFLEPPADHVVGPHPQLVNAVNQPKYKTKKYGDYVYCKINKLPQ

SEQ ID NO: 23298 - protein, 357 aa, Pyrus communis
MVSSDSVNSRVETLAGSGISTIPKEYIRPKDELVNIGDIFEQEKNNEGPQVPTIDLKEIESDNEKVRAKCREELKKAAVDWGVMHLVNHGISDELMDKVRKAGKAFFDLPIEQKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAECVPNSIVMHIGDTLEILSNGKYKSILHRGMVNKEKVRISWAVFCEPPKEKIILKPLPETVSEDEPAMFPPRTFAEHIQHKLFRKSQEALLPK

SEQ ID NO: 23299 - protein, 376 aa, Bacillus anthracis str. Ames
MAQKQKCVAMLLAGGKGSRLSALTKNLAKPAVPFGGKYRIIDFTLSNCANSGIETVGILTQYQPLELHNYIGIGNAWDLDRVSGGVTVLPPYAESSGVKWYTGTASAIYQNLNYLSQYEPEYVLILSGDHIYKMDYSKMLDYHIEKEADVSISVIEVPWDEASRFGIMNTNEEMEIVEFEEKPQFPRSNLASMGIYIFNWAILKEYLEMDARNPESSNDFGKDVLPLLLDEGKKLMAYPFEGYWKDVGTVKSLWEANMDLLRDETSLNLNDRDWRIYSVNPNEPPQYIAEKAKVEESLINEGCVIEGDVKHSVLFQGVTVEEGSMVIDSVVMPGAKIGKNVVIERAIVGSEMVIEDGTIIRPEKNVDDVVLIAEGK

SEQ ID NO: 23300 - protein, 230 aa, Glycine max
MVFPKLGIIITAALALVPLLFINESDGASYYPSGLHADIAEIAPFASQKVNLSVYYASLSQPCATFIVKNLEEIFHSDLINIVNLQLVPWANAYVDKTNHSIVCQNGPDECELNSLEACALNVLNDVNKHYALIYCFEFLAIEGRHKNWQDCFSQLDLPEELILSCYNRGNGTELGQKSINETALLYAPHEFLPWVMVNNQSIGKEYENFTRYVCEAYKGITAPAACNLH

SEQ ID NO: 23301 - protein, 211 aa, Xanthobacter autotrophicus Py2
MSSGNTTKGAPLRVGIGGPVGSGKTALMEALCKTFRQRYDICAITNDIYTKEDARLLTVAGALEPERILGVETGGCPHTAIREDASINLRAVADMNARFPNLDLVLIESGGDNLAATFSPELADITIYVIDVAGGEKIPRKGGPGITRSDLLVVNKTDLAPMVGADLSIMEADTIRMRAGRPYVFASIRNGVGVEVVARFIEQAGGLVAAA

SEQ ID NO: 23302 - protein, 131 aa, Oryza sativa
  misc_feature (59)..(59): Xaa can be any naturally occurring amino acid
  unsure (1)..(131): unsure at all Xaa locations
MVRTSVLHDALNAINNAEKAGKRQVLIRPSSKVIIKFLQVMQRHGYIGEFEEVDDHRSXGKIVVQLNGRLNKTGVISPRYNVRLSELEKWVVKLLPARQFGYVILTTSAGIMDHEEARRKHVSGKIIGFFY

SEQ ID NO: 23303 - protein, 305 aa, Pseudomonas fluorescens PfO-1
MGTYPLSPSMAAFVARTESFASDDSSLGGLRKSYDDMCRAFTPERPAGLEVVDFQLSGVAVRSYRPPVRPSASGWPCVLYLHGGGWVVGGLDSHDFICCELAMALGAMVVVVDYRLAPEHPFPAGFEDCLSVWRALRSGPFWFDPGRMLVAGDSAGGNLAAALCLALRDAGEPLPGAQVLIYPGLGGDAQLPSRSECADAPLLASSDVDCYHALYLRGTAKPNAYAMPLLAGDFSGLPPAWIAVAQFDPLRDDGVCYAERLDAAGVDAALYYGEGLVHGCLRARHQVAEVDRLFENLLGFMADKM

SEQ ID NO: 23304 - protein, 312 aa, Arabidopsis thaliana
MGEKTANFFSLFLVVADFQNLPCGWRRHARFCLTVVNQISDKLSLHRETERWFDEKIPVHGYEEMISLAKLNVRKGGFLVKNEVKIVVEVDVLQVIGNLDVSEVSSHLHKETSSVDVNGFLVLPSQVESAKLIFERHSDMALEFRAKNQYVRTSCMNVLLSLIDTLCQSLQDFSIDDLGQAERALTYLKDSDFKVDWLERKLEEVKEKKIEEQIGKTRMQELEEEFESRELARILLVASFLMTMQTDYCQQRLSYKEKLSCHGLEEMLLLSELNAKEGGFLVNNEVKIIAEVDVLQVIGKLDVSENTQPRKG

SEQ ID NO: 23305 - protein, 134 aa, Oryza sativa (japonica cultivar-group)
MATCRSRGVERGGAPHVLAVDDSSVDRAVISGILRSSQFRVTAVDSGKRALELLGSEPNVSMIITDYWMPEMTGYELLKKVKESSRLKEIPVVIMSSENVSTRINRCLEEGAEDFLLKPVQPSDVSRLCSRVLR

SEQ ID NO: 23306 - protein, 296 aa, Trichodesmium erythraeum IMS101
MVNFGSVLTAMITPFNLDGSVNYEETEKLSIWLTENGTDSLVVCGTTGESPSLTWEEEYELFQVVQKAVGGKAKVIAGTGSNSTKEAITATEKAAKLGLGGSLQVVPYYNKPPQSGLYRHFQAIAQATPDFPIIIYNIPGRTGKNMEPETVARLAEIPNIVAIKEASGNLDQVSQIRNLTAPEFKIYSGDDYLTLPLMAIGGNGVVSVASHLVGNKLQEMIVAFKTGEVQRATKIHLELFNLSRTLFATTNPIPIKEAMNMLGWNVGKTRLPLCDPPAEITEKLRVEMDKLGLLAR

SEQ ID NO: 23307 - protein, 269 aa, Aeropyrum pernix K1
MSPVLEVIAGLISGIAGGNPIKAAFLLSLYAFAMTSLGGFLVLAARTHGGRLDVLLDVGMGFSSGIMIVASFTSLLLPALEISGPGIVIISFIVGAIAVYIINEILPHEHLIKGYEGPPSFRRKVKAAWLVATAIIIHNLPEGMSIGAAASYAISEGLAVALAIGTQDFPEGLAVSLPVFAASGSLYLALLVAMLSGFSEVVAATIVAALIGYSPGLLASALAFAAGAMVFVVSYEALPESHRSGNEKLATVGFFAGFIIMLYLDTALG

SEQ ID NO: 23308 - protein, 1564 aa, Saccharomyces cerevisiae
MLQAPSSSNSGLNQGNAAPDGPPNETQPYEGLDAAAQEEIKELARTLTSQSSLLSQEKRITGTGDPNTLTAASSSSLSRSIFASDIKGVNPILLDVNDPDYDETLDPRSENFSSVRWVRNMAQICENDSDFYKPFSLGCAWKDLSASGDSADITYQGTFGNMPIKYLKMSWRCISRRLFHRTHGKSEDNDSGFQILKPMDGCINPGELLVVLGRPGAGCTTLLKSISVNTHGFKISPDTIITYNGFSNKEIKNHYRGEVVYNAESDIHIPHLTVFQTLYTVARLKTPRNRIKGVDRDTFAKHMTEVAMATYGLSHTADTKVGNDFVRGVSGGERKRVSIAEVSICGSKFQCWDNATRGLDSATALEFIKALKTQATITKSAATVAIYQCSKDAYDLFDKVCVLYDGYQIFFGPSKQAKKYFQRMGYVCPERQTTADYLTSITSPSERIKDKDMVKHGIMIPQTAYEMNQYWIQSEEYKQLQVQVNKHLDTDSSQQREQIKNAHIAKQSKRARPSSPYTVSFFLQVKYILIRDIWRIKNDPSIQLFTVLSHAAMALILGSMFYEVMLSTTTTTFYYRGAAIFFAILFNAFSSLLEIFSLYETRPITEKHKTYSLYRPSADAFASTFSDVPTKLATAVTFNIPYYFLINLKRDAGAFFFYFLINIITVFAMSHLFRCIGSVSKTLPQAMVPASVLLLAFAMYTGFAIPRVQMLGWSKWISYINPLSYLFESLMINEFHGRNFPCAQYIPSGPNYVNATGDEVTCSALGSIPGNNYVSGDDFIQTNYGYRHKNKWRSVGIGLAYIIFFLFLYLFFCEYNEGAKQNGEMLVFPHSVVKKMKKKGIVSEKKKKNQPTLSTSDAEKDVEMNNNSSATDSRFLRDSDAAIMGNDKTVAKEHYSSPSSSASQSNSFSKSDDIELSKSQAIFHWKNLCYDIPIKNGKRRILDNVDGWVKPGTLTALIGASGAGKTTLLDCLAERTTMGLITGDVFVDGRPRDQSFPRSIGYCQQQDLHLKTATVRESLRFSAYLRQADDVSIEEKDKYVEEVIEVLEMKLYADAIVGVPGEGLNVEQRKRLTIGVELAAKPKLLVFLDEPTSGLDSQTAWSTCQLMKKLASRGQAILCTIHQPSALLMQEFDRLLFLQEGGQTVYFGELGKGCKTMINYFEAHGAHKCPPDANPAEWMLEIVGAAPGTHASQDYFAIWRDSEEYREMQKELDWMERELPKRTEGSSNEEQKEFATSTLYQIKLVSYRLFHQYWRTPFYLWSKFFSTIVSELFIGFTFFKANTSLQGLQNQMLAIFMFTVVFNPILQQYLPLFVQQRELYEARERPSRTFSWKAFIVSQILVEIPWNLLAGTIAFFVYYYPVGFYRNASYANQLHERGALFWLFACAFYVYISSMGVLVISCIEIAENAANLASLFFIMSLSFCGVLATPNILPRFWIFMYRVSPLTYLIDALLSVGLANASVVCSSNELLKIVPPSGMTCSEYMEPYMQSTGTGYLLDGSSETECHFCQFSSTNDYLATVSSSYSRRWMNYGIFSAYIVFDYCAAIFLYWLVRVPKKSKKLKK

SEQ ID NO: 23309 - protein, 1211 aa, Arabidopsis thaliana
MKCFLFSGGDKRGEQKTPISVSLTSIFSDREINRSGSEFNSRDVSGTSTESSMGRKNSYPPVSTRASNLREFSITDLKSATKNFSRSVMIGEGGFGCVFRGTVRNLEDSSVKIEVAVKQLGKRGLQGHKEWVTEVNFLGIVEHTNLVKLLGYCAEDDERGIQRLLVYEYMPNRSVEFHLSPRSLTVLTWDLRLRIAQDAARGLTYLHEEMEFQIIFRDFKSSNILLDEDWKAKLSDFGLARLGPSEGLTHVSTDVVGTMGYAAPEYIQTGRLTSKSDVWGYGVFLYELITGRRPVDRNRPKGEQKLLEWVRPYLSDTRKFKLILDPRLEGKYPIKSVQKLAVVANRCLVRNSKARPKMSEVLEMVNKIVEASSGNGSPQLVPLNSVKASRDARGKNNGGGGEGGWFGKKSKKDFSTAILERKKSPNRLVVDEAINDDNSVVSLHPATMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDDVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVTNEHFHTALGNSNPSALRETVVEVPNVSWNDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGGGSGGDGGGAADRVLNQLLTEMDGMNAKKTVFIIGATNRPDIIDSALLRPGRLDQLIYIPLPDEDSRLNIFKAALRKSPIAKDVDIGALAKYTQGFSGADITEICQRACKYAIRENIEKDIEKEKRRSENPEAMEEDGVDEVSEIKAAHFEESMKYAGRVGRRSVSDADIRKYQAFAQTLQQSRGFGSEFRFENSAGSGATTGVADPFATSAAAAGDDDDLYN

SEQ ID NO: 23310 - protein, 616 aa, Zea mays
MASISGAAAPPSSAVCRLRLRRHLLLRPSHLRLRAPHSIADLSRSSNSAPSPARPALGSGPENGSGGVRAVEKDPIKLWERYVEWLYQHKELGIFVDVSRMGFTEEFLRQMEPRMQQAFVDMRELEKGAIANPDEGRMVGHYWLRDPALAPNSFLRNKIETALDKILAFSQDVISGKILSPSGRFTSILSIGIGGSALGPQFVAEALAPDNPPLKIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVHNFFVTFIEVLRDRPAGHDWELEPGVTCGDYLFGMLQGTRSALYANDRESISVTVQEVTPRAVGALIALYERAVGIYASLVNINAYHQPGVEAGKKAAGEVLALQKRVLTVLKEAICENPTEPLTLDEIADRCHCPEDIEMIYKIIQHMAANDRALIAEGSCGSPRSVKVYLGECSVDEDMQAA

SEQ ID NO: 23311 - protein, 413 aa, Oryza sativa
MPSEFVAARKKPPPELLFAACRKKQQPPPPGMAFVPSEFAAAGVGRKRQPAPPVEIRRVWAHNVEEEFRIIRNAIDHFPYVSMDTEFPGVIHRPTKHPALLTAGDRYDLLRRNVDALHLIQVGITLAASPTAAPALAFEINLSDFDQRVHRHAAESVQLLAEHGVDLAAHRRHGVRASALAPLLMSSGLVCSHGAVKWVTFHSAYDFAYLVKLLMGRKLPRSMAEFLNLVRVFFGDEVYDVKHMMRHCGGELYGGLERVAAALQVKRAAGRCHQAASDSLLTWDVFRRMRELYFLKHGVEAYQGVLFGLELDMDMPSNKTPSLPLDSGSIPLEARSGLPAARSREDGPDGGGPVEVMAARHGRQQGGDNVGDNMAATVTYDHEAGVSATAEAVAACVHQSPGLAWLAVGRWSG

SEQ ID NO: 23312 - protein, 593 aa, Kluyveromyces lactis
MYGNQQNNSNPYQMSYYRMNNGQGQGTNRWPQQLSHQEMLAGHSQQILNTNKPAGNQSKPPIVMASNNVFSIGPYRQRKDSSRISVLQKYEIIGYIAAGTYGKVYKAKARDYQNGMNRDNVIILDSPDSVSADSNLDINSINRSTRQQEANDNLTTMDFRKPSHKRFTPPNNSNSTQIRSNSGSETNVRINSSSITNNSRKPSQIQFYAIKKFKTEREGVEHYTGISQSACREMSLCRELDNNHLTKLVEIFLEKKSIYMVSEFAEHDLLQIIHFHSHPEKRLIPPRMLKSIMWQILDGVSYLHQNWILHRDLKPANIMVTVDGCVKIGDLGLARKFNNMVQTLYTGDKVIVTIWYRAPELILGARHYTPAIDLWAVGCIFAELIGLRPIFKGEEAKMESKKSVLFQANQFQKILEVMGSPDHKIWPNIDSYPEYLQLAKMPKYRDNLTAWYQTAGGKDKTALDILYRLLQYDPIKRIDAIDALDHVYFTNGDPPVCENVFEGLNYKYPPRRIHTNDNDITNVGNDNNQANHSQKQPMHGNNNNKNGNMNGLGVNKRILAAAAAAAAAAAVSGNGNNPTSNTATGGSARKKRK

SEQ ID NO: 23313 - protein, 382 aa, Oryza sativa (japonica cultivar-group)
YMFGEDHKDLRRRIAPNFTPRALSTYAAIQQRVILSHLRRWLDRSAANGGKAEPIRVPCRDMNLETSQTVFAGPYLTKEAREKFERDYNFFNVGLMALPVDLPGFAFRSARLGVARLVRTLGECARASKARMRAGGEPECLVDFWMQETVREIDEAKAAGKPPPAHTDDEELGGFLFDFLFAAQDASTSSLCWAVSALDSHPDVLAGVRAEVASLWSPESGEPITAEKIAEMKYTQAVAREVVRHRPPATLVPHIAGEEFQLTEWYTIPKGTIVFPSVYESSFQGFPEPDTFDPERFFSEARREDVVYKRNFLAFGAGPHQCVGQRYALNHLVLFMALFVSVVDFRRDRTEGCDEPVYMPTIVPRDSCTVYLKQRCAKFPSF

SEQ ID NO: 23314 - protein, 331 aa, Glycine max
MALNNGVPATGTGLIVSFGEMLIDFVPTVSGVSLAEAPGFLKAPGGAPANVAIAVSRLGGKAAFVGKLGDDEFGHMLAGILKENGVRADGINFDQGARTALAFVTLRADGEREFMFYRNPSADMLLKPEELNLELIRSAKVFHYGSISLIVEPCRSAHLKAMEVAKESGCLLSYDPNLRLPLWPSAEEARKQILSIWEKADLIKVSDAELEFLTGSDKIDDESALSLWHPNLKLLLVTLGEHGSRYYTKSFKGSVDAFHVNTVDTTGAGDSFVGALLAKIVDDQSILEDEPRLREVLKFANACGAITTTQKGAIPALPKEEAALKLIKGGS

SEQ ID NO: 23315 - protein, 479 aa, Prochlorococcus marinus str. MIT 9312
MAERFSQKNLRVRPSSEEEKIVTNAKKHFEKTLVEIAGELVGSVAALEHPTKNKKLNYGEIFLRDNVPVMIYLITQKRYEIVKRFLSVCLQLQSTNYQTRGVFPTSFVEENGKLIGDYGQRSIGRITSADASLWWPILCWYYVNKSGDYAFGKSQGVQRGIQLLLDLVLHPTFEGTPVLFVPDCAFMIDRPMDVWGAPLEVEVLLHGCLKSCINLMELSRADHVSRLLDQRLILTNQWVKDLGSFLLKHYWVTSQTMQILRRRPTEQYGDDQHFNEFNVQPQVVPSWLQDWLENRGGYLIGNIRTGRPDFRFYSLGNSLACMFGILPPAEQRALFRLVLHNRQHLMAQMPMRICHPHMDVEEWQNKTGSDPKNWPWSYHNGGHWPSLLWFFGAAVLLHQKNYDSDDVILMEEMKSLIEESYWCQLNQLPKQEWAEYFDGPTGTWVGQQSRTYQTWTIVGFLLMNHFLREENNDLDMFKI

SEQ ID NO: 23316 - protein, 555 aa, Photobacterium profundum SS9
MCSVFGILDIKSDPSALRATALEMSKKMRHRGPDWSGIYSSDKAILVHERLAIVDLNSGEQPLYNQDKTHILAVNGEIYNHKELSAEFAPDYPFQTESDCEIILALYKEKGPELLDYLNGIFGFILYDAVEDAYLIGRDHIGIIPLYQGYDEHGNYYIASEMKALVPICKTISEFPPGSFLWSKKGEPTRYYKRDWMEFETVADAPTDKVALKEALESAVKRQLMTDVPYGVLLSGGLDSSIISAITKKFAARRIEDDEKSQAWWPTLHSFAVGLEDAPDLKAAKIVADSIGTVHHELTYTIQEGIDAIRDVIYHIETYDVTTIRASTPMYLMSRKIRAMGIKMVLSGEGADEVFGGYLYFHKAPNKREFHEETVRKLLALNMFDCARANKSMAAWGIEARVPFLDKEFLEVAMRINPEDKMCGNGKMEKHILRECFEDHLPESVAWRQKEQFSDGVGYSWIDSLKEVAEAKVTEQQLETASFRFPYNTPTTKEGYMYREIFDELFPLESAAKCVPGGPSIACSSAKAIEWDESFKNSADPSGRAIAAVHNEAYK

SEQ ID NO: 23317 - protein, 525 aa, Burkholderia sp. 383
MRIFRFIKIVYTVIRFGLDEVMLSRIDDRRVKLLLRITTIGRRYSDPPAVRLRHALESLGPIFVKFGQVLSTRRDLLSVDFANELAKLQDQVPPFDSAVAIGIIEKSLGAPVDELFDEFEREPIASASIAQVHFAKLKQGQHAGKAVAVKVLRPNMLSVIDSDLALMRDIAIWTERMWADGRRLKPREVVAEFDKYLHDELDLMREAANGSQLRRNFAGLDLLLVPEMFWDFSTSQVLVMERMTGVPISQVETLRSAGVDIKKLAREGVEIFFTQVFRDGFFHADMHPGNIQVSLDPNTFGRYVALDFGIVGALSDFDKNYLAQNFLAFFKRDYHRVATLHLESGWVPPETRVEELESAIRAVCEPYFDRALKDISLGQVLMRLFSTSRRFNVEIQPQLVLLQKTMLNVEGLGRSLDPELDLWKTAKPYLERWMTEQIGLRGWYERFKVEAPQWSKTLPQLPRLIHHAMAARHDAPRAASEDLMRQILVEQKRTNRLLQALLIFGLAVGVGALVARVLILLAYGA

SEQ ID NO: 23318 - protein, 231 aa, Eutrema wasabi
MKIKLSIAIILLSYTVATVAGQQCGRQAGGQTCPGGICCSQWGYCGTTADYCSPNNNCQSNCWASGSSGTGESASNVRATYHFYNPEQNNWDLGAVSAYCSTWNADKQNNWDLGAVSAYCSTWNADKSYAWRSKYGWTAFCGPAGPRGQASCGKCLRVRNTRTNAVVTVRIVDQCSNGGLDLDVAMFNRLDTDGVGYQQGHLIVDYQFVDCGNELIHQPAANSKNILVSPN

SEQ ID NO: 23319 - protein, 464 aa, Bacillus cereus ATCC 14579
MDKNLKKDLKIRHITMISIGGVIGAGLFVGSGAVVHSAGPGSIVSYALAGLLVIFVMRMLGEMAAVNPTSGSFATYAREAIGPWAGYTIGWLYWFFWVIVIAIEATAGAGIIQYWIPQIPLWLLSLILTILLTLTNVFSVKSFGEFEYWFSFIKVISIVLFLCLGLAVILGFVPGTEAPGTSNLIGQGGFMPNGISSVLLGITVVIFSFMGSEIVAVAAGESAEPVKAVKTATNSVIWRILVFFIGSIAVVVTLLPWNSANILKSPFVAVLEHIGIPAAAQIMNFIVLTAVLSCLNSGLYTNSRMLFSMAERGDAPKSFLKLNSSGVPVRAVLFGTFFAYIGVVFSYISPDKVFLFLVNASGGIALLVYLVIAVSHLKMRKKMGKVEQQNLKVKMWLFPYVTYVTIAAIIAVLVAMFAIDTLRSQALLTMFVTVLIILSYFIFNRNKNSTVLNPKSKNEESVRF

SEQ ID NO: 23320 - protein, 694 aa, Sinorhizobium meliloti 1021
MNVSQQIGPRAAASERSMADAIRFLSMDAVEKANSGHPGMPMGMADAVTVLFNRFIRIDPSHPDWPDRDRFVLSAGHGSMLLYSLHHLIGFADMPMAELSSFRQLGSKTAGHPEYGHALGIETTTGPLGQGISTAVGMAIAEQMMAARFGSALCNHFTYVVAGDGCLQEGISHEAIDLAGHLKLRKLVVLWDDNRISIDGSTDLSTSMNQLARFRAAGWDAQAVDGHDPDAVAKAIERARRTRKPSLIACRTRIGKGAASMEGSHKTHGAALGEKEIAATREKLGWPHPPFFVPPEIKAAWEKVATRGRTAREAWEIRLDASRSKKRYEQTVERKLDGEVGDLLARFRGAHRTRATKVATRQASQMALEVINGATALTIGGSADLTGSNLTLTSQTQPISPGNFKGRYLHYGIREHGMAAAMNGIALHGGFIPYGGTFLVFSDYARGAMRLSALMGLPVIYVLTHDSIGLGEDGPTHQPVEHLAMLRATPNLNVFRPADIIETAECWEIAIGEKNTPSVFALSRQALPMLRRTDGNENLSALGAYVLREARGDRDITLLATGSEVEIAVAAAERLQAEERIAAAVVSMPCWEKFEAQDAAYHRQVLGDAPRIAIEAAGRLGWDRWMGPDSAFVGMTGFGASAPAGDLYRHFGITADHVVAEALELLRRACPETPPIGARTGKPVAHIVRSSEEA

SEQ ID NO: 23321 - protein, 349 aa, Sinorhizobium meliloti 1021
MSGATLEAYLASCTARGDDLSRDVAAVIQRLAKAALDIRKLVNQGALGTAFNGTHGGSNTDGDLQKDLDILCDDQFLTCLQGAPVACYASEELENPVLLDPSARLAVAIDPLDGSSNIDNNVSIGTIFSVLPAAKGPDVDPSQSFLQPGNRQLAAGFFIYGPQTALVLSLGKGTEIFIFSSRLGCFVEAYKSAIIPERAHEFAINMSNYRHWEEAIRLYVDDCLAGSEGPRERDFNMRWIASLVAETYRILIRGGIFLYPADGRKGYSQGRLRLVYEANPIAFIIENAGGAATTSIDRILDLVPENLHQRVPLVFGSRREVARITRYHVDPNMIGERAPLFGKRGLFRA

SEQ ID NO: 23322 - protein, 394 aa, Aeropyrum pernix K1
MSQQPECRVEGNYIIVPKGLVNVIVDETRISGVDPKGEATIYRGYTIEDIGEHASFYEAAHLILFGRLPCDEELKEIKSKIDKYRGQIPEKLFDAMKHVPVTHPMYYGIYGTALLGQYYAPEWRFDEDFLYDHALRLTAQLPVIFTTGWNLAHHGTFLRPDPSKDHAWDVLRMIVMREPSDIEARAFESTLVLYMDHGFNASTFTTRVIGSTLSDLYSAVAGGIAALKGPLHGGANEKAMEMFLDAMKKAEEKGVPLYDYIEEYIKEKLARKEKIMGFGHRIYKLHDPRTDVAAKFVAKLKDGEFWMKVLKKAEEVMWREKKIPANIDLYTAVLYYQLGIPIPMYTPIFAMGRVVGWSAHYIEQVLNNKLIRPTEKYVGPTGLKYQPIEERCRK

SEQ ID NO: 23323 - protein, 134 aa, Brassica napus
  misc_feature (9)..(9): Xaa can be any naturally occurring amino acid
  misc_feature (95)..(96): Xaa can be any naturally occurring amino acid
  unsure (1)..(134): unsure at all Xaa locations
FSRPLLSAXPSITVHALQPHDQFIICASDGLWEHMSNQEAVEIVHTHPRNGIAKRLVKMALKEAAKKREMRYSDLKKIDRGVRRHFHDDITVIVXXFDTSLVVSRARGPAVSVRGAGVNLPHNSLAPCTTAGAS

SEQ ID NO: 23324 - protein, 265 aa, Brassica napus
  misc_feature (155)..(155): Xaa can be any naturally occurring amino acid
  misc_feature (161)..(161): Xaa can be any naturally occurring amino acid
  misc_feature (174)..(174): Xaa can be any naturally occurring amino acid
  misc_feature (181)..(181): Xaa can be any naturally occurring amino acid
  unsure (1)..(265): unsure at all Xaa locations
MRTRNKGKVHPSPSPLPPLSSSSKGDDCLSVLKLLPAVILVLVSDLSPEDKQVLAYLITRSLKTTTTTTVNAGGRRSCCDSKNKKSRTHHKAPDFDCECFDCYTSYWFRWDSSPNRELIHQIIEAFEDHLENNNSSAASQKSNGKKKKKDKSSRXRGVEEXPIASEITEPVVVXPCDEVKXPEKSTEMLSLPVAAAPGHKGLAWKVLPDVMGLFNSRFWRLWNPNAMHFGSKQMLVFFFVLESKTKLNAFYMKYLNRTHLVMLVV

SEQ ID NO: 23325 - protein, 266 aa, Caulobacter crescentus CB15
MARRLALITGASAGIGAASARIYASHGYDVALTARRVDRLEGLAAEIKLRSGVEAYAIPADLAEPGGVGAVLAAIAEQGREVDALINNAGYGLPGTYDATSWEDQAKFLQLMLTSVCEMTHKVLPGMVERRFGRIVNVASLAGLVPGAAGHTLYAATKGFLVKFSQSLHLENLANGVHVSALCPGFTYSEFHDVNGTRAQVSQGVPEWMWLGADEVAAAGYEAAEANRSICVPGAPNKAIAAIAKIVPDDWALALMASQGSRFRKV

SEQ ID NO: 23326 - protein, 404 aa, Caulobacter crescentus CB15
MSVTLDLSRVSSDAAPATPVTKPLINLSGLTRPQLVAALVESGVVEHGKAKMRATQIFRWMHHRGVTDFADMSDVAKETRARLAEAFTIARPEIVERQVSKDGTRKWLIRMAPGIEVESVYIPGVGRAGALCVSSQVGCTLNCSFCHTGTQPLVRNLTAAEIVAQVQVAKDDLAEWPSDKEDRQLSNIVFMGMGEPLYNLGQVADAIEIISDNEGIAISRRRITVSTSGVVPMLEKLGSTTQAMLAISLHATNDPLRDVLVPLNKKYPIAELMAGIRAYPGLSNARRVTFEYVMLKGVNDSPEEARALVKLIKGIPAKINLIPFNPWPGSDYQCSDWATIEAFAAILNKAGYSSPIRTPRGRDILAACGQLKSESEKVRASALRKLSLAAMAGVLSDDDEDETA

SEQ ID NO: 23327 - protein, 216 aa, Glycine max
  misc_feature (30)..(30): Xaa can be any naturally occurring amino acid
  unsure (1)..(216): unsure at all Xaa locations
MKKLYHKGTVHPSPPLISDQLSFLPAAILXLAAALSPEDREVLSYLISCSSSATSTSTFSGNARRKTGAETEHSPSFSCSCFCCYTSYWVRWDESPNHQLIHEIIDAYEDSLSKKGNKGKKNGKGKKEKRNNKKGCSSTTTSSNHTHEHAHSSELKRSELASSPSRESAESEPVVEIHTNNISGGESCEGVVVEEKGSVRRFMSFVGERIWGAWGQ

SEQ ID NO: 23328 - protein, 501 aa, Sphingobium chungbukense
MATQLKSTENDYGIKSEYGHYIGGEWIAGDSGKTIDLLNPSTGKVLTKIQAGNAKDIERAIAAAKAAFPKWSQSLPGERQEILIEIARRLKARQSHYATLETLNNGKPMRESMFFDMTQTIGQFELFAGAAYGLHGQTLDYPDAIGIVHREPLGVCAQIIPWNVPMLMMACKIAPALASGNTVVLKPAETVCLSVIEFFVEMADLLPPGVINVVTGYGADVGEALVTSPDVAKVAFTGSIATARRIIQYASANIIPQTLELGGKSAHIVCGDADIDAAVESATMSTVLNKGEVCLAGSRLFLHQSIQDEFLAKFKTALEGIRQGDPLDMATQLGAQASKMQFDKVESYLQLATEEGAEVLTGGTRADAANLAGGNFIKPTVFTNVKNTMRIAQEEIFRPVTTVISWNDQTHMMQQANATTYGLAGGVWTKDLARAHRIARQLETGTVWINRYYNLKANMPLGGYKQNGFGREFSHEVLNHYTQTKSVVVNLQEGRVGMFDQ

SEQ ID NO: 23329 - protein, 361 aa, Glycine max
MGIYLSSPKTEKFSEDGENDCLRYGLSSMQGWRATMEDAHAAYTDLDESTSFFGVYDGHGGKVVAKFCAKFLHQQVLKSETYLTGDIGTSLQKAFLRMDEMMRGQKGWRELSILGDKINKFTGMIEGLIWSPRSSDGNCQVDDWGLEEGPHSDFAGPTSGSTACVAVIRNNQLVVANAGDSRCVISRKGQAYNLSRDHKPDLEIEKDRILKAGGFIHAGRVNGSLNLARAIGDMEFKQNKFLPAEKQIVTANPDINTVELCDEDEFVVLACDGIWDCMSSQQLVDFVREQLHLKTKLSAVCESVLDRCLAPSTAGGEGCDNMTMIVVQFKRPAQSSAPAEEQSSSSNGQAEPETKLERSES

SEQ ID NO: 23330 - protein, 160 aa, Zea mays
MCVCACIMRAPLGGLRSGIMFNDITTLLLRPRVFKDAVDLFVERYRGMGIDAVAGIEARGFVFGPAIALAIGAKFIPLRKPRKLPGEVISVTMHVLVYGTDCLEMRVGAIERSGERVLVIDDLVATGGTLCAAIRLLERAGADVVECACVIGLPKFKVSE

SEQ ID NO: 23331 - protein, 114 aa, Thermobifida fusca YX
MHTAIQELEKAQLRSDVPDFRPGDTLNVHVRVTEGNRTRIQVFKGVVIRRQGSGIRETFTVRKISYAVGVERTFPVHSPVIEKIEVVSRGRVRRAKLYYLRNLRGKAARIRERR

SEQ ID NO: 23332 - protein, 93 aa, Zea mays
  misc_feature (85)..(85): Xaa can be any naturally occurring amino acid
  unsure (1)..(93): unsure at all Xaa locations
TYYATSSLLAPTVMMASSATAVAPFQGLKSTASLPIARRSSRSLGNDRNGGRIRCMQVWPAYGNKKVKTLSYLPPLSTDNLLKQXVDYLLHNR

SEQ ID NO: 23333 - protein, 548 aa, Nicotiana tabacum
MTTTPIANHPNIFTHQSSSSPLAFLNRTSFIPFSSISKRNSVNCNGWRTRCSVAKDYTVPSSAVDGGPAAELDCVIVGAGISGLCIAQVMSANYPNLMVTEARDRAGGNITTVERDGYLWEEGPNSFQPSDPMLTMAVDCGLKDDLVLGDPNAPRFVLWKGKLRPVPSKLTDLAFFDLMSIPGKLRAGFGAIGLRPSPPGHEESVEQFVRRNLGGEVFERLIEPFCSGVYAGDPSKLSMKAAFGKVWKLEETGGSIIGGTFKAIKERSSTPKAPRDPRLPKPKGQTVGSFRKGLRMLPDAISARLGSKLKLSWKLSSITKSEKGGYHLTYETPEGVVSLQSRSIVMTVPSYVASNILRPLSVAAADALSNFYYPPVGAVTITYPQEAIRDERLVDGELKGFGQLHPRTQGVETLGTIYSSSLFPNRAPKGRVLLLNYIGGAKNPEILSKTESQLVEVVDRDLRKMLIKPKAQDPLVVGVRVWPQAIPQFLVGHLDTLSTAKAAMNDNGLEGLFLGGNYVSGVALGRCVEGAYEVASEVTGFLSRYAYK

SEQ ID NO: 23334 - protein, 600 aa, Triticum aestivum
QMKRQEEASWHVRMLTQEIRKSLDRHTILYTTMVELSKTLHLQNCAVWMPNEARTHMILTHHLREREITESHSGSIPISDPDVVEIKATRGAKVLGEGSALGTASRCNPEAGAAVAVIRMPMLRVSNFKGGTPEMMETSYAILVLVLPEDGSLGWGEQELEIVEVIADQVAVALSHAAVLEESQLMREKLAQQHRDLLQAKHEAVMATEARNSFQSAMYDGMRRPMHSVLGLVSMMQQESMNPEQRLVMDAIVKTTSVASTLMNDVMQTSTMDREHLSLVRRPFSLHSLIKEAVSVVRCLCGSKGVDFEFQVENSLPERVVGDEKRVFHIVLHMVGTLINQCRAGCLSLYVNSYNEMDERHNNQDWMLLRRANFSAGYVCVKFEIRIKKSRNSLLDASASQISQEPNASSSEMGLSFNMCKKIVQMMNGNIWSVSDPEGLRETVMLALQFQMQHVTPVSGASSDLYRLSPIPNFNGLHVLLVDGDDTNRAVTHKLLEKLGCRVFSVSSGIQCMTSFAGGESSFQLVLLDLTMHTMDGFEVALAIRKFRSNSWPPLIVALAASSDDNVRDRCQRSGINGLLQKPVTLAALGDEVYRVLQHN

SEQ ID NO: 23335 - protein, 527 aa, Propionibacterium freudenreichii subsp. freudenreichii
MSTTDRVTTPTPTVSGTDAPGPDASHCHLVVVGGGITGLAAAWQGMARGARVSVVESDDHFGGKVVTDRRDGFLVEQGPDSFVAYRPAALKLIEELGLSDQVIAPGGGRRVSLLSRGKLRPMPAGMGMVLPTRMWPFVTTTVLSWPDKIRAGLDLVIPRRLPDHDVAIGAFLRQRLGDGIVRRFADPMVGGIYGAGIDELSLDAVLPSLRDNERDHRSLMVASLAGGRASRRAARQRAAQNNAQQNSSHQNSTGQNNSAGTRGPAASPFRTLRGGLGQLIDALVDQLRAGGVELLVNTSVDLLGRDGVHLSDGRVLPADAVVLAGGVASSARLLRPQLPAAARALAQIPLASTTIVSLAWPVSAFDVAPDSQGWLEADAGPVSGLTASSIKFAGRAPDGSVLMRVFVPDKRGPLTDAPDDELLSAVIDHVRPLLGVHGEPGLTQITRWHKVMPKYTVGHLERAAVVDSTLAEQRPTWAVAGSALHGVGLPDCISDARHSADEVIDAALAATPSAPNRNAATDRTETR

SEQ ID NO: 23336 - protein, 820 aa, Debaryomyces hansenii CBS767
MSFSVPNSVKVSYDDDEIPILSYTNDTPIATGIRSELNRKEYENNTYIDWNKESMLEPKSSDVVYRKWATIIVLSIILGYVTTFIDLASVWLNDVKKGLCYGEMDKWSLSNPYLTCPAEDWYDWSQILVGSQGFISNMFINFPIYFVFAGCWIAVAAYITINRDIFIKQSGIPEIKIIISGFNYDLPVYLGMHTFIYKIFGLILVVSSGLWLGKEGPLVHVSCCILNILYDAIVNKNNQNEAVRRELLSAATATGISVAFNAPIGGVLFVLESMPSFFMPTKVMWNSFLSATTAVVVLTGFKLFTEGENFYEKDLFRVNFGNFSWLFVELIPFVILGVLGAFYGYIFINFNAKFSSKHFRGRVQEKLCQVFKVSDSWGKYLEILTIVVLTTILNFPFEMTKLPLHAFLKILFTDCPDDSNTDLDSNSSNFMCLPSNGITSLKLLYIIVQGFFLTSYTYGVNLPGGVLMPSLVLGATTGRLLGIISQALQNQINWDSLATCTQNSCLVSPSSYAVIGAASFMAGITKLTMCVVVIMFELTGAITYVLPIMCSVMILKFVNDWLCNDNIYDAWLKNHFNRYDSNKGEPNEGKGNGLCDFTNLTATVKNRLPDVTIARAMVPIERTKYVCLIPEQPYTNKTLYQFMNDDNHEGYPLIVNESNPISLGYAYKTNIASKLSTIDDALDDSVISFQIQGLPNHILSQQLHYERSFETKNIIRLDITTENSVIITNDQTPLVLVLEMFEKLSLNYLIIMNHNPHVDQLMSGFIDRFIVSRLINLNFRKLQGEDADSESMQDYDIENMLEDDHLLSTRLDRMSVELIT

SEQ ID NO: 23337 - protein, 702 aa, Oceanicola granulosus HTCC2516
MHNMDAPAAITNRPILAGSDVPLGATWDGSGTNFALFSAHATKVELCLFDNRGRREIERIELPEFTHQVWHGYLPDVRPGQLYGYRVHGPYAPEAGHRFNPNKLLLDPYALQHKGDLRWHDSLFGYKLNHDKADLSFDRRDSAFVMPKCVVVDTAHTWGGDIRPDVPWGRTVVYEAHVGGMTMGHDGIEQPLRGTFEGLADPRVIDHLVSLGVTSLELLPVQAFYDEGYLTEKNLVNWWGYSTLGFFAPAPRYLTPDGSLHEFKLMVRRLHEAGIEVIMDVVYNHTAEGSERGPTLSFRGIDNASYYTLADDPRYYFDTTGCGNSLNLRNSRVLQMVMDSLRYWVEECHVDGFRFDLATTLGRDRDHYSEHAIFLEAVRQDPILAGVKLIAEPWDTGPNGYQVGNFPPGWAEWNDSYRDTTRAYWKGDSGTLPKLASKLLGSADTFNHAGRRPWASVNFITAHDGFTLMDLVSYNDKHNEANGEDNRDGHSHNLSWNCGVEGETDDPGITALRDRQRRNLMATLLFSQGTPMLLMGDERGRSQGGNNNAYCQPGEMNWFGWEASERDEAFERFVRGLVRIRKTKGLFLAERYLHSGADARHNRFAKWLRPDGQRMEEGDWDNGISKAVGLLMHEHDTFLYMVLNASETDLDVYLPGGDKRRWSKLVDTLEGVADPKGRDRIDGGTVPLPARSMLLLETTGRG

SEQ ID NO: 23338 - protein, 456 aa, Photobacterium profundum SS9
MTFGLTKGTTKGGPYWIRIIIIAKEIVMADKKATLHIEGKAPIELPILGGSQGPDVIDVRKLGASGYFTFDPGFLATASCESQITYIDGDKGILLHRGYPIDQLANNADYLEVCYVLLYGEVPTRAQYEFFRTTVTRHTMVHEQIASFFHGFRRDAHPMAVMCGVVGALAAFYHDSLDINNDSHREITAFRLLSKMPTLASMCYKYSIGQPFIFPRNDLDYAENFLHMMFATPCEEYDVSPVIARAMDKIFTLHADHEQNASTSTVRLAGSSGANPFACIAAGIASLWGPAHGGANEACLKMLEEIGSVDKIAEYIERAKDKDDPFRLMGFGHRVYKNYDPRATVMREACHEVLEELNIQDPLLDIAMELERIALSDPYFIDKKLYPNVDFYSGLILKAIGIPISMFTVIFAMSRTVGWIAHWSEMHGDPDNRIGRPRQLYTGKLQREFKPLHERE

SEQ ID NO: 23339 - protein, 311 aa, Zea mays
  misc_feature (94)..(94): Xaa can be any naturally occurring amino acid
  unsure (1)..(311): unsure at all Xaa locations
MAAAAAVASATTAEDEARLLRLEEQAEHGGGGAWEYLCLARRLRARRPAHVLRVGLALLNNASARSGLASEQWTLYEQVATAAMDCQRLDVAKXEDCIGVLSKQFPGSTRVARLEARLFEAKGEWAEAERAYALILENNPFDQIVHKRKIAIAKAQGGMSIVIDYLNKYLELFMADHDAWRELAETYSSLQMYKQAAFCYEELILAQPTIPLYHIAYAEVLYTMGGLENLQTAKKYYASTIQLTGGKNTRALFGVCLCTSAINQLTKGRNKEEEDSELQSLAAEVLLKNYKQQAPSKAPLISSMLKNMKLS

SEQ ID NO: 23340 - protein, 446 aa, Oryza sativa (japonica cultivar-group)
MKQVSCSVVNKCLAYNPCLSRNYYQRSHTVKLQRSQAGQIILPRKLRKSTLWQTNFTQRQIATHCSSDLSTSCREELPSYLTVNVLKDQSCARQGIFRKVIVILNPNSGFRSSREVFYQKVQPTLELSGFMMQVVETAYAGHAHALASTVDLSTCPDGIICVGGDGIVNEVLNGLLGRDDLEEAIQLPIGIIPAGSENSLVWTVLGIRDPVSAATTLAKGGITPIDVFSVKRTQAGITHFGLTASYYGFVADVLQLSEKFRLHFGPFRYVIAGVLKFLSLPQYRFEVNYLPLSPRRNHKLLPVTEKCNDHLAADSSAEDNWVTRKGEFLGIFVCNHFCKPAQGLLSPVIAPKAQHNDGSLDLILVHGSGRLRLFCFFIAYQFCWHLLLPYVEYVKVKHVKVRPIGKTHNGCGVDGELILGEGQTEWQCSLLPAQGRLLGRHRSASE

SEQ ID NO: 23341 - protein, 405 aa, Oryza sativa (japonica cultivar-group)
MQRNGVMECSVCHSKVVAPSPRSVSRAYDKHRSKISSKYRALNFLLVSGDCILVGLQPILVFMSKVDGKFQFSPISVNFLTEVTKVIFAIVMLIIQSRKQKVGEKPLLSLSTFVQAARNNALLAVPALLYAINNYLKFIMQLYFSPATVKMLSNLKVLVIAILLKFIMRRKFSIIQWEALALLLIGISVNQLSSIPDGTKSFGLAVTTIAYIYTLIFVTVPSLASVYNEYALKSQFDTSIYLQNLFLYGYGAIFNFLGILGTVIFQGPESFDILRGHSRATMFLICNNAAQGILSSFFFKYADTILKKYSSTVATIFTGLASAAFLGHTLTVNFLLGISIVFISMHQFFSPLAKVKDDKPAGALEPEDAQNHRSSDSSFVNMTAGAADDASHLTATDERKPLLPI

SEQ ID NO: 23342 - protein, 271 aa, Neisseria meningitidis Z2491
MTMHALPRYAVFGNPVAHSKSPQIHQQFALQEGVDIEYERICADIGGFAQAVSTFFETGGCGANVTVPFKQEAFHLADEHSERALAAGAVNTLIFLKNGKLRGDNTDGIGLANDITQVKNIAIEGKTILLLGAGGAVRGVIPVLKEHRPARIVIANRTRAKAEELAQLFGIEAVPMADVNGGFDIIINGTSGGLNGQIPDIPPDIFQNCALAYDMVYGCAAKPFLDFARQSGAKKTADGLGMLVGQAAASYALWRGFTPDIRPVIEYMKAL

SEQ ID NO: 23343 - protein, 120 aa, Gloeobacter violaceus PCC 7421
MDLDLQTVERAVRAVRLGAIGAAGLASMAERSLAVAEFAGEHARAGGLTRQTLSERAAEDELMWLFRVGVVRREVDGQGITDRFRLTPLGNRVLTEVRRADLPALSPLDQVGNLLTRWLS

SEQ ID NO: 23344 - protein, 248 aa, Synechocystis sp. PCC 6803
MLKAVLLDFNGVVINDEAIHRSLIDELLLTENLRPLTPAEYQQFCLGRSDRACLVDLFEHRGRGLTEAYLQKLIDRKAESYHQKLVALETLPIYGGLKEFLEKLQLRRLAIALVTGAVRSEVEYGLDRAGLARYFPVIVAGDDIASSKPQPDGYQLAIHKLNQWRQSQAVTDSLLDDIAPLLPENCLAIEDTFAGIEAAKKAGMAVVGIAHTYPYHFMQRQANWAVDRFDELDLDRLQVIFSRPKLAV

SEQ ID NO: 23345 - protein, 364 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTRQVTEAVCNAIAGSNILKMAAAE

SEQ ID NO: 23346 - protein, 364 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTADTQQVTDAVCEAIAGSNILNMAAVG

SEQ ID NO: 23347 - protein, 656 aa, Bradyrhizobium sp. BTAi1
MCGIAGLFRPGGADDSALAGIVGRMTAALAHRGPDASGSWVSGRQGIALGQRRLAILDLSEAGAQPMHSACGRYTITFNGEIYNHLDLRAELEDAAAAPNWRGHSDTETLLAAIRQWGLVPALQRLIGMFAFALWDAETRQLILARDRFGEKPLFYGWSGADLVFGSELKALAAHPGWAPSLDRAALTDFMRYSYVPAPATIWRDVRKLPPASFVAFVADAGPGTSPTAQSYWSLRDTVVAAQGDRISGESEAIARLEQLLSTAVKRQCLSDVPLGAFLSGGVDSSTIVALMQAQASQPVRTFSIGFAEGGYNEAEDARKVAQHLGTDHTELYVDARTAMEVVPKLPRIYDEPFADSSQIPTHLVAQLARRHVTVALSGDAGDELFGGYNRHVWGSALQARLGRVPMPLRRAIGAALGAIAPEPADTLLNMLQPVLPARLRVRHAGDQVAKLARIVAADGFDGLYRTLCSIDQDPRATVVAGEERASWAASEMKQLRGQISLLDRMTLADSLSYLSDDILQKVDRAAMAVALETRVPFLDRDVVEFSTRVPASMKVRDGRGKWLVRQVLYRHVPADMIDRPKTGFSIPLDAWLRGPLKSWAGDLLSPARLKRQGLFAPTRVTRMFEEHLSRRHNHAYWLWNVLMAEAWYDEWGRAG

SEQ ID NO: 23348 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMSAVERVTEAGILTPDVGGTANTSQVTEAVCNAIAGSNII

SEQ ID NO: 23349 - protein, 250 aa, Triticum aestivum
  misc_feature (83)..(83): Xaa can be any naturally occurring amino acid
  misc_feature (210)..(210): Xaa can be any naturally occurring amino acid
  misc_feature (235)..(235): Xaa can be any naturally occurring amino acid
  unsure (1)..(250): unsure at all Xaa locations
NKFVQKSRLVPVRNSRDIVDPRVRRPPKGVLLYGPPGTGKTLMARACAAQTNATFLKLAGPQLVQMFIGDGAKPVRDAFELPXAKSKAPCIIFIDEIDAIGTKRFDSEVSGDREVQRTMLELLNQLDGFSSDERIKVIAATNRADILDPALLRSGRLDRKIEFPHPTEEARARILQIHSRKMNVHPDVNFEELARSTDDFNGAQLKGWLXVEAGMLALRRDATEVIPEDFNEGIXIQVQAKKKPSLNYSA

SEQ ID NO: 23350 - protein, 255 aa, Zea mays
  misc_feature (194)..(194): Xaa can be any naturally occurring amino acid
  misc_feature (206)..(206): Xaa can be any naturally occurring amino acid
  misc_feature (247)..(247): Xaa can be any naturally occurring amino acid
  unsure (1)..(255): unsure at all Xaa locations
MEEEVAALVIDNGSGMCKAGFAGDDAPRAVFPSIVGRPRHHGIMIGMGQKDSYVGDEAQSKRGILTLRYPIEHGVVTNWDDMEKIWHHTFYNELRVAPEEHPVLLTEAPINPKSNREKMTQIVFETFNAPAFYVSIQAVLSLYASGRTTGIVLDSGDGVTHVVPIYEGFALPHAISRVDMAGRDLTHYLMNDLXAERGYTFSTTAXEREIVRDIKEKLCYVALDFEQEIQTASQSSSLEKSYELPDXQVITFGNE

SEQ ID NO: 23351 - protein, 358 aa, Agrobacterium vitis
MREYKIAAIPADGIGPEVIAAGLQVLEALEKRSGDFSIHTETFDWGSDYYKKNGVMMPADGLEQLKKFDAIFFGAVGAPDVPDHITLWGLRLPICQGFDQYANVRPTKVLPGITPPLRNCGPGDLDWVIVRENSEGEYSGHGGRAHKGLPEEVGTEVAIFTRVGVTRIMRYAFKLAQARPRKLLTVVTKSNAQRHGMVMWDEIAAEVSKEFPDVTWDKMLVDAMTVRMTLKPQSLDTIVATNLHADILSDLAGALAGSLGVAPTANIDPERRFPSMFEPIHGSAFDITGKGIANPVATFWTAAQMLEHLGEKDAATRLMSAVERVTEAGILTPDVGGTANTQQVTDAVCEAIAGSNIL

SEQ ID NO: 23352 - protein, 358 aa, Agrobacterium vitis
MREYKIAAIPADGIGPEVIAAGLQVLEALEQRSGDFKIHTETFDWGSDYYKKHGVMMPADGLDKLKKFDAIFFGAVGAPDVPDHITLWGLRLPICQGFDQYANVRPTKILPGITPPLRNCGPGDLDWVIVRENSEGEYSGHGGRAHRGLPEEVGTEVAIFTRVGVTRIMRYAFKLAQARPRKLLTVVTKSNAQRHGMVMWDEIAAEVATEFPDVTWDKMLVDAMTVRMTLKPETLDTIVATNLHADILSDLAGALAGSLGVAPTANIDPERRFPSMFEPIHGSAFDITGKGIANPIATFWTAAQMLEHLGERDAAARLMGAVERVTEAGILTPDVGGTANTSQVTEAVCNAIAGSNII

SEQ ID NO: 23353 - protein, 324 aa, Neisseria meningitidis Z2491
MAGNEKYLDWAREVLHTEAEGLREIAADLDENFALAADALLHCKGRVVITGMGKSGHIGRKMAATMASTGTPAFFVHPAEAAHGDLGMIVDNDVVVAISNSGESDEIAAIIPALKRKDITLVCITARPDSTMARHADIHITASVSKEACPLGLAPTTSTTAVMALGDALAVVLLRARAFTPDDFALSHPAGSLGKRLLLRVADIMHKGGGLPAVRLGTPLKEAIVSMSEKGLGMLAVTDGQGRLKGVFTDGDLRRLFQECDNFTGLSIDEVMHTHPKTISAERLATEALKVMQANHVNGLLVTDADGVLIGALNMHDLLAARIV

SEQ ID NO: 23354 - protein, 473 aa, Sulfolobus acidocaldarius
MPGLPKNEHEALEFLKSNNIKWVDLQFTDLLGKLQHITIPSNEFDESSFKVGFGKLDGSSIKGFTSIYESDMVLLPIPQTMTLIPWMQGVARVLTKVFWGGGKGRFERDPRGIAEEAEKYQSEQGYVSYFGPELEFFVFDKVEVDASLPQSGTGYKIHSREAPWSKNGGYVIRYKEGYYPASPVVQLMDIRLEIISTLVDYFGTIEAAHHEVATAGQGDIDFRFSTLADTADKVQVLKYVTKNIASKRGMIATFMPKPFFGDNGSGMHTHFSLWTKDGKNLMYDPNDEYAELSQIGRYIIGPLLEHGRALSAIVVAGTTNSYRRLVPGYEAPVYLVWSKSNRSAAIRIPAYYKGMEKAKRLEYRPPDPSSNPYLVFSAILMAGLDGIRRKLDPGDPVDENIYHMSEEKKRSLKIRELPGSLDEALNELESDNEFLKPVFNSSILQAYLDLKKEEAKMMQLYPHPMEIYQYLDS

SEQ ID NO: 23355 - protein, 365 aa, Thermobifida fusca YX
MPAELTFVAPRRTPPPRHLADLDPQERRDAVAELGEKPFRARQLAQHYFGRLEADTARMTDLPAASRERLGEALLPQLLTPVKHVTCDNGMTRKTLWRAFDGVLVESVLMRYPDRVTLCVSSQAGCGMNCPFCATGQAGLTRNLSTAEIVDQVVSSARDLARGTVAGGPGRISNIVFMGMGEPLANYKRVLAAIRRITDPVPDGLGISQRGITVSTVGLVPAIEKLTAERMQVRLAVSLHAPDDELRDELVPVNHRWKVAEVLDAAWRYADTTGRRVSIEYALIRDINDQAWRADLLGRLVAGRLAHVNLIPLNPTPGSKWTASRPEVEREFVRRLRSHGVSVTVRDTRGREIDGACGQLAASGA

SEQ ID NO: 23356 - protein, 358 aa, Oryza sativa (japonica cultivar-group)
MVSSPSLWRPPVPIKDAIEQDAITPFPKPEAPEEEEEESQGDCYRRLMSSLPVKVYGERRYLEYQATWWPESAVQAVIAIQRRFRPRPSDVLLASYPKSGTTWMKALVFAIMSRKVYPLRDHPLLRLNPHDCVVHLSGAYATGKEAVVEALPSPRIMAVHMPFSTLPASVVVDSSSGCKIVYVWRDPKDVLVSLWHYYRKLRPEEAHVSEFHDLYESFCQGDTVFGPWWDNVLGYFRASVEMPTRVLFLRYEDMLEDTASAVVAIANFVGCPFSAEEERAGVVDAIVKLCSFEELKNLDTNMSGSNGHLIKLPSSSYFRKGVAGDWVGHMTREMADRIDSIIQGKFQGSGLEIKRAST

SEQ ID NO: 23357 - protein, 954 aa, Oryza sativa (japonica cultivar-group)
MAVGEECAAAVASQVRHRWLAAAFFSSVDVAIVAGLPRVPTNYRDAPTCGMWGPHVSRCFIATFFNKPLGVLLGFVTDARAYWVTRSLIAWNVNDQDTSLFLYASRDATMHVSDGAIHGYDSKIELEPEHASLPDNVAEKFPFIRSYRTFRVPSSVDVASLVKCQLAVASYDAHGRHQDVTGLQLPGVLDDMFAYTGPLGAVFSDKDVDLYLWAPTAQDVRVCFYDGPAGPLLQTVQLKELNGVWSVTVPRYRENQYYLYEVKVYHPSTSQVEKCLADDPYARGLSANGTRTWLVDINSETLKPASWDELSDEKPNLESFSDISIYELHIRDFSAHDSTVDCNSRGGFRAFTFQDSAGIRHLRKLSAAGLTHVHLLPSFHFASVDDNKSNWKFVDEAQLAKLPPGSDEQQAAIVSIQQEDPYNWGYDPVLWGVPKGSYASNPDGPSRIIEYRQMVQALNRIGLRVVMDVVYNHLDSSGPFGVSSVLDKIVPGYYLRRNVNGQIENSAAMNNTASEHFMVDRLIVDDLLNWAINYKVDGFRFDLMGHIMKSTMIRAKSAIRSLTRDVHGVDGSKIYLYGEGWDFGEVAQNKRGINASQINMSGTGIGSFNDRIRDSVNGGNPFGNPLQQGFSTGLFLEPNGYYQGNEADTRRELATYADHIQIGLAGNLKDYVLRTHTGEAKKGSDIYTFDGSPVGYTSSPVETINYVSAHDNETLFDIVSIKTPIGLSIDEKCRINHLASSMIALSQGIPFFHAGDEILRSKSLDRDSYNSGDWFNKLDFTYETNNWGVGLPPRDKNEENWHLIKPRLENPSFRPLKNHILSVFDNFVDILKIRYSSPLFRLSTASDIEQRVRFHNTGPSMVPGVIVMSIKDAQNEKCKMAQLDKNFSYVVTIFNVCPHEVSIEIHDLASLGLELHPIQVNSSDALVRQSAYEASKGRFTVPRRTTAVFVQPRC

SEQ ID NO: 23358 - protein, 635 aa, Saccharomyces cerevisiae
MSGARSTTAGAVPSAATTSTTSTTSNSKDSDSNESLYPLALLMDELKHDDIANRVEAMKKLDTIALALGPERTRNELIPFLTEVAQDDEDEVFAVLAEQLGKFVPYIGGPQYATILLPVLEILASAEETLVREKAVDSLNNVAQELSQEQLFSDFVPLIEHLATADWFSSKVSACGLFKSVIVRIKDDSLRKNILALYLQLAQDDTPMVKRAVGKNLPILIDLLTQNLGLSTDEDWDYISNIFQKIINDNQDSVKFLAVDCLISILKFFNAKGDESHTQDLLNSAVKLIGDEAWRVRYMAADRFSDLASQFSSNQAYIDELVQPFLNLCEDNEGDLREAVAKQVSGFAKFLNDPSTILNKILPAVENLSMDESETVRSALASKITNIVLLLNKDQVINNFLPILLNMLRDEFPDVRLNIIASLKVVNDVIGIELLSDSLLPAITELAKDVNWRVRMAIIEYIPILAEQLGMQFFDQQLSDLCLSWLWDTVYSIREAAVNNLKRLTEIFGSDWCRDEIISRLLKFDLQLLENFVSRFTILSALTTLVPVVSLDVVTEQLLPFISHLADDGVPNIRFNVAKSYAVIVKVLIKDEAKYDALIKNTILPSLQTLFQDEDVDVKYFAKKSLAECQELLKN

SEQ ID NO: 23359 - protein, 218 aa, Pseudomonas cichorii
MALSALLFDLDGTLIDTDELHLNAYNQLLARWERSMDLSYYKAHVMGFPDDMIFGGLFPDIPASQYADMAAQKEAMFRAQLKETIPVPGVLRILDHARSTGLRTAVVTNAPRENAMAMLTGLGIIDRFETIVIGGELERGKPHPMPYLTALELLGASADNALAFEDSLAGVQSANAAGIHTFGVLSGLDEKQLRAAGAKSVIRDFNDEVLWDLLKSSS

SEQ ID NO: 23360 - protein, 417 aa, Streptomyces coelicolor A3(2)
MTVSVTLPALGESVTEGTVTRWLKQVGDRVEADEPLLEVSTDKVDTEIPSPAAGVLLEILAAEDETVEVGAGLGIIGAPDTAPAAPAAPAAPAPAPAPTPTPTPTPTPTASAPAPTPAPAPAPAPAPAPAEPFVPPAASAVPAPPAPAPAPTTPQAPAPAPAPVRAAPAEDASSLRGRTVAMTRIRRAIGNNLKKALLEQAQLTSTVEADVTRLMRLRNRAKDGFLAREGLKLSPMPFFVKAAAQALKAHPVVNARINEDEGTITYFDSENIGIAVDTEAGLMTPVVKAAGDLTVAGLARAVHDLADRARGGHLTPDDVSGATFTISNTGSRGALFDTVIVPPNQAAILGVGATVRRPGVVRVGDEEVIGVRDLVHLSLSYDHRLVDGADAARYLTAVKALLESAAFEDDLYPDAAA

SEQ ID NO: 23361 - protein, 895 aa, Streptomyces coelicolor A3(2)
MSDPSRPTENPVISELDQLPDRDREETAEWRASLDAVVRNAGPERAVYLMRRVHEFAASTGMSLPGLLHSDYINTVPAAAQPEFDGDLEMESRITALNRWNAAAMVTRGARLGLGGHISTYASAAWLYEIGFHHFFRGKDADGSGDQLFVQGHASPGIYARVFLEGRLSESQLDSFRREAGGHGLPSYPHPRRLPWLWEFPTVSMGLGPLSAVYQARFNRYLHARGIKDTSASRVWAFLGDGEMDEPESTAALTLASRENLDNLTFVINCNLQRLDGPVRSNSKIVQELEARFRGAGWNVVKTLWGEAWDPLLAQDTTGDLVRRLGEVPDAQMQTLAARDAAYIRKHFFTGDALSALSASLSDARVVELFENSRGGHEPLKVYAAYRAAVEHRGAPTVVLAQTVKGHTLGPAFESRNANHQMKKLTMEQFRAMRDLLELPIPDSALAGDQVPFWHPGQDSPEVRYLHERRAALGGPAPVRRVVAKPLPEPPAKPFEDLEKGSGHQEMATTMALVRLVKDLMRDPRSGARWVPIVPDEARTFGMESMFPTAGIYSPQGQTYDPVDADQLLHYLESTTGQLLIEGITEAGSVAEFAAAATSYATHGEPMIPFYIFYAMFGFQRTGDQFWALGDQMGRGFVVGGTAGRTTMTGEGLQHGDGHSHLLAATNPAAVSYDPAFAYEIAVIVRDGLRRMYGERPENVFYYLTVYNEPKHQPAMPPVPGIEEGIVRGIYRFRPAEAPAAGPRLQLLASGTAIHWVLRAQELLASDWGVHADVWSVTSWTELRRDAMRADDARTRGEERTPFVTRALSGAPGPVLAVSDWMRQVPDQISQWVEQDYYSLGTDGFGLSDTREDVRRYFRVDAESIVVTALDRLARAGQVPPETVARARAQYGLGR

SEQ ID NO: 23362 - protein, 380 aa, Methanocaldococcus jannaschii DSM 2661
MSENMATIPIGPIHPVLKEPLRIKLVLDGEKPVDAEIEMGYVHRGIEKIMEGKHCHKGIHLAERVCGICSYVHTMTFAECIEHISKIEIPDKAKYLRVVTCELERIHSHLIASAVYNLSIEHETLAMWLLNVREIIMDLMEMITGNRVNMGYNVIGGVRRDINREMMDEIYKKLDIFEDELKNIIEVFETGPLIALRSKEIGILPYHEVMRTRAVGPICRGSGLPESDWRLRHSTYQELKFKPVWREEGDNFARMMVRHEEIIESVRLIREALEHYEECSGDIRVKAEIKGGKGEWRNEAPRGEVTYRMEITDGGIIKRIMIRTPTVMNLEAYKYMLKTCPTVADAVSAYTSIDPCVSCTERCIVAVKDGKEIPISIKFR

SEQ ID NO: 23363 - protein, 195 aa, Thiomicrospira crunogena XCL-2
MRQATIQRNTLETKIELSVNLDGTGKADLNTGVPFLEHMLDQIARHGLIDLTIKADGDTHIDDHHTVEDIGISLGMALKEAVGDKKGIKRYGHSYVPLDEALSRVVIDLSGRPGLVFKADFTRASIGGFDTELVAEFFQGFTNHAQATLHIDCLRGKNAHHQAETIFKAFGRALRMALEADERMADQLPSTKGAL

SEQ ID NO: 23364 - protein, 334 aa, Frankia sp. EAN1pec
MADIQRAAGISDLDTGDARPAPRRKTLSSPYLHRLQRRHFLLFDIIPILGTIAALGFLTVHPFGFTELGLLASMWLLTGLGVTVGYHRLFTHRTFRTTRGVSSVLAVLGSMAGQGGMVSWVALHRRHHECSDRAGDPHSPNLAGGGLRGRLRGLAHSHFLWMRRHEYPNIAHYAPDLLRDRALARIGRRYDHWVLLGLLIPTLVGGLVYWSWAGAVSGLLWGGLVRIFVLEHIIWSINSFLHMFGTRAFDSRENSRNGGVFGLLTLGESWHHNHHAFPESPSFGLAWHRLDPGYWLIRTLAACGLAWDLKVPSTERIAARRVPRTAGTAAGPAT

SEQ ID NO: 23365 - protein, 367 aa, Arabidopsis thaliana
MMKKRNTVYLSEDLIVEILSRVSAVSLARLRTTSKRWNALVKDERLAKKHSAYAPRQSLVITLIDSRVYLMNVSLQYGIEKVDLSAKLTGQFSLKDPLSNSLEEVDIRNVFHCDGLLLCSTKDNRLVVWNPCSGETRWIQPRSSYKVSDIYALGYDNTSSCHKILRMDRSEDRIPIQTEYQVYDFTSKSWLVDGVAGGLFIPSIGTRRRGLSVKGNTYWLALTEDGPPFDMFLLCFDFSTDGFRRLSLPTDTPCTYYDVSLSVTREEQQLCMFKSHGSELWIATKMESTGAISWSKSHRFHFRIDEMTVLADQEKPVFVYRFKPKSNMLHIVGEHIYIIQVDQHSADSKCPYLLTYVPSLVQIQQSI

SEQ ID NO: 23366 - protein, 114 aa, Synechocystis sp. PCC 6803
MAEDTIFSKIIRREIPAAIVYEDDLCLAFKDVNPQAPVHVLLIPKKPLPQLSAATPEDHALLGHLLLKAKEVAADLGIGDQFRLVINNGAEVGQTVFHLHLHILGGRPFSWPPG

SEQ ID NO: 23367 - protein, 256 aa, Frankia sp. EAN1pec
MNLEKYGPWALVVGGSEGIGESYARKLAAQGFKLVLTARKTGPLQVLADDLRAGGAEVRILSVDLSEPDALERTRSVTDDIEVGLLIYNAGANSVRGDFVGLDPAVYRSVIAVNVLGQAEFARHYGGLMCARKRGGIILSGSGASFMGAPSLAAYCGSKAFSRIFSEALWIECEQYGVDVLHLSIGFTATPAMARLGYPLDAAQAPDEAAQEALDNIANGPLWIAGGQSSLETAVNRSTVPGRAEAVRAFATPGRF

SEQ ID NO: 23368 - protein, 1075 aa, Porphyromonas gingivalis W83
MIDKSKIKKVLLLGSGALKIGEAGEFDYSGSQALKAIREEGIRTVLVNPNIATVQTSEGIADEIYFLPVTPYFVEKVIEKERPDGILLAFGGQTALNCGVELYRSGVLEKYGVEVLGTPVQAIMDTEDRELFVRKLDEINVKTIQSQAVESVEEARKAARELGYPVIVRAAYALGGLGSGFCDDEDELNILCEKAFSFSPQVLVEKSLKGWKEVEYEVVRDRFDNCITVCNMENFDPLGIHTGESIVIAPSQTLTNSEYHKLRELAIRIIRHIGIVGECNVQYALDPDSEDYRVIEVNARLSRSSALASKATGYPLAFVAAKLGLGYGLFDLKNSVTQTTSAFFEPALDYVVCKIPRWDLGKFHGVSRQLGSSMKSVGEVMAIGRTFEEAIQKGLRMIGQGMHGFVENKELVIPNIDKALNEPTDRRIFVISKAFRQGYTVDKIHELTKIDRWFLEKLYGIVTLAEEMEEFDKLEDLSPALLAEAKLRGFSDFQVARAVLKPDATSMESATNQVRAMRKELGILPVVKRIDTLAAEYPAHTNYLYLTYSGDRHDVAYENDKRSVVVLGSGAYRIGSSVEFDWCGVNALATIRKEGYRSVMINYNPETVSTDYDISDRLYFDELTFERVMDILELENPHGVIVSTGGQIPNNLAVRLDEQHVPILGTSAQSIDNAEDRHKFSAMLDKLGIDQPRWQELSSMDDIDGFVAEVGYPVLVRPSYVLSGAAMNVCSNDEELHRFLELAANVSKQHPVVVSQFIEHAKEVEMDAVARDGEIIAYAISEHIEFAGVHSGDATIQFPAQKLYVETVRRIKRISREIAKALKISGPFNIQFLAKGNDIKVIECNLRASRSFPFVSKVLKINFIELATRIMLGLPVEKPNKSEFDLDYVGIKASQFSFTRLQKADPVLGVDMTSTGEVGCIADDTDEAVLKSMLSVGYRIPQKSVLLSTGGYKQKVDMLDATTMLAAKGYKIYATEGTHNFLRENGIESTKVFWPSENGQPQALELLHNREIELVVNINKNLTAGELTNGYKLRRAAIDLNIPLVTNARLASAFITAFCKHSPEDIRIKSWAEYK

SEQ ID NO: 23369 - protein, 647 aa, Porphyromonas gingivalis W83
MRYGFMKVAAAVPFVKVADCEYNIERIDRMVHEADAKGVEIMTFPELSITGYSCGDLFFQPFLQERANEALCRLVEQTANTTVMVIVGMPLRVEEKLFNSAVVFQQGKILGAIPKTYLPNYREFQEARWFSPAHTLQYSTISIGQHSVPIGRNLIFKCGTVGVGIEICEDMWTPFTPGTRLCLYGAEVIFNLSSSNENAGKHSYLRSLISGLSSQGICAYVYASSGYGESSTDIVFTGKAFIAEAGEIVEEMERFRYEERMIISDIDVSRIQTERLINSSFKAAVTFHTHDEKFNQLPFKLRSRQESLPMTRRVDRNPFMPEDKDRKERSREMINIQVCGLMQRLLHMGAEHAVIGISGGLDSALALIVCAQAFDRLDLPRKNIIAVTMPGFGTSDRTYRNAFALMEAIGVTIKEIDIKEACLRHFEAIGHNPEVQDTTFENTQARERTQILMNLANIYNAPVIGTGDLSELALGWVTYNGDHMSMYAVNAGIAKTTVQILVDHIAHSGWLDEAASAVLLDIVRTPISPELKPVGQDGNISQKTEDLVGPYELHDFFIYHFLHNEYKPSKIYYLAGVAFKGIYTKAEIKKWMMVFFRRFFAQQYKRNCMPDGPKVSCISLSPRGAWRMASDASSALWLDEIAKFETD

SEQ ID NO: 23370 - protein, 257 aa, Zea mays
MASRKFFVGGNWKCNGTGEDVKKIVTVLNQAEVPSEDVVAEVVVSPPFVFLQQVKGLLRLDFAVAAQNCWVRKGGAFTGEISAEMLVNLQVPWVILGHSERRALLGESSDFVADKVAYALTQGLKVIACIGETLEQREAGTTMDVVAAQTKAIAEKISDWTNIVLAYEPVWAIGTGKVATPAQAQEVHDGLRKWLHSNVSPAVAELTRIIYGGSVNGANCKELAAQPDVDGFLVGGASLKPEFVDIIKSATVKSSSA

SEQ ID NO: 23371 - protein, 303 aa, Streptococcus agalactiae A909
MSNIVIIGSISMDLVMETNRIAKEGETVFGQRFSMVPGGKGANQAVAIGRLSQDRDNITILGAIGEDSFGPILLDNLNKNHVTTDFVGTIPPSSGVAQITLYNNDNRIIYCPGANGKVDTKKWSQEWAIIKKADLVVLQNEIPHQANMKIANFCKEHSIKLLYNPAPSRETDIEMLDKVDYFTPNEHECQELFPNQKLEDILATYPEKLIVTLGTKGAIYSDGKESHLIPALETKAVDTTGAGDTFNGAFGYAISKKFKIANALRFATLAAHLSVQKFGAQGGMPTIKEMEDNQHYEKDWHIK

SEQ ID NO: 23372 - protein, 448 aa, Thermobifida fusca YX
MASEHADLPQERRLVTEIPGPRSRALQERRTAAVAQGVGSSLPVYVVRASGGIVEDVDGNRLIDFGSGIAVTNVGNANPRVVARASEQLARFTHTCFMINPYEGYVDVCEALNRITPGDHEKRSILVNSGAEAVENAVKIARHATGRQAVVVFDHAYHGRTNLTMALTARNMPYKQGFGPFAGEVYRMPMAYPFRWPTGPDNCGPEAAAQAIDLITTQIGPENVAAVLIEPIQGEGGFIVPGEGFLPALVEFCRKHGIVFIADEIQTGFARTGRLFACEHEGIVPDLITTAKGIAGGLPLAAVTGRAELMDAVHGGGLGGTYGGNPVACAAALAALETIEQDNLVERARAIGDVLLSRLRALAERYDIIGDVRGRGAMVAMELVAGAGDKTPNPEALASVVKYCHAKGLILLTAGTYGNVIRLLPPLVISDALLDEGLTIIEEAFAQL

SEQ ID NO: 23373 - protein, 610 aa, Medicago truncatula
MNCFPCFTSQKSKKSNSRRENGVAPPQENNNLITRTPDIKKPKPADDPNQVDTSNIQAQNFTFRELAIATKNFRQECLMGEGGFGRVYKGTIPATGQVVAVKQLDRNGIQGSKEFLVEVLMLSLLNHENLVKLTGYCADGDQRLLVYEFMSGGSLESCLLERKNDQDPLDWYSRMKIASNTAKGLWYLHDKANPSIIYRDLKSSNILLDKDLNAKLSDYGLAKLAGKDKANIVPTRVMGTYGYSAPEYVRTGNLTLKSDVYSFGVVLLELITGRRAVDTTRSHDEQNLVSWAQPIFRDPKRYGDMADPNLNKNYPEKDLNQVVAIAAMCLQEESAARPLMSDVVTALSFLSTSPPPEAVPAPLPPPNCTSQKSVATADESESEDDNDSHSSDEERSVHEDKKSITATSAKHQEYDDVSDTEGDYYDNENQHDYSSQDAKETKEFYSKSSCKSSTKSRKGTVSSGRRNNSSSDSENDHESSRRKHEVDGSLTQKSSKKSAARDLSQKSSKKSTVTKDLSQKSSKKSSARVVSRSSHSSSDEESHDGGVLLKRGDSRPSHDGNGYSFGLVSSDSEEGSHFDRTSTRGSEEGSFHHFQHSSSRKSDEGSVHSR

SEQ ID NO: 23374 - protein, 392 aa, Mycobacterium leprae
MCGRRLGRQRRRVPVGGDFPAPRGAAADAVLLNPDRVHRKALVAFRKAGGRIVENVSAATDLVIDGVVGISGSGPLRPAAAAVFATVSASGVPVVAVDLPSGIDVVTGVINGPAVHAALTVTFGGLKPVHALADCGDVTLVDIGLDLPDSDILGLQAADVAAYWPVPGVHDDKYTQGVTGVLAGSSTYPGAAVLCTGAAVAATSGMVRYAGSAYTQVLAHWPEVIASATPTAAGRVQSWVVGPGLGIDATATAALWFALETDLPVLVDADGLTMLAAHPDLVINRNAPTVLTPHASEFARLAGTPPGDDRVGACRKLADSFGATVLLKGNVTVIADPGGPVYLNPAGQSWAATAGSGDVLSGMIGALLAAGLPAPRPRRGIRARACASAVGC

SEQ ID NO: 23375 - protein, 215 aa, Nicotiana tabacum
MGYWQAKVVPKFKQIFDKNGPKKAAAAEACKTFDEAKEQYSKEFEEKKTELQPKVVEIYEAAAVEIKTLVKGPKVSGLKKHSTQVQKFLDELVKIEFPGSKAVSEASSNFGPSYVSGPVLFVFEKVSTFIVTEDKKEEEAAASEAEATTAAPVEVKEKEIVAEAEAKKEEEPAPAPAATPAAEVAPAEVAPAADVAPAKVEEAPAAVAAPEPPKA

SEQ ID NO: 23376 - protein, 265 aa, Triticum aestivum
NKFAQKSRLVPVLNSRDIVDPRVRIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNGTSPTAKAKLRLLFEVAPLGVL

SEQ ID NO: 23377 - protein, 219 aa, Oryza sativa (japonica cultivar-group)
METELCSSRVLSPPRYESGDEELSVLPRHTKVIVTGNNRTKSVLVGLQGVVKKAVGLGGWHWLVLKNGVEVKLQRNALSVLEPPTGNEDDDDIDGNNSFCSSSDMGDKDMDYSSIEYHKPTKPRVRHTRPWSSCIKSSNRGNFHPSTKLRTRVNLTKLGTPTLWRYWKHFNLVSMNPNPSKEQLFHGVQQHFQSQQLDELQVILGFIQAAKRLKTLYRS

SEQ ID NO: 23378 - protein, 316 aa, Streptomyces coelicolor A3(2)
MSDIVLEPAAQDFADATAKPPLLYELGVEGARKLLDDVQSGPVEKPDVDEKWITVPVEVGDVRVRIVKPAGTTGVLPVVLYVHGGGWILGNAGTHDRLVRELAVGAEAAVVFVEYDRSPEAKYPVAIEQAYATAQWVTTKGAEEGLDGSRMVVAGDSVGGNMSAALTHMAKRRGDVTFLHQSLYYPVTDAGQDTESYRLFAHGPHLTAKAMEWFWNAYAPDPAERDQITASPLRATPEDLQGLPPAFVVVDENDVLRDEGEAYARKLIQAGVPTTSVRYNASLHDFMMLNPVRGTQASTAAIEQAIHVLRSALGTD

SEQ ID NO: 23379 - protein, 407 aa, Oryza sativa
NCQTCVLATLLCSDTCLKLKTIEEKIGRGCRGGRKEGRKKATMVDLVNGVLNWVATPAMVASLLLFYPPYYLFKTVHSFLSYLFPDDLARKVVLITGASSGIGEQLAYNYALNRASLVLVARREWSLRKVADQAFELGAPDVIILPGDVANPEDCKRFVQTAIDHYGRCKSPISLICSVNFFSKMDHLVCNAGIASVGAFQEIPDVTNYSSQFDVNFWGSVQSTFEALPHLKRSRGRIVVTASATGWNPVPRMTFYNAANAALINFYETLRTELGSQVGITIVTPGWIESEMSKGKFLKDHGEMEVDQEMRDAQIGLFPVEYAKNCAKAMVQAVRQGKRCLTVPPWFSTMYLWRVFAPEVVEFCYRLLYMHRHGGSQADAPSKKMAEAGGKKLLYPTSLRSDDIKDE

SEQ ID NO: 23380 - protein, 106 aa, Thiomicrospira crunogena XCL-2
MTPEKSIFSKIIDREIPSEIVYEDEKCIVINDINPKARIHLLVIPKKPIATLFDLAPEDKDLMGHMMLLLPQLAQSQGLDGFKTQIHTGESGGQEVFHIHIHLLGN

SEQ ID NO: 23381 - protein, 498 aa, Ostreococcus tauri
MTDSSELGRTSGHADSTRASGARDRGRRTSQAAIEEKAHQGSRETSDHRGRLSPGRVVEEDFERGEGAQGGMKSGEHRVKLGRTLDAKDKHLRDDSYRYGSDEDDEDEDEAEDEDEDVGRGRRASAFDADGDWDEDEIDERDGEYEEAEITAEEAAALEAFMAPKTGKDRTLADMILEKIEEHERGGAETMRDEDGDAIPEGLDQRVIEIYKQVGKLLSRYTTGKIPKAFKVIPALSNWEEVLYITDPERWSPHAMYAATRLFASNLNVAMAQRFYNLVLLPRVRQDIADNRRLHFALYMSLKKATFKPAAFFKGMLLPLCQSRTCTVREAVIFSSVLQRCSVPALHSAAVLMKMSTMEYAGTTSFFMRVLLDKKYALPFSVVDALVDHFLRFSTEERDLPVVWHQTLLTFVQRYKAVIDKDSKKLLFKLVTMKSHYLITPEIRRELAHGKSRGEKDAMDMSGSGGAMGGFSKSVKVKALEESARDMPAIPMLADDQY

SEQ ID NO: 23382 - protein, 397 aa, Oryza sativa (indica cultivar-group)
MERYKIIKEVGDGTFGSVWRAINKESGEVVAIKKMKKKYYSWEECINLREVKSLRRMNHPNIVKLKEVIRENDMLFFVFEYMECNLYQLMKSRGKPFSETEVRNWCFQIFQALSHMHQRGYFHRDLKPENLLVTKELIKIADFGLAREISSEPPYTEYVSTRWYRAPEVLLQASVYNSAVDMWAMGAIIAELFSLRPLFPGSNEADEIYKICSILGTPNQRTWAEGLQLAASIRFQFPQWLCSWDPQRRPTAVEVLQHPFFQPCFYIPPSLRFRSTNGYAATPPSVGAKGAVDQKNARRYSVGPLSNGRPAVNYSYLSANTPARAAGVQRKLELDHQVNMNSCQAPEGNHKLTKAEAMNQPWSRPPPAAAAVRSNGVQTFDVTWCKIFVGELNRAYS

SEQ ID NO: 23383 - protein, 386 aa, Magnetospirillum magnetotacticum MS-1
MVMPTYARSDLAFERGEGAYLFTMDGRRFLDFASGVAVNALGHCHPRLVKALAGQAAKVWHTSNLYRVPGQESVAAKLVGQSFADTVFFCNSGAEALECCIKMARRYHFAAGNPQRTRIICAEGAFHGRTLATVAAGGQKKHLEGFAPAVDGFDHVPFGNLNALRAAITEESAAILVEPVQGEGGIVPGDPDYLRRLRATADEFGLLLIFDEVQTGMGRTGTLFAHEQAGIAPDIMGLAKGLGGGFPVGACLATAKAASGMVPGTHGSTFGGNPLAMAVADEVMTIMAEPGFLDHVRAVAQKLRTGVEEAASRFPDVIEEVRGLGLMLGFKPRMPNTDMVARLAANGLLSVGAGDNMVRLLPPLIINDAQVDEAVGILARTFGEVK

SEQ ID NO: 23384 - protein, 332 aa, Neisseria meningitidis Z2491
MSRPVPAVFGSVFHSQMPVLAYREGKWQPTEWQSSQDLSLVPGAHALHYGSECFEGLKAFRQADGKIVLFRPTANIARMRQSADILHLPRPETQAYLDALVELVKRAADEIPDAPAALYLRPTLIGTDPVIGKAGSPSETALLYILASPVGDYFKVGSPVKILVETEHIRCAPHMGRVKCGGNYASAMHWVLKAKAEYGANQVLFCPNGDVQETGASNFILINGDEIITKPLTDEFLHGVTRDSVLTVAKDLGYTVSERNFTVDELKAAVENGAEAILTGTAAVISPVTSFVIGGKEIEVKSQERGYAIRKAITDIQYGLAEDKYGWLVEVC

SEQ ID NO: 23385 - protein, 405 aa, Bradyrhizobium japonicum USDA 110
MIVMTNSAAPHLLPVFARSDLGFERGEGCWLIATNGDRYLDFTSGVAVNALGHAHPALVKALQEQATKLWHMSNLFQSPDGEKLATRLCNESFADFVFFCNSGAEALEGVIKLVRHHHFSKGHPERYRIITFEGAFHGRTLATLAATGSAKYLEGFGPPMDGFDQVPHGDIEAVKKAIGPQTAGILIEPIQGEGGVRSATPAFLKALRQLCDEKGLLLAFDEVQTGMGRTGDLFAHRRTGVTPDVMSLAKALGGGFPIGAILATADAAAGMGPGSHGSTFGGNPLAIAAANAVLDVMLKPGFFDHVQKMSLLLKQKLASVIDRHGDVVSEVRGEGLLIGIKAVVPSGDLVAALRNEKLLTVGAGDNVVRFLPPLIVTEAEIEDSVGRLERACAAISSSQTKRAAS

SEQ ID NO: 23386 - protein, 306 aa, Triticum aestivum
  misc_feature (261)..(261): Xaa can be any naturally occurring amino acid
  unsure (1)..(306): unsure at all Xaa locations
MEGDESFLGMLNFGVSTQVPDSPVGEQESPMLPTQKTSTTVKGKSTKGKNWSIEEDNLLVAAWVHTNLDALIETDQTSNSYWGRIYDYYSTRKKVSWPVRVQNALNCRWTTINEQVSKFCGYYQQILNRNQSGVTIAQQQAQALVLYQSKDPKKRPFTLMHCWLVLEKHPKWENRVISKGPQKKQKKTSDASPGTTSNDEDFERCTDALETETRPDGNKREKTHLQKAKASASDAFSPKLSLENVWAQKLKKAEVKVTKRXEMSYKQFELEEKIMSMDTTVMIGAQQEYYMNKQNEIAARRFNTSG

SEQ ID NO: 23387 - protein, 547 aa, Neisseria meningitidis Z2491
MNAFTRAWYALERHYQDTRHVLLRDRFACEPDRFERMHERLDGMLFDYSKNRLGEDTLQLLCRLAETADLEGKMRALRTGAKVNNSEGRAALHTALRLPDGAGAVYADGRDVLPEIRRELNRALKFAHSLDDGSYQGTTGKRITDFVHIGIGGSDLGPAMCVQALEPFRRHIAVHFAANADPACLDEVLCRLNPETTVFCVASKSFKTPETLLNAEAVKAWYRGAGFSESETGCHFCAVSADTEAAQSFGIAAERVFAMYDWVGGRYSVWSPVGLPVMVAVGGARFRELLAGAHAMDSHFFHTPPRRNIPVLMALIAVWYNNFQHADGQTAVPYSHNLRLLPAWLNQLDMESLGKSRASDGSPAACKTGGIVFGGEGVNCQHAYFQLLHQGTRLIPCDFIVPMTAQGVEDGRSRFTVANAFAQAEALMKGKTLDEARAELADLPEAERERLAPHKEFPGNRPSNSILLERLTPYNLGMLMAAYEHKTFVQGVIWDINPFDQWGVEYGKQLAKTIIGELEGGTSVHDASTEGLMAFYRECRLKGGGAA

SEQ ID NO: 23388 - protein, 944 aa, Frankia sp. EAN1pec
MAQDTTRKFSVITDGLPSQLPDIDPSETSEWLESLDAVIEESGRGRARFLMLKLLERAREKAVGVPGLTSTDFINTIPPEQEPWFPGDEHVERRIRAYIRWNAAIMVSRANRPEYNVGGHIATYASSASLYEVGFNHFFRGKDHLTSSPGSDSGDQIFIQGHASPGIYARAFLEGRLTEAQLDAFRREGEPGGLSSYPHPRLMPDFWEFPTVSMGLGPIDAIYQARFNRYLLNRQIKDTSRSKVWAFLGDGEMDEPESIGALGVAAREELDNLIFVVNCNLQRLDGPVRGNGKIMQELESLFRGAGWNVIKVVWGRDWDPLLAKDTDGVLVHRMNTTPDGQFQTYSTSSGDYIREHFFGADARLRRMVTDLADEDLSKLSRGGHDYRKLYAAYKAATEHAGQPTVILAHTIKGWTLGKDFEGRNATHQMKKLTKTELKELRDRLYLEIPDSALDGNLPPYYRPGPDSEEIQYMRERRAGLGGSIPRRVVHARTLPQPPKSIFDELRRGSGKQPVATTMAIVRLLKDLMKTKEMGARFVPVIPDEARTFGMDAMFPTAKIYSPHGQRYEAVDRELLLSYRESESGQMLHEGISEAGSMGSVIAAATAYSTHGQHMIPVYVFYSMFGFQRTGDQMWALGDQLGRAFLLGATAGRTTLNGEGLQHQDGHSLLLASTNPACVSYDPAFAFEISHIVRDALDRMYGERNENVFYYLTVYNEPVPQPAEPTGVDPTQIIAGMYRFRTADALTGGEETPTGPVEDGATESSTTTQAQLLASGTGMRWALAAQEMLAADYGIAADVWSVTSWNELRREALVCERRNLLNPEQPPAVPYISQILNGAPGPVIAVSDWMRAVPDQISRWVPQPYTSLGTDGFGRSDTRAALRRHFNVDAESVVVATLEALTRTGDVEQATVDDAIRRYGLRKDGANEAALGNGATEENDQPVSG

SEQ ID NO: 23389 - protein, 117 aa, Triticum aestivum
PHKTPARAPGAMALLATTPLLALVGAGGVMGYMKSGSQKSLAAGGISALVLFFVHTQLPVRPVFASAIGLGISAALLSVMGSRFKKSGKIFPAGVVSLLSLVMVGGYAHGIMRSSHA

SEQ ID NO: 23390 - protein, 428 aa, Bacillus cereus ATCC 14579
MEVYTMKFPHDFLFGAASASYQVEGAWNEDGKGVTNWDEFSKIPGKTYNGTNGDVAVDHYHRYKEDVRLMAEMGLESYRFSISWARILPTGDGKVNEKGIEFYNNLIDECLKYGIVPFVTLYHWDLPLPLEKDGGWTNKRTAEAFVKYAETCFKAFGDRVKHWITFNETVMFCGLGYLKGAHPPGIQNDVPKYFQATHYVFYAHAKTVAVYKQLKQYGEIGITHVFLPAYSVDDQKENIQAANHANEYETYWYYDPILKGEYPSYVVQQLKEKGWTPNWTVEELEIIKQNAEENDFIGLNYYQPIRVERYDMDIKSEEHSRENSTLAPGNPSFDGFYRTVKMDDKTYTKWGWEISPEGFLEGLHMLKARYGDIKMYVTENGLGDEDPIIDGEIVDVPRIKFIEAHLKVMKRAIEEGINLKRLLCMVSD

SEQ ID NO: 23391 - protein, 497 aa, Pseudomonas fluorescens Pf-5
MTTLTRADWEQRARDLKIEGRAYINGEYTASASSDTFECISPVDGRVLATIASCDAADAQRAVENARATFNSGAWSRLAPAKRKSVMIRFAGLLKQHAEELALLETLDMGKPISDSLDIDVPGAAQALSWSGEAIDKIYDEVAATPHDQLGLVTREPVGVVAAIVPWNFPLMMACWKLGPALSTGNSVILKPSEKSPLTAIRIAALAVEAGIPAGVFNVLPGYGHTVGKALALHMDVDTLVFTGSTKIAKQLLVYSGESNMKRVWLEAGGKSPNIVFADAPDLQAAAESAASAIAFNQGEVCTAGSRLLVERSIKDKFLPLVIEALKGWKPGNPLDPATNVGALVDTQQMNTVLSYIEAGHADGAKLVAGGKRTLEETGGTYVEPTIFDGVSNAMKIAQEEIFGPVLSVIAFDSVEEAIQIANDTPYGLAAAVWTANISKAHQTAKALRAGSVWVNQYDGGDMTAPFGGFKQSGNGRDKSLHAFDKYTELKATWIKL

SEQ ID NO: 23392 - protein, 519 aa, Saccharomyces cerevisiae
MFSRSTLCLKTSASSIGRLQLRYFSHLPMTVPIKLPNGLEYEQPTGLFINNKFVPSKQNKTFEVINPSTEEEICHIYEGREDDVEEAVQAADRAFSNGSWNGIDPIDRGKALYRLAELIEQDKDVIASIETLDNGKAISSSRGDVDLVINYLKSSAGFADKIDGRMIDTGRTHFSYTKRQPLGVCGQIIPWNFPLLMWAWKIAPALVTGNTVVLKTAESTPLSALYVSKYIPQAGIPPGVINIVSGFGKIVGEAITNHPKIKKVAFTGSTATGRHIYQSAAAGLKKVTLELGGKSPNIVFADAELKKAVQNIILGIYYNSGEVCCAGSRVYVEESIYDKFIEEFKAASESIKVGDPFDESTFQGAQTSQMQLNKILKYVDIGKNEGATLITGGERLGSKGYFIKPTVFGDVKEDMRIVKEEIFGPVVTVTKFKSADEVINMANDSEYGLAAGIHTSNINTALKVADRVNAGTVWINTYNDFHHAVPFGGFNASGLGREMSVDALQNYLQVKAVRAKLDE

SEQ ID NO: 23393 - protein, 454 aa, Saccharomyces cerevisiae
MSEPEFQQAYEEVVSSLEDSTLFEQHPEYRKVLPIVSVPERIIQFRVTWENDKGEQEVAQGYRVQYNSAKGPYKGGLRFHPSVNLSILKFLGFEQIFKNSLTGLDMGGGKGGLCVDLKGRSNNEIRRICYAFMRELSRHIGQDTDVPAGDIGVGGREIGYLFGAYRSYKNSWEGVLTGKGLNWGGSLIRPEATGYGLVYYTQAMIDYATNGKESFEGKRVTISGSGNVAQYAALKVIELGGTVVSLSDSKGCIISETGITSEQVADISSAKVNFKSLEQIVNEYSTFSENKVQYIAGARPWTHVQKVDIALPCATQNEVSGEEAKALVAQGVKFIAEGSNMGSTPEAIAVFETARSTATGPSEAVWYGPPKAANLGGVAVSGLEMAQNSQRITWTSERVDQELKRIMINCFNECIDYAKKYTKDGKVLPSLVKGANIASFIKVSDAMFDQGDVF

SEQ ID NO: 23394 - protein, 678 aa, Saccharomyces cerevisiae
MTQFTDIDKLAVSTIRILAVDTVSKANSGHPGAPLGRSPAAHVLGESNAHEPNQPKTGSTEIDLSCLTVTRSLCCIYLHLTGYDLSIEDLKQFRQLGSRTPGHPEFELPGVEVTTGPLGQGISNAVGMAMAQANLDMPLTTSRAFTLSDNYTYVFLGDGCLQEGISSEASSLAGHLKLGNLIAIYDDNKITIDGATSISFDEDVAKRYEAYGWEVLYVENGNEDLAGIAKAIRQRKLSKDKPTFDQNDHNHWLRFLRSGSHSVHGAPLKADDVKQLKSKFGFNPDKSFVVPQEVYDHYQKTILKPGVEANNKWNKLFSEYQKKFPELGAELARRLSGQLPANWESKLPTYTAKDSAVATRKLSETVLEDVYNQLPELIGGSADLVLPILTPSNLTRWKEALSFQPPSSGSGNYSGRYIRYGIREHAMGAIMNGISAFGANYKPYGGTFLNFVSYAAGAVRLSALSGHPVIWVATHDSIGVGEDGPTHQPIETLAHFRSLPNIQVWRPADGNEVSAAYKNSLESKHTPSIIALSPDKTCHNWKVALIESASKGGYVLQDVANPDIILVATGSEVSLSVEAAKTLAAKNIKARVVSLPDFFTFDKQPLEYRLSVLPDNVPIMSVEVLATTCWGKYAHQSFGIDRFGAPVRHQKSSSSSVSPQKVLLKELKRPLHSIRVTS

SEQ ID NO: 23395 - protein, 563 aa, Photobacterium profundum SS9
MDKVWLNRYPEDVPAEINPDAYPSLVEMFEQSVHKFADQTAFINMGQVMTFRKLEERSRAFAAYLQNDLKLKKGDRVAVMMPNLLQYPIALFGILRAGCVVVNVNPLYTPRELEHQLNDSGAKAIVIVSNFAHTLEKVVKNTCVSHVILTSLGDQLSRPKGTLVNFVVKYVKKMVPKYHLPHATSMRAALKKGRRMQYVKPFLSGEDTAFLQYTGGTTGVAKGAILTHRNMLANVMQAKGAYGPVLTDSRELIVTALPLYHVFALTVNCLLFIEIGGQNLLITNPRDIPTFVKELQRYQFTAITGVNTLFNALLNNEDFHELDFSKLRLSVGGGMAVQRAVAEKWKDITKTYLLEGYGLTECAPLVAAYPHNLVDYNGSIGLPVPSTDVRIVDDEGNVLPNDQTGELQVRGPQVMKGYWERPEATKDVLTDDGWLSTGDVVRFDDEGFLHIVDRKKDMILVSGFNVYPNEIEDVIALHPKVLEVAAIGQEHEVSGEIVKVCVVPRDSSLTRDELLTHCREYLTGYKIPRIVEFREELPKTSVGKILRRALREESGNAAKSQDA

SEQ ID NO: 23396 - protein, 339 aa, Prochlorococcus marinus str. MIT 9211
MSSLLEQLSSMTIVVADTGDLEAIRTFKPRDATTNPSLILAAAQVPGYQKLIDEALKSSREEIGIRGSFQEVVKEALDQICVVFGKEILKNIPGRVSTEVDARLSFDTQATVEKARKLIRLYNKAGIKNDRVLIKIASTWEGIKAAEVLEREGIHCNLTLLFNFCQAAACAEAGVTLISPFVGRILDWYKANTGIANYPGPEDPGVISVTKIFNYFKSNNYKTEVMGASFRNIEEIVELAGCDLLTISPKLLDQLSNTNVPLEKKLDSLNPKPVGQKIDIDHEKFESMMNSDSMAFEKLDEGIKKFSKAIDDLEIRLLERIAILEEGKSFALSGNAISS

SEQ ID NO: 23397 - protein, 665 aa, Ostreococcus tauri
MSASRGRSIVVNVATPSGKGQAEPKRSKVEIIKERSDYLRHPLIEELATTASSISEDAAQLYKFHGGYQQDDREKRAFGEGKFYQFMMRTKQPGGKVPNKLYLTMDDLAMTHGNGTLRLTTRQTYQLHGILKSDLKETFSTVIRNMGSTLGACGDINRNVTAAPAPYAKREEYHIAQELADDIAALLAPQSGAYYDVWLDGEQIMTAEKPEVTAARNENRNGTNFEDCPEPIYGQLFLPRKFKIGVTVEGDNHIDVLTNDIAIVVVMRDGKHVGYNVYVGGGMGRSHRNDATFPRAATLLGFCGPRDILYAVKAIVCTQRDYGRRDDRKQSRLKYLVESWGMERFKTVTEGYYGKKFEPGMELAPFEFPTYLGWNEQGDGKLWYGVHVQNGRLRGEMKKALRNVIERYELPVRLTANQDLLLTDVDPAWKADIMATLKAAGVKDVTEVDALERLSMACPALPLCGLAITEAERGLPEINKRLRGVMTKVGLATSEDILIRMTGCPNGCARPYMAELGFVGDGPASYQIWLGGTRAMTGVAEAFADRVKVADMETFFEPIFAMWAQQRQDKEYFGDFVNRVGFDAVRAFSKSYVPAPTAAAAPAAAAASPAAAAASPAAVETGGRLPRVMIERDAFEALQVYAEKKNTTLTQATTDAIMKMIADDK

SEQ ID NO: 23398 - protein, 253 aa, Pseudomonas cichorii
MEQRCEVAVLGLGAMGTATLYQLAKAGVSAIGVDRHSPPHTCGSSHGDTRITRLSVGEGPQYLPLVRNSHAIWRDLEALSGEALFEQCGVLVMSSHPAYDPQDPQDFTHKTIELARAYGVEHEVLSAQSIRQRFPQFAPVLDNAIGYFEPGGGYVRPERCIDVQLKLAKVHGARVLTDETVTHLQTHGEGVRITTDKGSILADKVVVSAGMWSADLLGAPFDRLLKVCRQKLFWFELAEQAVFAPVSPSFILD

SEQ ID NO: 23399 - protein, 463 aa, Zea mays
MATYDKAIESYKKAVTTAASLAASAMLVRGVVNELVPYEVRDLLFSGLGYLRSRMSSRHTVVIEETEGWTSNQLYDAARTYLATRINTDMQRLRVSRVDEGKSLMFSMEEGEEMADVHAGAEFRWRLVCRDGAGNGAGNGAGNGHGHGHARGGSYRVEVRSFEMSFHRRHKEKAIASYLPHILAEAKKIKDQDRTLKIYMNEGESWFAIDLHHPSTFTTLAMDRKMKRAVMDDLERFVRRKEYYRRIGKAWKRGYLLYGPPGTGKSSLIAAMANYLKFDVYDLELTEVNWNSTLRRLLIGMTNRSILVIEDIDCSLDLQQRADEAQDAGTKSNPSEDKVTLSGLLNFVDGLWSTSGEERIIIFTTNYKERLDPALLRPGRMDMHIHMGYCCPESFRILASNYHSITDHDTYPEIEALITEVMVTPAEVAEVLMRNEDTDVALEGLIQFLNGKKDHAKDDSRQG

SEQ ID NO: 23400 - protein, 328 aa, Oryza sativa (japonica cultivar-group)
TGGSLKDSFLDEGFILDKKIGLGQPKRIENAKILVANTAMDTDKVKIYGARVRVDSMAKVAEIEAAEKQKMREKVQKIIGHGINCFVNRQLIYNFPEELFADAGILAIEHADFEGIERLALVTGGDIASTFDNPESVKLGHCKVIEEIMIGEDRLIHFSGVEMGQACTIVLRGASEHVLDEAERSLHDALCVLSQTVNDTRVLYGGGWPEMVMAKEVDGLARKTPGKKSHAIEAFSRALQSIPTIIADNAGLDSADLISQLRAEHHKEQSTAGIDVISGGVGDMEKLGISESFKAKQAVLMSATEAAEMILRVDEIVTCAPRRREDRM

SEQ ID NO: 23401 - protein, 374 aa, Campylobacter coli RM2228
MELSYYEILEITQSADKDTIKKAYRKMALKYHPDRNQGDKEAEDKFKLVNEAYEVLSNEEKRAIYDRYGKDALKGGGFGSGGAGFGGFEDLGDIFSSFFGGGFSGASQRRKKSSDEKFQAELVVNLKLSFKEAVFGCKKNIDFTYKSSCKTCSGTGAKDGKLQTCPKCKGRGQVGISQGFITFAQTCPDCKGSGESASEKCKDCKGRGYEELKDSVEVNIPEGIDNGMNLRVAAKGNLSKSGNRGDLYVKVIVEEDDTFIRDDEDIYIEFPVFFTQAILGQSIKVPTIRGEATLNLPKGAKDGQRFVLEKEGVKDVHSSRIGNQIVQIAIKFPNSLNDEQKELLEKLSESFGIKDGMHHEQKGLFEKITHWFKS

SEQ ID NO: 23402 - protein, 144 aa, Ostreococcus tauri
MTQAESPMVRISVLNDTLSTFIIDVVTRIDVSSVALTSIFHRAESMYNAEKRGKRQVLVRPVSKVVIKFLQVMQKHEWNRVDRSSAAREKKTQLAQTLTVYFLRAIGYINEFEFIDDHRAGKIVVELNGRINKCGVIRCVCFRV

SEQ ID NO: 23403 - protein, 322 aa, Arabidopsis thaliana
EMNLRIEDLNEETKTLISSLPSDKDFTGKTICKYQGCWYTHNVLQAVLNFQKSFKPQDTDIIVASFPKCGTTWLKALTFALLHRSKQPSHDDDHPLLSNNPHVLVPYLEMDLYLCSENPDLTKFSSSSRLFSTHVPSHTLQEGLKGSTCKIVYMSRNVKDTLVSYWHFFTKKQTDEKIISSFEDTFEMFCRGVSIFGPFWDHVLSYWRGSLEDPNHVLFMKFEEMKAEPRDQIKKFAEFLGCPFTKEEEESGSVDEIIDLCSLRNLSSLEINKTGKLNSGRENKMFFRKGEVGDWKNYLTPEMENKIDMIIQEKLQNSGLKF

SEQ ID NO: 23404 - protein, 416 aa, Rubrobacter xylanophilus DSM 9941
MDEFHYRGGVLHCEDVPLHEIARGAGTPAYVYSYAALERAYREVEEAFSGLDHLVCFAVKANGNLAVLRALASLGAGADIVSGGELYRAMRAGFDPKKVVFAGVGKTEQELKAGLGERILMFNVESAGELEHLERLAHLHGKRARVALRINPGVDPGTHEHISTGNVESKFGIPADEALSLAERAKGFRCVDLIGVHQHIGSQIVKVAPYVESVERSAALVDELRSRGFDIRYLNIGGGLGIRYRDEETPSPAELVEAIRPTLAASGAKILCEMGRYIAGPAGALLTGVLYRKRSGERSFIVADAGMNDLIRPSLYGAYHEVLPLDEGADQTRADLVGPVCESGDFLARDRDLPDAREGDVLAVMNAGAYGFSMASNYNSRPRPAEVLVREDRWAVVREREHYPDLIRGELVPAFL

SEQ ID NO: 23405 - protein, 670 aa, Synechococcus sp. WH 5701
MVAAPTVDTLSVDNLCVNSIRFLAIDAINKSNSGHPGLPMGAAPMAYALWDKHLHHNPANPKWFNRDRFVLSAGHGCMLLYALLHLSGYDSVSIEDIKQFRQWGSKTPGHPETFETPGVEVTTGPLGQGISNAVGLAIAEAHLAAKFNRPDVSLVDHHTYVIMGDGCHQEGISGEAASLAGHLGLGKLIALYDDNHITIDGNTKVSFTEDVLKRYEAYGWHVQHVADGNTDIDAIGRAIEAAKAVTDKPSLIKVTTTIGYGSPNKADTAGVHGAALGAEEADLTRKSLGWSYGPFEVPEEAYEQWRKARERGAALEAEWDNILAAYRSEYPAEAAEFERMLRGELPQGWDRNLPRFTPEDKGLATRQYSYNVLNAIGPDLPELIGGSADLTHSNLTDIKGEGSFQKGSEANRYLHFGVREHAMAAILNGIAYHDSGLIPYGGTFLVFAGYMVGAMRLSALSELGVIYVLTHDSIGLGEDGPTHQPVETLASLRSIPNLLVIRPGDGNETSGAYQVAVTNRKRPTVLALSRQAMVNQPNSAPEHVAKGGYILEDSNGSPDLILIGSGTELDLCVKAAKELRGQGHNVRVVSMPCVELFEEQDASYRESVLPGAVRKRLVVEASGSFGWHKYVGLDGDTVSIDRFGASAPGPVCLEKFGFTVENVVAKAKAL

SEQ ID NO: 23406 - protein, 318 aa, Rubrobacter xylanophilus DSM 9941
MEASGALEVVTLGEALIVMDPVERGPLRHVPGFRKRVGGAELNVAVALARLGHRAGWAGSVGDDEFGREVLGFLRAEGVDVSGAVLDPGAPTGLYFKEWRAGGLRAHYYRAGSAASRMAPGRLDEGFLLSGRVLHLTGITPALSGGCEELVRRLAGEAGRRGVLLSFDANIRWRLFGERDPRKAIEPLLPLADLLFLSDEEAELLLGGSDPRSVERARGRLGAGVVVVHSASGSFAAGGEGVVRREGYRVEAVDTVGAGDAFVGGFLAGFLRGWETGACLELANACGACAVAVPGDAASMPAEEEALALLRGRRERER

SEQ ID NO: 23407 - protein, 481 aa, Oryza sativa
MPSHQPVAGMSAVDPAYLSSQPSAASKPHPQEPVRNKAYDPKKPHITETPMTKKNWYKHVNWLNVILIVGIPMCGLVAAYWTPLYLKTAIWAVAFYFATGLGITAGYHRLWAHTSYSASLPLKIFLAAVGGGAVEGSIRWWARDHRAHHRYTDTDKDPYSVRKGLLYSHFGWMLMKQNPKRIGRTDISDLNDDAVVVWQHKNYLKVVLFMGLIFPTLVAGLGWGDWLGGFVYAGILRIFFVQQATFCVNSLAHWLGDQPFDDRNSPRDHVITALVTLGEGYHNFHHEFPSDYRNAIEWHQYDPTKWSIWMWKQMGLAYDLKQFRSNEIEKGRLQQQQKKLDQKRSKLDWGVPLEQLPVMEWDDYVDQAKNGRGLIAVAGVVHDVTDFINDHPGGKAMIKSGIGKDATAMFNGGVYYHSNAAHNLLSTMRVGVIRGGMEVEIWKRAHGENKDFIKDAAGNRIVRAGAQVTKVVEPPASAGTA

SEQ ID NO: 23408 - protein, 179 aa, Candida albicans
MSTPARRRLMRDFKRMQQDPPSGVSASPLPDNVMKWNAVIIGPSDTPFEDGTFRLLLSFDEQYPNKPPQVKFISEMFHPNVYASGELCLDILQNRWSPTYDVSSILTSVQSLLNDPNISSPANVEAANLYKDHRSLYVKRVRETVENSWNDDDDEEEEEEDEDEAEDEDDDDDDNIDED

SEQ ID NO: 23409 - protein, 733 aa, Frankia sp. EAN1pec
MGSRRTSANVVPGAGPIVIVDRAHVAAALPGYELGDQIGAGAFGLVLAGWHRRLGRDVAIKVLAARDRSGLTASFAAEAQILASLDHPHIVRVYDYVETDDLRLIVMEMLAGGTLTRHQASISQPGACAVGLAAAGALSCAHSRGVLHRDIKPDNMLFDAAGLIKVADFGIAKLVSGSAATASSVVGTPLFMAPEQIAGGRLGPTTDLYALGVVLYLLLAGTRSFGPAAATQPPWPNPIDQHILPPPIGVPEPVATVVLRMLSPVPADRPPSAHAFAVDLAQAAATAYGPGWIATAGVSLRLDDDVRAAAERPARLTRLPPSSAADDMSPSHPADSSPEDGPASESVASRGRHARSHPRLASSPRHRLAAGVVLLLLAVAGTVLIPVAARSGNPNEPSSHPVALGASAKETPAPAAQALGQPLTDHTDWVASVAFSPDGHTLASSSKDTTVRLWDITDRTRPHPLGQPLAGHTLGVMSVAFSPDGNTLASSSRDTTIRLWDITDRTRPHPLGQPLTGHTDAVTSVAFFSDGRTLASSSRDTTIRLWDITDRTRTRPLGSPLSGHSDWVTSLALTMDGRTLASSSLDSTVRLWNMADRSHPQPIGLPLTGHTGGVNSVAFSLDSRTLASSGRDTTIRLWDVTDRSTPRLLGAPITGHANTVGPLTFSQDGDTLVSGSYDDTVRIWDVTDRSHPRLLGLPLTGHTDWIWSVALSPDGQTLASGSKDNTIRLWALP

SEQ ID NO: 23410 - protein, 382 aa, Medicago truncatula
MLTQKMADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDIKEKLAYVALDYEQELETAKSSSSIEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 23411 - protein, 507 aa, Yersinia pestis
SGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 23412 - protein, 145 aa, Brassica rapa subsp. rapa
MASFATIAAVQPYSAVKGLGGSSLTGAKLFIKPSRQSFKPKSTRAGAVVAKYGDKSVYFDLEDLGNTTGQWDLYGSDAPSPYNPLQSKFFETFAAPFTKRGLLLKFLILGGGSLLTYVSASSTGDVLPIKRGPQEKPKLGPRGKL

SEQ ID NO: 23413 - protein, 139 aa, Leptolyngbya sp. PCC 7375
LYRFDDDGHGEVVAEEKCEEMEPYLGLHYPESDIPKTARQMFLSNWIRVIPDAAATAVDLYPMDNPVTQQPTDLTHSILRSAYSCHLEYLHNMGVGASLTISLMKDNKLWGLIACHHRTAKYVPYELRKACEFLGRVIF

SEQ ID NO: 23414 - protein, 434 aa, Brassica napus
MAEKSFKYIILGGGVSAGYAAKEFASQGVKPGELAVISKEAVAPYERPALSKGYLFPEGAARLPGFHCCVGSGGEKLLPESYKQKGIELILRTEIVKADLAAKSLVSAAGDVFKYETLIIATGSTVLRLTDFGVKGADSKNILYLREIDDADKVVEAIQAKKGGKAVVVGGGYIGLELSAALRINNFDVTMVFPEPWCMPRLFTADIAAFYETYYTNKGVKIIKGTVASGFTAHPNGEVNEVQLKDGRSLEADIVIVGVGAKPLTALFKGQVEEDKGGIKTDAFFKTSVPDVYAVGDVATFPLKMYGDMRRVEHVDHSRKSAEQAVKAIKAAEGGGAVEEYDYLPFFYSRSFDLSWQFYGDNVGDSVLFGDSNPSNPKPRFGAYWVQDGKVVGAFMEGGSGDENKALAKVAKARPAAESLDDLTKQGISFAAKI

SEQ ID NO: 23415 - protein, 201 aa, Triticum aestivum
MDLSANPDSPLSGGGNGGGSSSSITSSLSVASGGTPQSPSRYEAQKRRDWNTFGQYLRNHRPPLSLAQCSGAHVLEFLRYLDQFGKTKVHASACPFFGHPSPPAPCPCPLRQAWGSLDALVGRLRAAYEENGGSPESNPFAARAVRLYLREVREHQARARGVSYEKKKRKKPQQLAGDSSSGSFHGNQHQPPPGPPPAAGC

SEQ ID NO: 23416 - protein, 1021 aa, Oryza sativa (japonica cultivar-group)
MGASEVRSWGPLGHLSPRSGPSGDSMKNQRFCFVNHVGKIVLNSDTLLGNGVVGILAETANMWERRAPLTPSHCARLLLGGGKRGTGVNRIIVQPSTKRIHHDAQYEDVGCEISKDLSECGLIIGIKQPKLEMILPHRAYGFFSHTHKAQKENMPLLDEILEKRVSLFDYELIAGDDGKRLLAFGKFAGRAGLIDFLHGLGQRYLSLGYSTPFLSLGQSHMYPSLAAAKAAVIAIGEEIATFGLPSGICPIVFVFTGTGNVSQGAQEIFKLLPHSFVDAGKLPELSAARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEASQHFGDILSKFVARLASAKELLELPSHLRKACIAHAGRLTSLYEYIPRMRKTIIELPPAPTNLLPDKKYNSLVSLSGHLFDKFLINEALDIIETAGGSFHLIRCDVGQSIDDMSYSELEVGADDTATLDKIIDSLTSLANAHGDPNARREIELSLKIGKVNECGTDDSMAKEGSKVLILGAGRVCRPAAEFLASYSNIFSSSAYDHDIDQIHVIVASLYQKDAEETIDGIRNATAAQLDVADIKNLSNLVSQMKKHLVTASYVDESMSKLEQSAEGAGVTILCEMGLDPGIDHMMSMKMIDEAHSRKGKIKSFTSFCGGLPSPASANNPLAYKFSWSPAGAIRAGRNPAVYKFHGEIIHVDGFSEIMATFAKIGFFDAASHPLLQQTTRPTYRDFLVELFNACNISTTARKEYSEVSGGQDGELISRLLSFGHCKDKEIAAKTVKTIKFLGLYEETQIPENCSSAFDVICQRMEQRMAYIHNEQDMVLLHHEVEVEYPDGRPTEKHQATLLEFGKVENGRPTTAMALTVGIPAAIGALLLLQNKIQKKGVIRPLEPEIYIPALEILESSGIKLAERVET

SEQ ID NO: 23417 - protein, 207 aa, Photobacterium profundum SS9
MSLVTTINWEKVDGLVPAVIQDNTSGQVLMLGYMNKEALNKTLETKQVTFWSRTKERLWTKGETSGNVLELKSINLDCDQDTLLVKVNPVGPTCHLGTPTCFDNDAEGKQEQPALVFLHQLEQVLANRKGADPESSYTASLYARGTKRISQKVGEEGVEVALAATSGDKAELVCESADLIYHLIVLLQDQGLSLSDVTEKLQERHNK

SEQ ID NO: 23418 - protein, 139 aa, Stanieria cyanosphaera PCC 7437
LYKFDEDDHGSVIAEEKRSDLVSYLGLHYPESDIPRPARKLFSYNWIRLIPDAQTQPVEMIPAINPISDRPLDLTHSILRSAFPCHLEYLHNMGVGASLTISLIKDQKLWGLIACHHQTPKHVPYELRKACEFLGRVVF

SEQ ID NO: 23419 - protein, 1484 aa, Candida albicans SC5314
MSDIPPTNESNSDSTLINQNNNGNNDNKETGKDISSTHTHHRVTFAEQQPISTSSRKSSLLRKHSSNNTSSDSDKRPSIISRNSNPDIHRDSLPPLNRGPSYNGNYTRSHSSRNVNANNTINTGVTSDSNSNNNVDSNAPISSPATPAISSPPANSKYFNLTLPAGKSREKSPGRHSKEGHTRSRSFTKQQHGIGSTSSQSSSQYLAQEKAYLRKMRNQSVDDYYSKGIPGAHEVSKADDNDDEDDDDDEEHSSFDGGDNANLLAAIDDDKYQIDYSMALSLMKNSNVNLRKIANLNTDDTDDPAIIERLEWQSMLTSVLTGDVVRSEKTKIININNPDSTQESYLHATFKENLWFGIRAKIFNRTEDEQRKIVAYRRTLVDQLIDDVMKFEIDYENSTDNPIRDQVKTILDRYDQACSLWKTLEDMYSDKPACRSEEFQNRIDALTAWLTITDAISRETKSLRLWIGNDELDITKSPVEVSSSNAATSTSKIVKKIFDEDNKSLAERLMKEKDVQTIFRKRIFKPIAPWMIKSKDTYIRLGVIFENMKLPDYLHDLLQICIIPVRLIKEIVIVRLGYAMKLQNPTLMMIDQMLDDFKSYITVALEVKSGISEYKEPDEDRKWLISDLFDSELEDFDNVILRCVRYFLVLLNRKLLDSSRSPTTFRTFKEPEELEEAWNFLKPLGHYVDGGSVVVAEEITMLASRLIHRLMAYFNHQIREPTYNGVPQDLIRWYSSTSENFGQLRRKLARFMGEISRDFKNSVVFDIPSQSNCTKTLLEILRSSNHFLVYTGTVETQGTYFFASPELLGNEQEILKILTGSCVGLDPSTDNSHFTDLLHLIRSGSEEHLRYNDDDLDSYDDSNGAYAYVLALCPMKPIVWDGLVVNVDIDSVPITDMKNGELLLVSKLSYYDLHIVRNRFLEVASEVSLGNAGLKQVEYRCSLAKVNQELKKMNRVVFKMCSSVLESVQVIKTRIAELDPVGEYQALINSYFIYARDYGKNSVRTLDPQRKSTIIMKMIQLSIDWVSFICDDCIPTDRKTFRWCVLALEFSMEMIRGINIFLLTEEQFTKLKVKVARCMSLLISHFDIMGARSSEAEKNKLLKWTAQRHNIASSQNDDEYLNKVYHEEVMGQINKIEERRRNLQEEFQSIGRVLDVSDSEYQFLTLLASSFSSVSIRWQKGACIGRGTFGQVFSAVNLDTGGVMAVKEITFHDSQSVKTIVPSIKEEMTVLEMLNHPNVVQYFGVEVHRDKVYIFMEFCEGGSLAGLLTHGRIEDEMVIQVYALQMLEGLAYLHQSGVVHRDIKPENVLLDHNGVIKYVDFGAAKVIASNGRTIGGMTNSSLRKSVKRDGHNNLNSMTGTPMYMSPEAITGTSTDRSGVVDIWSLGCCVLEMATGRRPWANLDNEWAIMYHIAAGHKPQLPSPEQLSEPGRTFLARCLEHDPTKRPSAVELLADPWMVEIRHMAFGNSDVTTTPLSEVAGPVSE

SEQ ID NO: 23420 - protein, 165 aa, Mesorhizobium temperatum
MFADGVMFDGSSIAGWKAINESDMVLMPDTETVHMDPFFAQSTMVILCDILDPISGESYNRDPRGTAKKAEAYMKAEGIGDQIFVGPEAEFFVFDDVKYKADPYNTGFKLDSTELPSNDDTDYETGNLGHRPRIKGGYFPVPPIDSAQDMRSEMLTVLAEMGVRV

SEQ ID NO: 23421 - protein, 165 aa, Rhizobium sp. SX211a
MFADGVMFDGSSIGGWKAINESDMVLMPDPATVHMDPFFAQSTMVIVCDILDPVSGEAYNRDPRGIAKKAEAYLKASGIGDTIFVGPEPEFFVFDDVKYKADPYNTGFKLDSSELPSNDDTDYETGNLGHRPRVKGGYFPVPPIDSCQDMRSEMLTVLTEMGVTV

SEQ ID NO: 23422 - protein, 126 aa, Pseudomonas fluorescens Pf-5
MTKTVITSDKAPAAIGTYSQAIKAGNTVYMSGQIPLDPKTMELVEGFEAQTVQVFENLKSVAEAAGGSFKDIVKLNIFLTDLSHFAKVNEIMGKYFQQPYPARAAIGVAALPKGAQVEMDAILVIE

SEQ ID NO: 23423 - protein, 883 aa, Oryza sativa (japonica cultivar-group)
MATPDVILPGPSLRPMPYMRSAPSARPEYHECATCHGPAKTRCSRCKSVRYCSGKCQIIHWRQGHKQTCQQWNGFGTSSSGGLPPTENTEQMPFLSNLNSPLRGSDVHLHDMDFDTMSEPSFVTTDSYNLDTSPFLSDRSNMNKPNQFLHTSENGAAIGSYEKNDYSIDGEVPSSEILSGNKGLNNSSGSGENCGNRDVIYPLNSVVHQPNNYAPEIRKRPKASITVYESDKGVYLTSDMISSGEGPYASAAESLQRSNSSGNVTGKGNMIHKKPPYPSGSTKTAVSTNSSLQGCNGISKAGASKVEALKKPSKFLKTSLVGLINDNKRSKVLFPYEDLVKFFQYEVRGISPRGLFNCGNSCYANAVLQCLMCTKPLMIYLLLRLHSKDCNTKTQAPTLLGVVVKSLTISDFFDIDCFILLGCSKNWCLMCELEQYASTLRESGGPVSPSRILSNLRNIGCRLGGGSQEDAHEFLRHLVMSMQGACLDGLGGEKQVEASLQETTLIQQMFGGRLKSKVKCLRCYHESERYENIMDLTLEIHGWVESLQDALTQFTAPEDLDGENMYKCGRCSAYVKARKQLSVHEVPNILTVVLKRFQTGKYGKINKCVTFPDMLDMVPFVTGAGDNPPLYFLYAVVVHVDTENASFSGHYISYVKDMQGTWLRIDDSEVQAVSLNQVMSEGAYMLFYMRSFPRPPKIYIEKGLSSVPTCSKRHSSKSSKGSKQDLNHTESLFASSDQTYGIYDFRPDNGYIQDQHAALRTRNFYHTDDAFADSISTDFSDATSSEWSLFTSSDESSFTTESTRDSFSVVDYGDNAGLDPISSIFGPYYAQDHPPGSFASCTRLSPSNPQTRFLTHGTLKGGIPALELQGNICNSPKISAKAE

SEQ ID NO: 23424 - protein, 213 aa, Ostreococcus tauri
  misc_feature (1)..(1): Xaa can be any naturally occurring amino acid
  unsure (1)..(213): unsure at all Xaa locations
XWVDPAEYSEKFAEKSAQSVLRGTRDPVAVMKDAHDETQVIGSCTACIAMLKDGNILDVANLGDAGALVAREGEVVYQTSPQQHEFNLPYQLGWAKVYPEGDRPEASERSEISLSPGDVLVLGSDGLWDNVPHAEVAALCAEHNGDAEECAEAIATLAFGYSCDPEYDSPFTQQARAVAETRPEWGDRRSIIGGKMDDIAVVVAFIDSERTLS

SEQ ID NO: 23425 - protein, 165 aa, Rhizobium sp. SDW058
MFADGVMFDGSSIGGWKAINESDMVLMPDPATVHMDPFFAQSTMVIVCDILDPVSGEAYNRDPRGIAKKAEAYLKASGIGDTVFVGPEPEFFVFDDVKYKADPYNTGFKLDSSELPSNDDTDYETGNLGHRPRVKGGYFPVPPVDSCQDMRSEMLTVLTEMGVTV

SEQ ID NO: 23426 - protein, 165 aa, Synechococcus sp. WH 5701
MTDIAPGYDHITSAIGAALAGWHGTAMLCYVTPKEHLGLPNAEDVREGLIAYKIAAHAADIARHRPGARDRDDELSRARYAFDWNKQFELSLDPERAREYHDETLPADIYKQAEFCSMCGPKHCPMQTKITDEDLAGLEEVLAAQQDPQGERPAIQKNPAEPAAV

SEQ ID NO: 23427 - protein, 293 aa, Synechococcus sp. WH 5701
MSQMHYARQGLITEEMAYVAKRENLPESLVMEEVARGRMIIPANINHTNLEPMAIGIASRCKVNANIGASPNASDLDEEVAKLRLAVKYGADTVMDLSTGGVNLDEVRTAIINASTVPIGTVPVYQALESVHGSIEKLDADDFLHIIEKHCQQGVDYQTIHAGLLIEHLPLVKGRLTGIVSRGGGILAQWMLYHHKQNPLFTRFDDIIEIFKRYDCSFSLGDSLRPGCQHDASDAAQLAELKTLGQLTRRAWEHDIQVMVEGPGHVPMDQIEFNVKKQMEECSEAPFYVLGPW

SEQ ID NO: 23428 - protein, 113 aa, Magnetospirillum magnetotacticum MS-1
MAPSASLREAASLLLEKNIGALICSDRAGGIVGILSERDISRSFARLGADIISMSVSDAMTRDVIACSADDGVAEILEIMTETRCRHIPVVGDGELLGLVSIGDLVKALKEEG

SEQ ID NO: 23429 - protein, 437 aa, Saccharomyces cerevisiae
MSITKVHARTVYDSRGNPTVEVEITTENGLFRAIVPSGASTGIHEAVELRDGNKSEWMGKGVTKAVSNVNSIIGPALIKSELCVTNQKGIDELMISLDGTSNKSRLGANAILGVSLCVARAAAAQKGITLYKYIAELADARQDPFVIPVPFFNVLNGGAHAGGSLAMQEFKIAPVGAQSFAEAMRMGSEVYHHLKILAKEQYGPSAGNVGDEGGVAPDIDTAEDALDMIVEAINICGYEGRVKVGIDSAPSVFYKDGKYDLNFKEPNSDPSHWLSPAQLAEYYHSLLKKYPIISLEDPYAEDDWSSWSAFLKTVNVQIIADDLTCTNKTRIARAIEEKCANTLLLKLNQIGTLTESIEAANQAFDAGWGVMISHRSGETEDPFIADLVVGLRCGQIKSGALSRSERLAKYNELLRIEEELGDDCIYAGHRFHDGNKL

SEQ ID NO: 23430 - protein, 165 aa, Mesorhizobium sp. SDW017
MFADGVMFDGSSIAGWKAINESDMVLMPDPDTVHMDPFFAQSTMVILCDILDPVSGESYNRDPRGTAKKAEAYMKAEGIGDTIYVGPEAEFFVFDDVKYKADPYNTGFKLDSTELPSNDDTDYETGNLGHRPRVKGGYFPVPPIDSAQDMRSEMLTVLAEMGVRV

SEQ ID NO: 23431 - protein, 313 aa, Triticum aestivum
MAIISDIQEEEAPPQQPQAAPAPAAVDVDLEVLEAVLERKGGALPFLHAAIDVAHRRSDLFRDPSAVGKVTAMASACRAQVEAEERKARDAKRKAAELEKAAAAEKERVVKAAAEKEKRESSVGARRRSDASTEVEKKEGKANKPNAGNGLDMEKYSWTQQLPEVNVNVPVPEGTKSRFVVCEIKKDHLKVGLKGQPPIIDGELHKPVKVDDCFWSIEDGKALSILLTKHNQMEWWKSVIKGDPEVDTQKVEPETSKLSDLDPETRQTVEKMMFDQRQKQMGLPTSDEMQKQDMLKKFMSQHPEMDFSRAKIA

SEQ ID NO: 23432 - protein, 146 aa, Magnetospirillum magnetotacticum MS-1
MIVKTILKSKARGGGIVSVTPDASIGDAARLLAQHKIGAVLVMTGDRVAGILSERDIVRGLADAMDVCVTAKVRDLMTAEVFVCHEDDTVERLMEIMTAKRIRHLPVMDSSGEVTGMVTIGDVVKSRLDETKMEAESLRDYVMAGR

SEQ ID NO: 23433 - protein, 136 aa, Neurospora crassa
MARTKQTARKSTGGKAPRKQLASKAARKSAPSTGGVKKPHRYKPGTVALREIRRYQKSTELLIRKLPFQRLVREIAQDFKSDLRFQSSAIGLLQESVESYLVSLFEDTNLCAIHAKRVTIQSKDIQLARRLRGERN

SEQ ID NO: 23434 - protein, 188 aa, Burkholderia sp. 383
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTRSESYDLEYGSATVEIHEDACRPGDRVIIMDDLIATGGTMMAGRNLLQRLGAEVVEGAAIIDLPDLGGSALLRNAGLPVYTVTEFAGH

SEQ ID NO: 23435 - protein, 513 aa, Oryza sativa (japonica cultivar-group)
SSTAHRPRVRVHRNSGGDDEAIDSWTLAPRHPTVPARCSYPYSTTALSGREARKRHAPRSRHLDFSGERRKNNTPPPLTYGDSDTMAMAAASASAMARRAASWPRLLLLSRAFAAAAAEPKRVLVPVADGTEPVEAAATADVLNRAGARVTVATADPAGDDRGLLVEAAFGVKLVADGRVADLEGEAFDLIALPGGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVSIAKELIFM

SEQ ID NO: 23436 - protein, 361 aa, Photobacterium profundum SS9
MSKEKILFIDRDGTLIVEPPVDFQVDRLDKLKLEPFVIPALLTLQDAGYKLVMVTNQDGLGTDSYPQADFDAPQNMMMEIFESQGVKFDDVLICPHFNEDNCSCRKPKLGLVKSYLQQGRVDFATSAVIGDRQTDLQLAENMAIKGIQYNPLPTDKSSLNWQQIVKDLTTNPRIAEVVRTTKETDIRVKVNLDETGGNSIETGLGFFDHMLDQIATHGGFQMQVNVKGDLHIDDHHSIEDTALALGQALKEALGDKRGIGRFGFSLPMDECLAQCALDLSGRPYLKFEAEFGRDQVGDLSTEMVSHFFRSLTDTLACTLHLSSTGHNDHHIVESLFKAFGRTLRQAIRVDGNELPSSKGVL

SEQ ID NO: 23437 - protein, 327 aa, Burkholderia sp. 383
MIAKINDDRALALARDVLDIEADAVRALRDQLDGGFVQAVALLLGCRGRVVVSGIGKSGHIARKIAATLASTGTPAFFVHPAEASHGDLGMVTSDDVFIGISYSGESEELVAILPLVKRIGAKLIAITGRAESSLGTLADVNLNAAVSKEACPMNLAPTASTTAALALGDALAVAVLDARGFGSEDFARSHPGGALGRRLLTYVRDVMRSGDDVPSVGLDATLSDALFQITAKRLGMTAVVDADGKVAGIFTDGDLRRVLARDGDFRTLPITDVMTRGPRTVAPDHLAVEAVELMERHRINQMLVVDADGVLIGALNMHDLFSKKVI

SEQ ID NO: 23438 - protein, 454 aa, Burkholderia pseudomallei K96243
MKNLQRHLSARHIRFLALGSAIGTGLFYGSASAIRLAGPAVILAYIVGGAAVYMVMRALGEMAVREPVPGSFGHYATENLGPFAGFVTGWTYTLEMVIVAIADITAFGIYMGFWFPHVPQWIWVLAIVAIICGLNLCHVKVFGELEFWLSIVKVGAIVAMIGGGAAILFTGMRLGSGGAPSLANLWSHGGFLPNGVGGLVASLSVVIFAYGGIEVIGMSAGEAKEPERAIPRAINAVPMRILLFYVLTMIVLMSIFPWTGVGANGSPFVQIFSALGVRSAAEILNLVVISAAISAINSDIFGAGRMMYAMALQGQAPRALAAMSARGVPWVTVLVMAGALLVGVVLNYLMPKDVFLMVAASATFATVWVWLMILLSQIAMRRRLGAAEVAALKFKVPFWPVGPALTIAFMAFVIAMLGYFDDTRVALFVGAAWLAILALVFYTRIRPRLAAVAR

SEQ ID NO: 23439 - protein, 310 aa, Brassica napus
LRTAKMVGANQNYLTELENRVSWQLDQASLKELMIPSFSHTCGTLLDVELVTRLVKKFAGLDSEGVKTGAALVKVAKLVDSYLAEAAIDGGLTLPELISLAEALPSHARTTEDGLYRAIDTYLKAHPQVMKQERKELCRLIDSRKLSPEAALHAAQNDRLPVRSIIRVLFTEQTKLSRHIDWSPSGSHYSEPGSGPQCLSKREMNVQQAEIKRLRDDVLRLQSECGAMHMQMERLMEKKSSGGGSKGFFRWKRLGLGPSIRGSVGVEKMMNGEEEVGDNGEELEPRTPGNMKTRLVKGRTTPSRWRKSMS

SEQ ID NO: 23440 - protein, 571 aa, Ostreococcus tauri
  misc_feature (427)..(433): Xaa can be any naturally occurring amino acid
  unsure (1)..(571): unsure at all Xaa locations
MVRSGMRYGYRINGEGGWDTGQRFDATKVLMDPYAPLVEARRKVFGEWSKHKVSGDTNDPDMLSGYDFESAPFDWRGVESPQIDEKDMIVYEMTVRAFTADASSGLDADARGSYAGVAAKVEHLKSLGVNVVELLPVFEYDEMEFQRIPNPRDHMVNTWGYSTMSFFAPMTRFGKKGCSAREASREFKEMVRALHAAGIQVILDVVYNHTGEMNDELPNTCSMRGIDNKTYYMTDTNQYVQMLNFTGCGNTLNANNPYVSQFILDSLKHWVKEYHVDGFRFDLASALCRDEQGHPMNSPPLIRAIAKDPELAHVKLIAEPWDCGGLYQVGSFPNWDRWSEWNGAYRDVLRRFIKGDEGMKSDFARRISGSSDMYHHNNRKPYHSVNFITAHDGFTLRDLVSYNTKHNMANGEFNNDGANDNYSWNCXXXXXXXRLNNFQWNELDSQKEHYFRFASEMVKFRRLHPLLGRETFLTDADVTWHEDRWDDPQSKFLAFTLHDSAGYGCGDLYIAFNAHEFYVDAALPSPPNGKRWARIVDTNLPSPEDFIVKGKFGVESRYNVAPRGCVILMSK

SEQ ID NO: 23441 - protein, 410 aa, Ralstonia sp. JS705
MATHVAIIGNGVAGVTTAQALRAEGFEGRISLIGSEPHLPYDRPSLSKAVLDGSLERPPVLAEADWYGEANIDMLTGPQVTAINAETRTISLDDGTTLSADAIVIATGSRARTLALPGSQLGGVVTLRTYDDVQSLRDSWTPATRLLIAGGGLIGCEVATTARKLGLPVTILEAGDELLVRVLGRRIGAWLRGRLTELGVQVELGAGVAGFSGEGRLEQVLASDGRFFAADSALICIGAEPADQLARQAGLACDRGVIVDHCGATLAEGVFAVGDAASWPLRAGGRRSLETYMNAQRQAAAVAAAILGKAVSAPQLPVSWTEIAGHRMQMAGDIEGPGEFLLRGTLGSGAALLFRLQEGKLQAVVAVDAPRDFALATRLVEAHAAVEPARLADISNSMRDLVRAHSGDTA

SEQ ID NO: 23442 - protein, 165 aa, Agrobacterium sp. SDW053
MFADGVMFDGSSIAGWKAINESDMVLMPDPATAHIDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVV

SEQ ID NO: 23443 - protein, 153 aa, Ostreococcus tauri
  misc_feature (1)..(2): Xaa can be any naturally occurring amino acid
  unsure (1)..(153): unsure at all Xaa locations
XXLSELQKRYSAYKRLEAELQQARIRLSQQLPDVKRSLEAVDVLVEKRDRGEEEGTTVRYQLTEATFADAEVATPESVYLWLGANVMLEYPLDEAKELLEANVKACESGLEANARDLAVIKDNVTITEVNMARLYNWDVTKKKEQGAKSSDGA

SEQ ID NO: 23444 - protein, 165 aa, Rhizobium sp. NM349
MFADGVMFDGSSIAGWKAINESDMVLMPDPATAHVDPFFAQSTLVVLCDILDPVSGEAYNRDPRGTAKKAEAYLKASGIGDTVFVGPEPEFFVFDDVKYKADPYNTGFKLDSSELPSNDDTDYETGNLGHRPRVKGGYFPVPPIDSLQDMRSEMLTVLAEMGVVV

SEQ ID NO: 23445 - protein, 332 aa, Synechococcus sp. WH 5701
MSALTRCLQEEAAAIAAAAGRLDAEQVDAALVLLDRCADQRAKLVITGVGKSGIVARKIAATFSSIGLMALYLNPLDALHGDLGVVAPEDVVLLLSNSGETQELLEILPHLRRRGTGRIALVGRVASSLARGCEVVLDGSVDREVCPLNLAPTASTAVAMAIGDALAAVWMERRGISPADFALNHPAGALGKQLTLTVGDLMVPTAKLHPLEEGASLSEVIAGLTGDGVGACWVRRADNDSLLAGLITDGDLRRALEQHAPAAWGELRATDLMTIDPITVAADLLAVEALERMERNRRKPIGVLPVLGEGGPMLGLLRLHDLVQAGLTPSAR

SEQ ID NO: 23446 - protein, 280 aa, Burkholderia pseudomallei K96243
MRTADGLELACYRWPSTAPSCAAPRATVALVHGLAEHAGRYQAFAERLNAAGIEVVAIDLRGHGRSPGERAWAERFDRYLDDADALVASAARENTPLFLMGHSMGGAIAALYAIERAAARHASLAGLILSSPALAPGRDVPQWMLAMSRFISRVWPRFPALKIDAALLSRDPAVVAANRADPLVHHGSVPARTGAEILDAMRRIEAGRAALRLPVLVYHGTADKLTEPDGSRDFGAHVGSPDRTLTLYEGNYHETMNDLERERVIGALIDWIAARVPARG

SEQ ID NO: 23447 - protein, 297 aa, Rubrobacter xylanophilus DSM 9941
MFSGTLTALITPFRNGEVDVEALEGLVEFQIQQGVSGLVPCGTTGETPCLSEEEDRLVVETVVRVAGGRVPVIAGTGSNSTDMAIRYTRMAEEAGADGSLQVAPYYNKPTQEGLYRHFATIAENTSLPIILYNIPSRTGVTISAETTARLAEIPNIVGTKEATHSMDLASDLRRLCGEEFCILSGDDSLTLPIMALGGRGVISVASNVAPAAVSQLTQALLEGDYERGRELHYELLPLFRALFIETNPIPVKTAASLLGLCSDEMRLPMQPMRGENLRRLQEVMEEKGHLLPTPEEV

SEQ ID NO: 23448 - protein, 415 aa, Oryza sativa (japonica cultivar-group)
MSAAQQQKHEVDRATVAGAVAALFKWMRARAAEAPPNLLADERDDLLLLQLSLRRIPPSPTTKPRLLPLPHPVIVPGESASICVISDDRPKSRSPAASDLLDASRSHHLPVSEVIPLSALRTDYRPYESRRRLAASHDLFIADRAVLPLLPRVLGKAFYSTKKAPVAVDFARTGWLEQVRKVMNSTFLYLRTGTCSGIKVGRLDMKEEDTVENVMAAVEAAVENVPKKWANVRSLHLKAVDSVALPIYQAVPELGMKIEVRFAQLEGEVGSGEVIDASEAGAALKGVGKKKAKKALKHVEEENAGEEAAQESGKRKRGKKQLAEDLMEQDIQDVSEKRKKVKEGTPAAETPKISKKGKEKSKRALDKEGEDASVEEASNKKKKGKKEVVSDVGEKNSKVKKSNGDKEKRRTRLRV

SEQ ID NO: 23449 - protein, 183 aa, Magnetococcus sp. MC-1
MTPRVLIPIAPGSEEMEAITIVNILRRAQIDCTLAGTVEGPIRCSRGSVIVPDTTLEAVMDMPFDLIALPGGQPGTTHLDEDPRMHTLLQRMHAEGKFITAICAAPTILAHAGLLTGKKATCYPTLLDTLHGAETVAIHGVVCDGNIITSTGPGTAMDFALTLVETLVGKAQRMQVEEALARP

SEQ ID NO: 23450 - protein, 211 aa, Frankia sp. EAN1pec
MGILDPYKGFGVTFSTMFKKPTTEQYPEQKKETAPRFHGRHQLNRHPDGLEKCVGCELCAWACPADAIYVEGADNTDEQRFSPGERYGRVYQINYLRCILCGLCIEACPTRALTMSNDYELADDSRDDLIFTKEQLLAPLRAGMESPPHPMRLGESETDYYTRDPDAPLPWQVGGSPADEADEAGEAGEAGEAERAADKVPAHGAGSERPR

SEQ ID NO: 23451 - protein, 307 aa, Synechocystis sp. PCC 6803
MAEVVCFGEMLFDCLADQLGVPLEQVKSWTNYAGGAPANVACALVKQGVSAAFVGRLGADQAGQELKNVLQQCQVNTDGLQIDPHRPTRLVYVTRTGDGDRHFAGFGEYHTGDFADTAMQGETIPESLFTSAQYLVMGTIALAYAPSRTATERLVALAKKHQVKIFLDVNWRSVFWDDEAQAKERIPALITHAQILKCTDEEAVWLFGHQDPVTIHQKLPHLQGVLVTAGDKGCSYSLGKNHGEVPAFKVNVRDTTGAGDSFVAGFLAQALTHGENLFIDPHLSCQAVTYASAIGALTTLHPGAIAR

SEQ ID NO: 23452 - protein, 455 aa, Prochlorococcus marinus str. MIT 9312
MSHEIFMPALSSTMTEGKIVEWLKNPGDKVERGESVLVVESDKADMDVESFQDGYLAAVLMPAGSTAPVGETIGLIVENEDEIASVKEQNKGNQPEVSSSDKLELVSNKTEEKPEVHNENVKKEEKEVVLKSEKSAPSFNSDQINAATSNVSSRVIASPRAKKLASQMGVDLAKVHGSGPHGRIQADDILKANGQPVSIPWIGEGSSPASIPGANLQVESKPETSGNSFGNPGETVQFNTLQKAVNKNMESSLDIPCFRVGYSINTDKLDNFYKKVKQNGVTMTALLVKAVAKTIKKHPQVNSSFSENGISYPENINIAVAVAMEDGGLITPVLKEPCNTDLFELSREWKDLVKRSRSKQLEPDEYSTGTFTLSNLGMFGVDRFDAILPPGTGAILAIASSKPTVVANSDGSISVKKIMQVNLTADHRVIYGADGASFLKDLASLIENEPETLVS

SEQ ID NO: 23453 - protein, 426 aa, Lingulodinium polyedrum
MGLGSRSAAPGLTLLLAGCAALAGPLSFLAPGLGRQPARLRAGSGGAPASAAQGAVQAERPGAGCLAAGAGVLCLAAVGLAAARRSAARPAAVRRAEADDAYGASHTSFYTDAVAKDKYDSIEEVMEKSLKDPKLQGMVKELLAACVKITEALRVNLVTVNDSSNTFGDTQLTVDVIADDLLWDLAKSSQLVCEASSEEEPEIVKTNPDGQYVLCWDPLDGSSIVDNNWAVGTIVGVWDKSTGLLGATGRDQVMSLVALYGPRTTVFMTMDDGVYEFTLGPGNQWICSREKIEIKKDCKIFAPANMRAAQEVDGYAKLIDHYMTNRYTLRYSGGLVPDVCQQFTKTQGVFTNPTSKASPAKLRLAFEAAPFGRLVEMAGGKTSDGVSGQSVLDVKIEAVDQRTALAIGSANEVDRFNETVLQKTPA

SEQ ID NO: 23454 - protein, 142 aa, Zea mays
MASLAAVSVKPVAIKGLAGSSISGRKLAVARPSARSIRRPRAAAVVAKYGDKSVYFDLDDIGNTTGQWDLYGSDAPSPYNPLQSKFFETFAAPFTKRGLLLKFLLLGGGSLLAYVSASASPDLLPIKKGPQEPPQPGPRGKI

SEQ ID NO: 23455 - protein, 643 aa, Burkholderia pseudomallei K96243
MNANPKFLSADARVDAAAVAPLPNSRKVYVTGSQPDIRVPMREITQADTPTSFGGEKNPPIYVYDTSGPYTDPDAKIDIRAGLPALRQRWIDARGDTETLAGLTSDYGRERAADPATAELRFPGLHRHPRRAKAGKNVTQMHYARQGIITPEMEYIAIRENQRRAEYLESLKASGPNGAKLAAMMGRQHAGQAFGAAAFGANAPAEITPEFVRDEVARGRAIIPANINHPETEPMIIGRNFLVKINANIGNSAVTSSIGEEVDKMTWAIRWGGDTVMDLSTGKHIHETREWIIRNSPVPIGTVPIYQALEKVNGKAEDLTWEIFRDTLIEQAEQGVDYFTIHAGVRLQYVPLTANRMTGIVSRGGSIMAKWCLAHHKESFLYEHFEEICEIMKAYDVSFSLGDGLRPGSIYDANDEAQLGELKTLGELTQIAWKHDVQVMIEGPGHVPMQLIKENMDLQLDWCKEAPFYTLGPLTTDIAPGYDHITSGIGAAMIGWFGTAMLCYVTPKEHLGLPNKDDVKEGIITYKLAAHAADLAKGHPGAQVRDNALSKARFEFRWQDQFNLGLDPDKAREFHDETLPKDSAKVAHFCSMCGPHFCSMKITQDVREFAAQQGVSENDALKKGMEVKAVEFVKSGSEIYHRQ

SEQ ID NO: 23456 - protein, 182 aa, Pseudomonas stutzeri
MIFDEFSIKTLIRPVQDFPRPGVVFRDITPLFQSPKALRMVADSLIQRYVEADFTHIGALDARGFLVGSILAYELNKPLVLFRKQGKLPADVLSQAYSTEYGEAHLEIHADSLCEGDSVLLFDDLIATGGTLLAAAQLVRRMRANIHEAAAIIDLPELGGSQKLQDIGIPTFTLTAFALSDR

SEQ ID NO: 23457 - protein, 590 aa, Mycobacterium leprae
MRRTHATGDRYAIDALRAALCSRWIDAGGTTGGCRRGVDREAALCVAACLGSCCQPLDWLPVADSAGLDQPEPSPRPVLVVDFGAQYAQLIARRVREARVFSEVIPHTTSIEEITARDPLAIVLSGGPASVYTEGAPQLDPALFDLGLPVFGICYGFQAMAQVLGGTVARTKTSEYGRTELKVLGGDLHSGLPGVQPVWMSHGDAVTAAPDGFDVAASSSGAPVAAFENRDRRLAGVQYHPEVMHTPHGQQVLSRFLHDFAGLDADWTAANIAGVLVEQVRAQIGNGHAICGLSGGVDSAVAAALVQRAIGDRLTCIFVDHGLLRDGERGQVQRDFVAATGAKLVTVDAAETFLQALSGVTNPEGKRKIIGRQFIRAFEGAVRDLLGDSTFDSGIEFLVQGTLYPDVVESGGGSGTANIKSHHNVGGLPDNLRFKLVEPLRLLFKDEVRAVGRQLDLPEEIVARQPFPGPGLGIRIVGEVTAERLDTLRRADSIAREELTTAGLDYQIWQCPVVLLADVRSVGVQGDNRSYGHPIVLRPVSSEDAMTADWTWVPYEVLECISTRITNEVAEVNRVVLDITNKPPGTIEWE

SEQ ID NO: 23458 - protein, 372 aa, Candida albicans SC5314
MVVDLDKYLKLGKDHYLALGLEGSANKLGVGVIKHNKGPLSSTNRAEVLSNIRDTYITPPGEGFLPRDTARHHRNWVVRIIKQALATAKIAGKDIDVICFTQGPGMGAPLQSVVIAARTLAQLWNIPIVGVNHCVGHIEMGREITGAENPVVLYVSGGNTQVIAYSKQRYRIFGETLDIAIGNCLDRFARTLKIPNEPAPGYNIEQMAKKGKHLVPLPYTVKGMDLSMSGILAAIDSIAKEMFGKQQKKLIDEESGEPITAEDLCFSLQETLFSMLVEITERALAHVDSNQVLIVGGVGSNQRLQEMMKLMIQDRKNGQIYATDERFCIDNGIMIAHAGLLSYRTGQTNQLNNTVCTQRFRTDEVFVKWRDD

SEQ ID NO: 23459 - protein, 292 aa, Bacillus cereus ATCC 14579
MIDFGTIATAMVTPFDINGNIDFAKTTKLVNYLIDNGTTAIVVGGTTGESPTLTSEEKVALYRHVVSVVDKRVPVIAGTGSNNTHASIDLTKKATEVGVDAVMLVAPYYNKPSQEGMYQHFKAIAESTPLPVMLYNVPGRSIVQISVDTVVRLSEIENIVAIKDAGGDVLTMTEIIEKTADDFAVYSGDDGLTLPAMAVGAKGIVSVASHVIGNEMQEMITAFQAGEFKKAQKLHQLLVRVTDSLFMAPSPTPVKTALQMVGLDVGSVRLPLLPLTEEERVTLQSVMQSIPR

SEQ ID NO: 23460 - protein, 409 aa, Oryza sativa (japonica cultivar-group)
MEYGAATRGALLAAAPLSGARRSWLPLSSPPSPPSIQIQNRLYSISSLPLKARGVRRCEASLASDYTKASEVADLDWENLGFGIVQTDYMYITKCGQDGNFSEGEMIPFGPIALNPSSGVLNYGQGLFEGLKAYRTTDDSILLFRPEENALRMRTGAERMCMPAPSVEQFVDAVKQTVLANKRWVPPTGKGSLYIRPLLMGSGAVLGLAPAPEYTFIIFVSPVGNYFKEGLAPINLIVEDKFHRATPGGTGSVKTIGNYASVLMAQKIAKEKGYSDVLYLDAVHKKYLEEVSSCNIFVVKGNVISTPAVKGTILPGITRKSIIDVALSKGFQVEERLVSVDELLEADEVFCTGTAVVVSPVGSITYQGKRVEYAGNKGVGVVSQQLYTSLTSLQMGQAEDWLVWTVQLS

SEQ ID NO: 23461 - protein, 181 aa, Triticum aestivum
VTSKTEVVQKSLSRTGPEFPGYRRPTRPSPSSFGRKPLLEVAEEAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 23462 - protein, 869 aa, Saccharomyces cerevisiae
MTESAIDDQRFNLTKELQRHSCRDQGKITQKDDALDFISYSSFQSSFNTDQKSANNGSTVRRSIRSIFRRAAELPRVHMGPLTYSHGINELVNKKLRKDCDLSTLCRVLQRGIRMIRMTRRRRKFYEFKLINNNGQIIWKDGSKYLELDSVKDIRIGDTASTYQEEVDPKRLRSDSKLWIAIIYKVSNKLKALHVVALNELDFNTFLSCICGLVKLRRELMESILLPDNSQFARIHWQITVSEKEEDEKKDTLSFADVKKLCDKFHIYVSTGQLLEFFQLADINHNGLLNYFEFEKFIKILKNRKEVNMIWSKFTKPPHSHLSFENFFQFLITEQHEQVDRQTAWSYFIKYREPTQLTMGQDGFTKFLKEQPYLVEVKEELYSKPLNHYFIASSHNTYLLGKQIAETPSVEGYIQVLQQGCRCVEIDIWDGENGPVVCHGFLTSAIPLKTVIRVIKKYAFITSPYPLIISLEINCNKDNQKLASLIMREVLAEQLYFVGTRTDKLPSPRELKHKILLKSKKTSEATRGLSVNEPFPSSFSSSYESANEQELRMKDDSTNSSSATNSSSMQRIKRIGLKKHADIINDVSNISGIHGIKFRNFSLPESKTIAHCFSLNERKVEYMIKDKHLKLSLDKHNRRYLMRVYPHVLRYKSSNFNPIPFWKAGVQMVATNWQTNDIGQQLNLAMFQILDHQPDGSFKSGYVLKPKKLLPVVTKAKMIPLIYEHFENGSDPVTVKIRILSTQLLPRLNDTSPSRNNTNSFVKVEFHTDDEPTMPISIDKGTRISATEASTKSSQGNGFNPIWDAEVSITLKDTDLTFIKFMVISEETQIASVCLKLNYLRMGYRHIPLFNMEGEQYIFCTLFIHTQIL

SEQ ID NO: 23463 - protein, 590 aa, Ostreococcus tauri
MSSIRAAARAALERKRREAEAMAGERRVERPDLNDEAGENARPGTAAVKPKAVAKKSRWGSSDDESEEEDDNHACGRREEVMNAGGPSTGGQGYTEKMLAEANLFAAAQRDMQDVVESGKQRSQGVDPKQFFAPSPSSEDGHTDASPEAGPARPPEGLTAALAELESCDKEEPIAGPARPPPVESSVNDSELEDAPTGPARPDPEISRLRAQEAKQPVQSLNLVDAELQVTRSMSMSMLPLKKKALDMLQRCRSVDEFERLNKIDEGTHGIVFKARDKRTGEVAALKRVIMDEADDGFPLTALREVNILLSLDHPSIVNVNEVVVGSKLNFVFMVMEYVENDLKGLMDQMAESSVPRFTVPEVKAFMLQLLSGMSYLHENWIMHRDLKLSNILVTNSGDLKICDFGLARQFGGVGRYTQLVVTLWYRPPELLLGATTYGPAIDVWSLGCIFGELLSGAPLFNGRAEIDQLQKIFKLLGTPNDKIWPEFSSLPSVQKVTFTEQPYNKLRQKFPRDSTGLSDNGFELLNRMLTYDPSKRFTCSEALNHPFFEEYPPPQRPVFVEEAYRRASLGSEKVPAHTVASVTRSSCEI

SEQ ID NO: 23464 - protein, 432 aa, Prochlorococcus marinus str. MIT 9211
MTNAFNTNLSQAVFNAAQDLMPGGVSSPVRAFKSVNGDPIVFDRVKGPYAWDLDGNRFIDYVGSWGPAICGHSHPEVIAALQEALEKGTSFGAPCELENKLAGMVIEAVPSVEMVRFVNSGTEACMAVLRLMRAFTGRDKLIKFEGCYHGHADMFLVKAGSGVATLGLPDSPGVPRSTTSNTLTAPYNDLEAVKALFAENPDAISGVILEPIVGNAGFIPPEPGFLEGLRELTKENGSLLVFDEVMTGFRISYGGAQERFGVTPDLTTMGKVIGGGLPVGAYGGRKEIMSMVAPAGPMYQAGTLSGNPLAMTAGIKTLELLKQEGTYERLESLSQRLINGICESAKKAGIPITGSFISGMFGFYLCEGPVRNFQEAKQTNAELFGKLHRAMLEKGIYLAPSAFEAGFTSLAHSNDDIETTIKAFEASFSEIV

SEQ ID NO: 23465 - protein, 267 aa, Prochlorococcus marinus str. MIT 9211
MTNPIRNVTPGGSGGAATLMLILSFTGILLLTQALFIVPAGQVGVVTTLGKVSGGSRRPGLNFKIPFVQSVYPFDVRTQVQDEKFSSLTKDLQVIDANATVKYALKPSEAGRVFRTITYSDREVYSKIIKPSLLKALKSVFSQYELVTIASQWSDISELVEKTVSEELSKFDYVDVQALDLTNLKIADEYKAAIEQKQIAEQQLLKAQTEVKIAEQEALRYETLTRSLDDQVLFKLFLDKWDGKTQVVPALPGSKAGTPPVIVGGKR

SEQ ID NO: 23466 - protein, 338 aa, Frankia sp. EAN1pec
MSAIGLEVMGIRADPDLEKSMRVGLAAVEEMLRGSVRSEFSFVTEASRHLVDAGGKRFRPMVVLLAAQFADPDAAGVVPAAVAIELTHLSTLYHDDVMDEAPLRRGAASANARWTNTVAILTGDFLFARASEITADLGPEATRILARTIATLCEGQIRETVGVGPGQDPIEHYLRVITEKTASLIATSARLGAMLAGADPVTTDVLAAFGERFGVAFQLSDDLIDVASPSEDSGKTPGTDLREGIPTLPVLYALQGEDAAARRLRDLLGVNPRTEAGVTESGVVEALELLREHPAMDRARAELIRWSSEARECLAPLPDGSAKTALESLADFVIDRTS

SEQ ID NO: 23467 - protein, 562 aa, Fulvimarina pelagi HTCC2506
MYRYDEFDERFVRERVDQFRTQIARRLDGSLSEDEFKPLRLKNGLYLQLHAYMLRIAVPYGTMSGRQLRQLAKIAREYDKGYGHFTTRQNLQFNWPKLKDIPAILDLLADVEMHAIQTSGNCIRNTTADQFSGVAADESEDPRPTAELLRQWSSQHPEFVWLPRKFKIAVTGAEHDRAAIKVHDIGLKLKRNEAGEPGYEISVGGGLGRTPMIGKVIREFLPKDELLAYVEAIMRVYNAEGRRDNKFKARVKILVHETGAEEFTRRVEDEYAKLDGPTINAPQEEIERIAAYFAAPDYEDLPAESVTLDSARREDAGLDRFVEQNGFAHKQPGYIAFTVSLKPVGGVPGDMSADQMDAFADIAEKYSLGELRVTHSQNLVLPYVKKDDVPALYTELKAHGLATANAGLVTDIIACPGLDYCALATAKSIPIAQEIAKTFADDARQKEIGELPIKISGCINACGHHHVGAIGILGLEKGGRENYQITIGGDATEHASLGERLGPGIDGEDVPGAIEAIVETYLGEKQGSESFIETVRRVGADPFKTRFASFVEERSKALEAAE

SEQ ID NO: 23468 - protein, 506 aa, Porphyromonas gingivalis W83
MLEKLIILDFGSQTTQLIARRIRELNTYCEVYPYNKLPEDLSGVRGIILSGSPYSVYDSKAFRIELSELRGKLPLLGICYGAQSLVHQAGGKVEPCDSREYGRTHLTLRQPDDALLTGLQSGTTVWMSHGDTITSLPEGFEVIAGTEDVPNAAFRIRGEKTWGVQFHPEIYHSEEGTKLLGNFLDICGMKRDWTPASFIEATVQELRERLGDDKVILALSGGVDSSVVAVLLNKAIGRNLTCIFVDHGLLRKGEFERVLQDYEHLGLNVIGVNAKEKFFAALSGVTDPEQKRKIIGRGFIEVFDEEARKLKDIKWLGQGTIYPDVIESLSITGMVIKSHHNVGGLPERMNLRLVEPLRMLFKDEVRRVGLELGMMPHLIHRHPFPGPGLGIRILGEITEEKATILQNADDIYMSLMREWGLYDQVWQAGAILLPVRSVGVMGDERTYEYTVALRAVTSMDAMSADWVHLPYDFLAKVSNEIINKVRGVNRVVYDISSKPPSTIEWE

SEQ ID NO: 23469 - protein, 888 aa, Fulvimarina pelagi HTCC2506
MRQQESEFMTAKEDPTTFSVDLTNCDREPIHLLGAVQDFGFLVAVSFDWLIQRVSANIESFTGRSVDDLLGAPLNTLLGDNVIHLIRSRLQMLSSEDGTEHVFGIDFLSNGRKFDVSLHVSGSSIVIEAEPSDTHQTVTPGALVRSMSGRLQRTPSTRDLFEESVRQLRSVTGFDRVMLYRFNTDGAGTVVAEALRTGLESFRGLNYPAADIPTQARALYVRNRVRTIADVRAEPVPVEPALDPSGEPLDLSMSTLRSVSPIHIEYLQNMGVDASYSISIVIDGKLWGLFALHHYKPRRLSMEMRNATELFGLMISLMIEGKLAREQRAAEEKARELHDRFVGKLMSLTPSVSDLSNFAGDLRDIIPSDGFAVWADGLVKSYGKTPPDDAMPALARFLNRAAASRVYSSDELGAVYPPAKEFEQDAAGLLAIPISRSPRDYIMFFRQELVQTVNWAGNPQDKKMGYGPNGPRLTPRKSFEAWQETVRGKSRSWTDAEKKASEALRISILEVLVKFTEETSRQQAQSQQAQELLIAELNHRVRNILALIRALVIQSKATATSIDDFSDIVSGRIQALARAHDQITDEKYASQKLSEIIQTEVDAYIGGKADRVRLTGPNILVSPKAFSILALVFHEMVTNSAKYGGLSDSRGQVFVDWQIHEEDGCVIRWREEGGPAVQRPSRRGFGSTIIERSIPHDLGGEAQLTFKLAGLQARFVIPHTFIDYVEHNHDGLQSGLEQPIGSHGGQNGTSGLRGSGRMNASDGLLLDGMNALLVEDNVIISLDAEQLLESHGTSAVFVGANVKEARRILDEQSIDVAMLDVNLGIETSFPLVEPLMERGIPFVFVTGYGEQIEFPESAGPHVEAVKKPFSEDDLLSALRRAIERSRAA

SEQ ID NO: 23470 - protein, 542 aa, Medicago sativa
MGCLLSKDKDSEQEHNNGGYRYAESSGMHNHRNNHEQVNTSRTAPTSSYQPQIPTKPSSISAPSPKPLIKQDTNTILGKGLEDVKQFYTLGKELGRGQFGVTFLCTENSTGLLYACKSISKRKLVSKSDREDIKREIQIMQHLSGQPNIVEFKGAYEDRNSVHVVMELCAGGELFDRIIAKGHYSEKAAASICRQIVNVVNICHFMGVMHRDLKPENFLLASKDENALLKATDFGLSVFIEEGRVYRDIVGSAYYVAPEVLRPRCGKEIDIWSAGVILYILLSGVPPFWAETEKGIFDAILEGHIDFESEPWPKISDSAKDLVRKMLIQEPKKRITAAQVLEHPWIKGGNASDKPIDSAVLSRMKQFRAMNKLKKLALKVIAENMSEEEIRGLKAMFTNMDTDNSGTITYEELKAGLQRLGSKLSEAEVKQLMEAADVDGNGTIDCIEFITATMHRHKLERDDHLYKAFQYFDKDSSGFITRDELETAMKEYGMGDDATIKEIISEVDTIISEVDTDHDGRINYEEFCAMMRSGNQQQVKLF

SEQ ID NO: 23471 - protein, 159 aa, Brassica napus
  misc_feature (112)..(112): Xaa can be any naturally occurring amino acid
  unsure (1)..(159): unsure at all Xaa locations
MEEENQKTHRSVSRKDRSSGAGEEAAPGDKCSGERCRSSWAAAAIADCVALCCCPCAVVNLITLAFVKVPWMIGRKCIGRRKKRKKKMEREDRFHHNQRSEPVKGVSSGCCXGGYGELDDHRFVVERDGSLTKEEEEEKTATFKGEDEARINARAEAER

SEQ ID NO: 23472 - protein, 322 aa, Cytophaga hutchinsonii ATCC 33406
MKLTKNIVSIVTDVILNESEAIKNLVNHINDDFQHIIDAILSCKGRVVITGIGKSAIIGNKIVATLNSTGTPALFMHAADAIHGDLGMIQGGDVVICISKSGNTPEIKVLVPLIKNRGTILIGMVGNVDSYLAVQSDYVLNVTVEREACPNNLAPTTSTTATLVMGDALAVALLECRNFSSEDFAQLHPGGALGKQLYLRVNDVYTANEKPMVAPDATVKDVILEISSKRLGAAAVVDSAGILQGIITDGDLRRMLNAHDSFKQLCAADIMTKAPKTIDADEFAASAMLLMQSKNITQLIVMKNENFAGFIHIHDLLKEGIV

SEQ ID NO: 23473 - protein, 369 aa, Oryza sativa (japonica cultivar-group)
MRPGGPPSLRAGLQQQQQQQPGTPGRSRRRPDLTLPLPQRDLTSLAVPLPLPLPPSSAPSSTSSSGSSSLGGVPPRRIRSAPRRRPRRRCRSWSASAASGAARAGRCGWCGTAPRGGRTRSRCSTGTTTTPCGGRSRARSRSSAPPSTRPSCGATACTRQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 23474 - protein, 334 aa, Chlorobium tepidum TLS
MAKVKVGINGFGRIGRLVFRQAMENPEIEIVGINDLTDVKTLAHLLKYDSSHKKFNGEVTIEGDNLIVNGRTIAICAQKDPAQLPWASLGATLVVESTGIFTSREAASKHLAAGAKKVIISAPAKDKIDATIVIGVNDKSITGKEEIISNASCTTNCLAPMTKVLNDNFGIVKGFMTTVHAYTNDQNILDLPHKDLRRARAAACSIIPTSTGAAKAIGEVLPELAGKLDGFAMRVPIPDGSVTDLSVIIEKSATKEEINAVMKAAAEGPMKGILEYNVDPIVSCDIVGNAHSCIFDSPLTMSSGNMVKIVGWYDNELGYATRVVDLLGIYSKFV

SEQ ID NO: 23475 - protein, 403 aa, Ostreococcus tauri
MARRAREDDGFEIQGQIGEGAFGRAVNAWTDAYYRRVGRVYAIKTFKAPPTSTSGREQMVGLPAPTVREVTMLRAMKHENVVRLHKVIVDKAELSLSIAIDYAEYDLGAILTWHRRHRRYVHPRMVKSATWQLLHGLWYLHSNWIIHRDIKPQNVLVMGDGSECGVVKIADFGLARFVDPASVLRPLHENGPVVTLWYRAPELLLGARHYTRAIDIWAAGCIFAELVTLVVPFKGIPKEKEDPRTMYQYEQLESIVKHKGTPTVDQWPLVIDHPYYDKAKSCLFADSQSELVKPDERAPMRDKALAPEIRHVFEELCAYDPEKRPTAYEALTDFDYFAKDDPEPKRNIFDYEGNAGDARVVYPHRKIVQAEKPHDDEIKRKASDGGSDQTATREEGEVKRTRV

SEQ ID NO: 23476 - protein, 291 aa, Campylobacter coli RM2228
MEYNLASIYNDKELENLKNSFKLPKKICCFINRLKCDNLTLEREFQDLNLEYKKLNEYCYLFKACDKSILSSMQAFNEFKFYIQNYASYLCALNLDVKAGQSVLDMCAAPGGKSINLANFMQNEGYLACNEASKDRFFTLQKNLKNYGVKARVFMKDGKNIGNLCPLKFDKILLDAPCSTLAKMGLELEKSSKEIKNIAKLQKKLLHSALKALKVGGELVYSTCTFTKEENEEVIENALKSDFDIELLDINLENALAKNGQSSEFEAISKCKRILPCEEYDGFFITKLRKN

SEQ ID NO: 23477 - protein, 216 aa, Cytophaga hutchinsonii ATCC 33406
MLEYNQIFENNRKWLAEKNRTNSEFFDQLSEGQNPDYLFIGCSDSRVTAEAIMGAKPGEVFVHRNIANLVPNNDNSSASVIEYAVKHLGVKHIVVCGHYLCGGVKAAMQSVDLGILNPWLRNIRDVYRLHKNELNAIADETARYNRLVELNVQEQCINIIKMAVWQKRYLNEGFPEVHGWVFDIHTGKLIDLEIDFNNALKSIREIYDLGTSTENL

SEQ ID NO: 23478 - protein, 396 aa, Staphylococcus aureus subsp. aureus Mu50
MAKKIVSDLDLKGKTVLVRADFNVPLKDGEITNDNRIVQALPTIQYIIEQGGKIVLFSHLGKVKEESDKAKLTLRPVAEDLSKKLDKEVVFVPETRGEKLEAAIKDLKEGDVLLVENTRYEDLDGKKESKNDPELGKYWASLGDVFVNDAFGTAHREHASNVGISTHLETAAGFLMDKEIKFIGGVVNDPHKPVVAILGGAKVSDKINVIKNLVNIADKIIIGGGMAYTFLKAQGKEIGISLLEEDKIDFAKDLLEKHGDKIVLPVDTKVAKEFSNDAKITVVPSDSIPADQEGMDIGPNTVKLFADELEGAHTVVWNGPMGVFEFSNFAQGTIGVCKAIANLKDAITIIGGGDSAAAAISLGFENDFTHISTGGGASLEYLEGKELPGIKAINNK

SEQ ID NO: 23479 - protein, 403 aa, Chlorobium tepidum TLS
MKRDYYEILGVARSADKDEIKKAYRKLALKYHPDKNPDNKEAEEKFKEVNEAYEVLSNDDKRRRYDQFGHAGVGSSAASGSGPGGAGYGDINDIFSAFNDMFSGGGGRARTGGSPFSGFEDVFSGGFSGSGSGRRRSAGIQGTDLKIRLKLTLEEIAKGVEKTIKIKKLVTCRECNGTGSKSGKTEICPTCHGSGEVRQATKTMFGQFMNISVCPTCGGEGRVVKDRCPSCYGEGIKQGEATVKITVPAGVQDGNYLTLQGQGNAGPRGGAPGDLIVVIEEKPHELFKRNGDDIIYDLSVGFPDLVMGTKIEVPTLDGHVKLTIPAGTQPNTMLRIGGKGIGHLRGGGSGDLYVRVNVFVPKEVSGKDRDLLKELKKSTVICPNHGDENHEKSIFEKAKDIFS

SEQ ID NO: 23480 - protein, 253 aa, Staphylococcus aureus subsp. aureus Mu50
MRTPIIAGNWKMNKTVQEAKDFVNALPTLPDSKEVESVICAPAIQLDALTTAVKEGKAQGLEIGAQNTYFEDNGAFTGETSPVALADLGVKYVVIGHSERRELFHETDEEINKKAHAIFKHGMTPIICVGETDEERESGKANDVVGEQVKKAVAGLSEDQLKSVVIAYEPIWAIGTGKSSTSEDANEMCAFVRQTIADLSSKEVSEATRIQYGGSVKPNNIKEYMAQTDIDGALVGGASLKVEDFVQLLEGAK

SEQ ID NO: 23481 - protein, 505 aa, Staphylococcus aureus subsp. aureus Mu50
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVENQNDGVNDGDTVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 23482 - protein, 434 aa, Staphylococcus aureus subsp. aureus Mu50 [sequence omitted]

SEQ ID NO: 23483 - protein, 241 aa, Burkholderia pseudomallei K96243
MSLSSPSFAAPLSDAPRLDACEAVLFDLDGTLADTAPDLAAAVNKMQRSRGIAQTPLDALRPLASAGARGLIGGAFGIAPADAEFDALRDEFLANYAADLCLHTTLFPGIGALLDDLDARGVRWGIVTNKAARFTDPLVALLGLAARAACVVSGDTASHPKPHPAPLLYAADRLSLAPERIVYVGDDLRDIQAGSAAGMPTVAAAYGYCGDGAAPADWRAQHLVETTDDLQRLLRVLRYNA

SEQ ID NO: 23484 - protein, 513 aa, Candida albicans SC5314
MSEPTKNLESIRSQELDSDHSISYDSTTGLKHGLKDRHLSLIALAGIIGPGIMIGASLALASGPAALLLGFGIIGIVAFCMMQSLGEIATMYPTGATFSTLGAKFVDYSWGGAVGWNYVIIWIAVLANEYNTTASVLQFWGPQVPLYGYVLILWAVFTAFQFLGVSVWGEFEFWLALTKIVGLVAFYIFSIIYCAGGVKGTKAFGFHYWNDPGPFANGFKSFVSTLTFASTFYSGCEVTAIAASEAKNPSRALPKAIKQTFWRILIVYLGIAISYGLTVPYDDPRLSKGSKTLKSPMTIAIQRAGWDGGAHLINAFIIVVCISAISSSIYTGSRSMVNLANEGCAPSILKRVNGQGVPYAAVILMSTLGLISLMNQSTGAANAYQYIVNLSGVAVFIVWGNVCFYHIRFRQAMKLQGRSLDEIPFKGMLYPYLPILGLALNVILALIQGWSYFKPFDAGNWVDAYILLPFFFVLYFGFKLWHKSKWVNLEEVDLDEGRREDDEKGVDNNKWMI

SEQ ID NO: 23485 - protein, 163 aa, Prochlorococcus marinus str. MIT 9211
MTADLQNTSSTEESSSGGLTSPPESDSPKEKKPSSSSGLKTHNQKGETKDLIKEFELSQQKDKVPEVYVGDTVKVGVRISEGNKERVQPYEGVVIAKRHGGINQTITVRRIFQGVGVERVFMVHSPQVASIKVERRGKVRRAKLFYLRERVGKATRVKQRFDR

SEQ ID NO: 23486 - protein, 202 aa, Magnetococcus sp. MC-1
MSNPLRVGVGGPVGSGKTALLEWLCREMQQHYSVAAITNDIYTKEDQRILTASGALPAERIMGVETGGCPHTAIREDASMNLAAVEDMQLRFADLELIFIESGGDNLAATFSPELADLTLYVIDVAAGEKIPRKGGPGITRSDLLVINKTDLAPLVGADLAVMEQDTLRMRGSRPFVFTNLKQGDGVAAIIQFLVEKGGLGV

SEQ ID NO: 23487 - protein, 286 aa, Medicago truncatula
MVKLKIPEHQVAGHQAKNGILGPLIDDSGKFYKPLQDDERGSNELAFYTSLYSDPRIPTNILKFFPSFHGTQTVDASDGSGLHPHLVLEDIVSNYTNPAVVDIKIGSRTWHPQSSEDYIRKCLQKDRESSSIKLGFRISGLRSVGPTNQLWQPHKKFLMDLSVDDVMLVLRKFVSSDGNVDEPDCVFGSRVFVPILEELLELKKWFEVQTIFHFYSCSVLVVYEKDEKEDEKKSASAVVKLVDFAHVVDAKGAIDHNFLGGLCSLIKFVKDVLTGLSDVQTSNPKA

SEQ ID NO: 23488 - protein, 1075 aa, Methanococcoides burtonii DSM 6242
MAKRNDIKKILLIGSGPIMIGQAAEFDFSGTQACRSLKEEGYKVVLVNSNPATIMTDPEMADAVYIEPLEAKIIAKIIEKERPDAIIAGIGGQTGLNLTSELAEMGVFEKFNVELLGTSLEAIKNTEDRELFKNKMEDIGEKVPRSVAVSTLKEAEAIIDELGLPLIIRPAYTLGGAGGGIAYTKEQLLEISERGLRRSRINQVLIEESVLGWKEFEYEVMRDSNDTCIVICNMENLDPMGVHTGESIVVTPSQTLNDIEHQMLRTAAIKIIRALGIEGGCNIQFAAKDGEYRIVEVNPRISRSSALASKATGYPIARVTAKIAIGMTLDEILNDVTKKTPASFEPTIDYIVTKIPRWPFDKFVTADKTLTTAMKSTGEVMSIGRTIEESLQKAVRSLDIDMKFGNKTWEQAEIITLLKTPTSERLFVIFHALNTGMSIEEVSELSGIDVFFIEKIDNIVKMEKKLAAELFAGEPDIALLTEAKRLGFTDERIGEMTGKSREEINDLRRNNDVISTYKMVDTCAAEFAAETPYYYSCYETMCEDVPTDRKKILILGAGPIRIGQGIEFDYCTVHAVTAIREDGIEAHIVNNNPETVSTDYDTSDKLFFEPLTLEDVMNIIEREKPYGVLVQFGGQTSVNLALPLQKELARRTDLDTIIMGTSPEDIDMAENREKFNLMMSKLGVAQPEAGYATSQEDAIEIATRIGYPVLVRPSYVLGGRAMEIVYEQNDLERYMREAVRVSPEQPVLIDDFLEAAVEIDVDAVCDGKDVLIGAIMEHIEEAGVHSGDSACVIPPRYLSEETLNTVRDYTRKIALSLNVIGLINIQMAEQDGKVYVLEANPRSSRTIPFVSKAVGLPLAKIAAQVIIGHSLEELGYAQQDELHVEHYSVKEVLLPFDKLPGADPVLGPEMKSTGEVMGIDYDFGRAFFKAQLSADNLLPLSGYVFMSIKEADREEFVEIAKKMQDAGLKLIGTKGTANYLAEKGINMEAVMKLHEGSPNVIDMLRRDEVGLIVNTPTGSQSRKDGYQIRRAAVDFKVPYITTVQAARAAADAITSMKTGEITIKSINEYHKEINN

SEQ ID NO: 23489 - protein, 1043 aa, Vibrio vulnificus
MFTATDVLKPEFVAQPLDKLWALISPLYMVDESQWLEQLLPLATPSAEEKQAIASRTTQLIEAIRADKKSIQLIDALLLEYSLDTHEGILLMCLAEALMRIPDAATADALIKDKMSVADWKSHLKNSESVFVNASTWGLMLTGKVVGLGDDETQSASQALNRLVNKLSEPVIRKAMYQAMKIMGHQFVRGRTIEEAQKNGRPMRDKGFTYSFDMLGEAALTTADANKYFKDYLMAIEAVGRETYGNDTSPAPSVSIKLSALHPRYEVANEHRVMSELFDTLAQLLKRAVELDVAITIDAEEADRLELSLKLFEKLYRSETVKGWGKFGLVVQAYSKRALPVLVWLNALAKEQGDLIPLRLVKGAYWDSEVKWSQQRGYDNYPVYTRKEATDVAYLACARFLLSDDVRGNIFPQFASHNAQTVSSIATMATHSDYEFQRLHGMGDSLYNHVMEQYRQPVRIYAPVGSHKDLLPYLVRRLLENGANSSFVHRLVDARCPVAELTKHPVEALTSFETLNNTKIPLPAAIFPERKNSYGVNVDIESEAKPFEAQVESFLSKQWLAGPIINGASLAESMIKDGQAESVTAPYDRRIQVGQIAFANLDHVSQAIDIAQAAFADWNRTPLVEKARCLDNLADLMEANLAELVALCHQEAGKTLHDSIDEVREAVDFCRYYAKQAQNLQPFELEGFDGVKRIASREGLGVFVCISPWNFPLAIFLGQVTAALVAGNTVVAKPAEQTSLIAVRAVELMLQAGFPASVVQLIPGRGADIGSALTSHPSIAGVAFTGSTATAQRINVTLAQREAKPVPFIAETGGQNAMIVDSTALPEQVVRDVIRSAFASAGQRCSALRVLFVQQDIADRVIGLIQGAMNELSVGVPYLHKTDVGPVIDARAKEKLLQHIEQMNQTQKPIAQLTLADDCQHGDFVTPTAFEISGIDVLKEEQFGPILHIVRFKASELTRVVEHINQTGFGLTMGIHSRNETTYRWIEKHARVGNCYINRDQVGAVVGVQPFGGQGLSGTGPKAGGPHYLYRFTQVQFNQTENA

SEQ ID NO: 23490 - protein, 196 aa, Glycine max
  misc_feature (179)..(179): Xaa can be any naturally occurring amino acid
  misc_feature (186)..(186): Xaa can be any naturally occurring amino acid
  misc_feature (188)..(188): Xaa can be any naturally occurring amino acid
  unsure (1)..(196): unsure at all Xaa locations
KNKNQHIHPPQRHSHHHLEELHNFIFLDMASLALETEDVISDIYLSLGLKESDKGVGVPRVLSLLSSLLERSVQRNETLLEAKHVKDVVTVFHGLRAPTLSVRKYIDRIFKYSGCSPSCFVVAHIYVDRFIQHTEIKLTSLNVHRLLITSIMLAAKFIDDAFYNNAYYAKVGGVSTSEXNRLEMSXLXGIEFRLQF

SEQ ID NO: 23491 - protein, 521 aa, Oryza sativa
MAARPCQAAARPGTASTRIREASRATTRAKEVRGRAVANGGGHGAACDKGKWFGGELTNEINGVGGADGVAARWTRRRGGAAPRVHGRGRREGEVAMGSLELLVTRPRTHWLLRCSVADGEGESGASNNNGAAVMEVKREKDSMGGARVFIAKARSGHRSMGSSSGSDRLRDLQAFDDTKAGVKGLVDAGVTTIPAIFHHHPLLLDDAEEDADVIPVIDLQADVDRGHLVGQVRAAAQCVGFFQVVNHGIPGELLEEMLAAVRRFNEQPAEGKKAWYSRDSGRRVKFNSNFDLFQSPAANWRDTLLLELTPRPGPAAEEIPPACRGVVGEYVEAVQRLGGALLELLSEALGLPPEYLGGLGGGLATMAAHYYPPCPEPHLTLGTTRHSDPSFLTVLLQESKGLQVLMRQRQRWVDVPPVAGALVVNIGDLLQLVSNDLFRSVEHRVLATTAAAEPRLSVACFFRPDYACTRVYAPVTTTPPPPLYRSTTMPEFLSHYRAKGLDGRSALHHFRIPPPSSPPH

SEQ ID NO: 23492 - protein, 586 aa, Lotus japonicus
MCGILAVLGCSDFTQAKRVRVLELSRRLKHRGPDWSGLHQHGDCYLAHQRLAIVDPASGDQPLFNEDKSIIVTVNGEIYNHEELRKQLPNHQFRTGSDCDVIAHLYEEHGENFMDMLDGIFSFVLLDTRDNTFIVARDAIGVTSLYIGWGLDGSVWISSEMKGLNDDCEHFEVFPPGHLYSSRERAFRRWYNPTWFSESIPSAPYDPLAVRHAFEKAVIKRLMTDVPFGVLLSGGLDSSLVASITSRYLATTKAAEQWGSKLHSFCVGLEGSPDLKAAKEVADYLGTVHHEFTFTVQDGIDAIEEVIYHVETYDVTTIRASTPMFLMSRKIKSLGVKWVISGEGSDEIFGGYLYFHKAPNKEEFHTETCRKIKALHQYDCLRANKSTFAWGLEARVPFLDKEFINVAMNIDPEYKMIKRDEGRIEKYILRRAFDDEEKPYLPKHILYRQKEQFSDGVGYSWIDGLKDHAAKHVTDKMILNAGNIFRHNTPLTKEAYYYRMIFERFFPQNSARLTVPGGPTVACSTAKAVEWDAAWSNNLDPSGRAALGVHLSAYDDKQNNLINNKPVEFEKLIPMEAPSLGVAIHS

SEQ ID NO: 23493 - protein, 614 aa, Polaromonas sp. JS666
MSASSSLIDIKVPDIGDFDEVSVIEVLVKAGDTIKAEQSLITVESDKASMEIPSSQAGVVKEVKVKIGDKVKQGSIVLLLEGAGAALAPKSEEKQTPAPVPSGQAAPASAAAQAPAPAAASFAGTADLDCDVLVLGAGPGGYSAAFRAADLGLKVVLVERYATLGGVCLNVGCIPSKALLHVAAVMDEVRHFDSLGVSFGEPVLDINKLRTHKEKVVGKLTGGLAAMAKMRKVTVVRGYGSFVGAHHVEVQETSGAAQETTGKKQTIAFKHCVIAAGSQAVRLPFMPEDPRVVDSTGALNMKEVPKRMLILGGGIIGLEMGTVYSSLGARLDVVEMLDGLMQGADRDLVKVWQKMNAPRFDNIMLKTKTVAAKATAAGIEVSFEGEGAPAPQTYDLVLQAVGRTPNGKKIAAEKAGITVTDRGFIPVDIQMRTNVPHIFAIGDVVGQPMLAHKAVHEAHVAAEVIAGELQGNKELASAAFNARVIPSVAYTDPEIAWVGLTEDQAKAQGIKVKKGLFPWTASGRAIANGRDEGFTKLLFDDSPEAHGHGKILGGGIVGTHAGDLIGEIALAIEMGADAVDIGKTIHPHPTLGESMGLAAEVAHGSCTDIPPARK

SEQ ID NO: 23494 - protein, 46 aa, Lemna aequinoctialis
VTDIPATTGATFGHEIVCYESPRPTMGIHRFAFILYEQLGRQTVYA

SEQ ID NO: 23495 - protein, 586 aa, Lotus japonicus
MCGILAVLGCSDDSQAKRVRVLELSRRLKHRGPDWSGLHQHGDNFLAHQRLAIVDPASGDQPLFNEDQSIIVTVNGEIFNHEELRKQLPNHKFRTGCDCDVIAHLYEEHGENFVDMLDGIFSFVLLDTRDNSFLVARDAIGVTSLYIGYGLDGSVWIASELKGLNDDCEHFELFPPGHLYSSKEKEFRRWYNPPWFSEAIPSAPYDPLALRQAFEKAIIKRLMTDVPFGVLLSGGLDSSLVASVTARYLADTKAAKQWGSKLHSFCVGLEGAPDLKAAREVADYIGTVHHEFQYTIQDGIDAIEDVIYHVETYDVTTIRAGTPMFLMSRKIKSLGVKMVLSGEGSDEIFAGYLYFHKAPNKEELHQETCSKIKALHKYDCLRANKSTYAWGLEARVPFLDKKFIDVAMGIDPENKMIKRDEGRIEKWVLRKAFDDEENPYLPKHILYRQKEQFSDGVGYGWIDGLKDHAAKHVTDKMMLNASNIYPFNTPNTKEAYYYRMIFERFFPQNSARLSVPGGASIACSTEKAIEWDAAWSNNLDPSGRAALGVHDSAYDDQLNKSVSKGVEPEKIIPKMEVSPLGVAILS

SEQ ID NO: 23496 - protein, 556 aa, Polaromonas sp. JS666
MAVVDIQVPDIGDFDEVTVIELLVKPGDTVKAEQSLITVESDKASMEIPSSQAGVVKELKVKLGDKVKQGSIVLTVEAAGAAVPATASAAAASAAPAASTAAAPAPAPAPAPVPASAPAAAAGPVEVRVPDIGDFKDVSVIEVLVKPGDTIKLEQSLVTVESDKASMEIPSSAAGVLKELKVKLGDIVNIGDLLAILEGSVAATGTSPAPAPAAPAAAPAPVSAAAAAPAAAVMPAHEPATAQQGSLPHASPSVRKFARELGVPLAEVKGTGPKGRITQDDVQAFTKSVMAGDTRTQAQAAKAPASSGGTGVGLDLLPWPKVDFTKFGPVERKDMSRIKKISGANLLRNYVMIPHVTNHDDADITELEAFRVSTNKENEKAGLKVTMLAFLIKASVAALKKFPEFNASLDGDQLVYKQYYHIGFAADTPNGLVVPVLKDADKKGVLQISQEMGELAKKARDGKLTPAEMQGASFTISSLGGIGGRYFTPIINAPEVAILGVSKSQMEPVWDGKAFQPRLMLPMSLAWDHRVIDGAGAARFNAYLGQILADFRRVLL

SEQ ID NO: 23497 - protein, 189 aa, Methanococcus maripaludis S2
MIVILNNGGQYVHRIQRSLKYLDVPAKIVPNSTTLEEIAANPEIKGVILSGGPDITKATNCENIALNSELPVLGICLGHQLISKAYGGEVSRADSEEYASIKIYVKQENDLFKGVPSEFTAWASHMDEVKVTPDCFEVLAYSDICGVESIKHKEKSIYGVQFHPEVSHTEYGDIILKNFCKKCGFGFEE

SEQ ID NO: 23498 - protein, 46 aa, Perilla frutescens var. crispa
VTDIPATTGATFGQEIVCYESPRPSMGIHRFVFVLFRQLGRQTVYA

SEQ ID NO: 23499 - protein, 771 aa, Cyanophora paradoxa
MSAFVVPVPSGSSSSAQIVASSQVVISREHAPKIHSRAQNFAIDTRARSFLNTPSQAAQFRQFNGLRRAESVFSKKSDANAALRQSKVAASTGFVINNQATAAMTPVDDKCINSIRFLAIDAIEKAKSGHPGLPMGCAPMSYVLFNEFMKFNPKNPDWIDRDRFVLSAGHGCMLQYALLYLTGYDSVGIEDIKTFRQWESECPGHPENFVTKGIEVTTGPLGQGIAQAVGLAMGEAHLAARFNKPDVKLIDHYTYVIMGDGCNMEGVAAEAASLAGHYGLGNLIALYDDNEISIDGNTDISFTEDVTKRYQSYGWHTVVVEDGNTDINAIRKAIAEAKAVTDKPSLVTIRTTIGYGSPNKANSYAVHGAALGDKEVDATRQNLNWPYAPFEIPEEAMNKWREAIPKGKSAEDEWNKKFAEYKAKYPQEAADFEKYVMKKELPANWEKCLPVYDPATDAGDATRILTGNTLNAIADAVPTFLGGSADLASSNMTLLKKYADFQKTSPEGRNLRFGVREFAMAAIANGLHLHPSGLIPYGATFLVFSDYMRAAMRLSSLSKCRTIYVLTHDSIGAGEDGPTHQPIEHLAAHRAVPNTFVFRPCDGNEVSGAYKVAVEERETPSLMILTRQKIPTLDGTSIANTAKGAYVLSDNSTNGKPDLILMGTGSEVHLCVNAAEAIRKEGKTVRVVSMPSWELFERQSAEYEASVFPKDCKRALAVEAASSFGWHKYFGDEGAMVSIDGFGASAPGDKLMQEFGFTTENVIAQAKKLLA

SEQ ID NO: 23500 - protein, 913 aa, Polaromonas sp. JS666
MAANPNEAGADNLRAAANDALGENTLDKDKQETREWMDALSAVIESEGPERAHFLLEQLLEHARQKSIDMPFSANTAYVNTIETDQEERSPGNLEIEERLRAYMRWNAMAMVVKANRLHPADGGDLGGHIGSFASLASLFGAGFNHFWHAESENHGGDCLYIQGHVSPGVYARAYLEGRLTEEQLLNFRQEVAGKGLSSYPHPKLMPEFWQFPTVSMGLGPLMAIYQARFLKYLHARGIANTENRKVWVFCGDGEMDEVESMGAIGLAAREKLDNLVFVINCNLQRLDGPVRGNGKIIQELEGEFRGAGWNVIKLIWGSNWDPLLARDKDGALRKVMIDTLDGDYQAMKANDGAYVRKHFFGQNPKTLEMVSKMSDDDIWNLRRGGHDSQKVYAAFHAAVNHTGQPTVLLIKTVKGFGMGKIGEGKNTVHQTKKLTDDDIKIFRDRFNIPIPDSQLADLPFYKPADDTPEMRYLHERRKALGGYLPHRRVKADESFTVPALETFKAVLEPTAEGREISTTQAYVRFLTQLLRDQALGPRVVPILVDEARTFGMEGLFRQVGIYNPDGQKYTPVDKDQVMYYKEDAKGQILQEGINEAGGMSSWIAAATSYSTNNRIMVPFYVYYSMFGFQRIGDLAWAAGDMQARGFLLGGTSGRTTLNGEGLQHEDGHSHILAGTIPNCISYDPTFAHEVGVILHHGLKRMVEKQDNVYFYLTLLNENYPMPGLQPGTEEQIIKGMYLCKEGAKLTPRVQLLGSGTILRESIAAQELLEKEWGVAANVWSCPSFNELARDGQNAERWNLLHPTDKPRVPFVGEQLDKHAGPVVASTDYMKAYAEQIRPFIPKGRTYKVLGTDGFGRSDFRSKLREHFEINRHYIVIAALKALSEEGTVPVAKVAEAIKKYGINADKINPLYA

SEQ ID NO: 23501 - protein, 382 aa, Ostreococcus tauri
  misc_feature (380)..(382): Xaa can be any naturally occurring amino acid
  unsure (1)..(382): unsure at all Xaa locations
MPRADDDAVTTTADDDKKPTFASLGLCKELVSACEELGWREPSAIQQKSIPEALQGRDVIGLAQTGSGKTGAFALPILQSLLDEPRTYHSLILSPTRELAIQIAEQVEALGRGIGVRTATLVGGIEMTSQAIMLGKRPHVVVGTPGRVVDHLENTKGFGLKALKVLVLDEADRLLNLDFEEEIDKILRVIPQDRRTQLFSATMTSKVQKLQRACLRDPVKVEVSAKYSTVDSLRQHYLFIPAKHKDCYATYLFNELSASTLIVFARTCDQTRKLALIARNLGFGAVPIHGQMSQPKRIAALQKFKAGERNILIATDVASRGLDIPSVDVVINYDVPQNSKDYVHRVGRTARAGRSGLAVTMVTQYDVELYQKIERLINKXXX

SEQ ID NO: 23502 - protein, 586 aa, Brassica oleracea
MCGILAVLGCSDDSQAKRVRVLELSRRLRHRGPDWSGIYQNGFNYLAHQRLAIIDPDSGDQPLFNEDKSIVVTVNGEIYNHEELRKGLKNHKFHTGSDCDVIAHLYEEHGENFVDMLDGIFSFVLLDTRDNSFMVARDAVGVTSLYIGWGLDGSLWVSSEMKGLHEDCEHFEAFPPGHLYSSKSGGGFKQWYNPPWFNESVPSTPYEPLAIRSAFEDAVIKRLMTDVPFGVLLSGGLDSSLVASITARHLAGTKAAKRWGPQLHSFCVGLEGSPDLKAGKEVAEYLGTVHHEFHFTVQDGIDAIEDVIYHVETYDVTTIRASTPMFLMSRKIKSLGVKMVLSGEGSDEIFGGYLYFHKAPNKQEFHQETCRKIKALHKYDCLRANKATSAFGLEARVPFLDKEFINTAMSLDPESKMIKPEEGRIEKWVLRRAFDDEERPYLPKHILYRQKEQFSDGVGYSWIDGLKAHAAENVNDKMMSKAAFIFPHNTPLTKEAYYYRMIFERFFPQNSARLTVPGGATVACSTAKAVEWDASWSNNMDPSGRAAIGVHLSAYDGSKVALPLPAPHKAIDDIPMMMGQEVVIQT

SEQ ID NO: 23503 - protein, 984 aa, Burkholderia pseudomallei K96243
MTSSAFDSSRQGCGSGQCACRRAAQTRRADPFDDTDYGTPTRHADTDVTLDIDGRAVTVPAGTSVMRAAIEAGINVPKLCATDSLEPFGSCRLCLVEIEGRRGYPASCTTPVEAGMKVRTQSDRLQALRRNVMELYISDHPLDCLTCAANGDCELQDMAGAVGLREVRYGFDGKNHLSDAKDESNPYFSYDPSKCIVCNRCVRACEETQGTFALTIASRGFESRVAASAGEAFMDSECVSCGACVAACPTATLIEKSVARLGQPEHEIVTTCAYCGVGCALKAEMKGEQVVRMTPHKNGLANEGHACVKGRFAWGYATHKDRITKPMIREKITDAWREVSWDEAIGYAAARFRRIQDEHGRDSIGGITSSRCTNEETYLVQKLVRAAFGNNNVDTCARVCHSPTGYGLKTTLGESAGTQTFASVGSADVIVVIGANPTDGHPVFGSRLKRRVREGAQLIVVDPRRIDLVDGPHVKAVHHLQLRPGTNVALVNALAHVIVTEGLVDEAFVAERCEPHAFDVWRAFAARPENSPEATADITGVPADAVRAAARLYATGGRAAIFYGLGVTEHAQGSTMVMGIANLAMATGNLGIEGAGVNPLRGQNNVQGSCDMGSFPHELPGYRHIGDAAVRARFDEAWSTTLQPEPGLRIPNMFDAALDGSFKGLYCQGEDIVQSDPNTQHVAAALASLDCLVVQDIFLNETAKYAHVFLPGATFLEKDGTFTNAERRISRVRRAMRPLSGYADWEVTLMLSRALGYDMHYAHPSEIMDEIARLTPTFAGVSYALLDELGSVQWPCNDAAPQGTPTMHVDQFVRGKGKFVITQYIASPEKVTPRYPLILTTGRILSQYNVGAQTRRTENVRWHGEDRLEIHPHDANDRGIRTGDWVGVASRAGQTVLRALVTERMQPGVVYTTFHFPESGANVITTDSSDWATNCPEYKVTAVQVAPVAQPSEWQRAYTRFRAEQLALLEQRTAERAPAIATGK

SEQ ID NO: 23504 - protein, 459 aa, Synechococcus sp. CC9605
MTQTITSQRPFEANRDAESPNRNLTPITTELDGTDRLVVGGCRLSDLAERYCTPLYVLDEATVRATCRAYREALNKHYAGPSLPIYASKANSSLVMSSLAASEGLGLDAVSAGELLTALRGGMPGDRMVLHGNNKSDEELLLAYANKVTIVVDNQHDLDRLAELVPAGSEPARLMLRFTPGIECHTHEYIRTGHLDSKFGFDPDQVEPVLRSLVGQPWAQLTGLHAHIGSQIFELEPHRDLAAVMADKLKLARDLGHPVTDLNVGGGLGIRYVESDDPPSIEQWIKVVAEAVTSACQERGLELPRLMCEPGRSLVATAGVTLYSVGSRKTIPNVRTYVAIDGGMSDNPRPITYQSLYTCCLADRPLAKPDESVNLVGKHCESGDVLLKDLSLPTTESGDIVAVFATGAYNASMSSNYNRIPRPAAVLVHDGSAELVQKREQPDDLLRYDVLPERFNALR

SEQ ID NO: 23505 - protein, 196 aa, Campylobacter coli RM2228
MIISAKFITSLDKFDKNFASHFSEVAFLGRSNVGKSSLINSLCKQKKLAKSSATPGKTQLINIFEVLCKKDEDKFSIHFIDLPGFGYAKVSKNLKEIWNKNLDEFLKLRSSIKLFVHLIDSRHTNLDIDLNLDEYLKSFLKPDQRVLKVFTKCDKLNQSEKAKLKNNFKDAILISNLNKMGLDDLEHEIIKQTLGL

SEQ ID NO: 23506 - protein, 247 aa, Arabidopsis thaliana
MALLRRDLLGYTPLYAEKLDPSLSSIGDSKESFYFGSLEGVLAQRYPNQWPSEGILPSWRQTMETYYKNVLSVGRKLLGLIALALDLDEDFFEKVGALNDPTAVVRLLRYPGEVISSDVETYGASAHSDYGMVTLLLTDGVPGLQVCRDKSKQPHIWEDVPGIKGAFIVNIGDMMERWTNGLFRSTLHRVMPVGKERYSVVFFLDPNPDCNVKCLESCCSETCPPRFPPILAGDYIKERFRLTYATS

SEQ ID NO: 23507 - protein, 418 aa, Neurospora crassa
MSLSNKLSIEDVDLKGKRVLIRVDFNVPLDAEKKVTNPQRIAGAIPTIKYALDHGAKAVVLMSHLGRPDRKPNPKYSLKPVVPELEKLLGKKVTFAPDCVGPEVEEIVNKADNGEVILLENLRFHIEEEGKGTDAEGNKVKADKAKVEEFRKNLTKLGDVYINDAFGTAHRAHSSMVGIDLPVKAAGFLMKKELQYFAKVLESPQRPFLSILGGAKVSDKIQLIDNLLDKVNTLIVCGGMAFTFKKTLQNMPIGNSLFDEAGAKIVPDLVKKAEKNNVKLVLPVDFTIADKFDKDANTGYATDKDGIPDGWMGLDCGEESVKLFTQAINESQTILWNGPAGVFEFDKFAKGTKATLDACVKAAEEGRTVIIGGGDTATVAAKYGVEDKLSHVSTGGGASLELLEGKALPGVVALSERQ

SEQ ID NO: 23508 - protein, 139 aa, Arabidopsis thaliana
MSRWSSCQEFLKHVESRNPGQPEFMQAVTEVIESLWPNIEKNPKYADASLLERIAEPERVVMFRVCWMDDKGVVQVNKGYRIQHSMAIGPYKGGLRFHPSVNLSILKFLAFEQTFKNALTTLPMGGGKGGSDFDPKGKS

SEQ ID NO: 23509 - protein, 618 aa, Oryza sativa (japonica cultivar-group)
MGGAHSREDLDLTSSDDEDDDEEYDAQTATSAASREDILRTSTPSSLEFLDAKLKALDLKYQAPNAAKLYLHVGGASASARWVPAERRATYAFVDKATAAGDSDCGGPRWVLEVGPGPRVSAPVGPGATAQGRSPAQRRADFAAGGSVWALRLPTDAAFRRFRQEYDRCLFENTYGVEATDEGRKEVFGADFAAWARPGESDDAVWADAEDSFTPPVATPARDLLEEFEEEAGDGSIQSLALGALDNSFLVGGSGIQVVKNFRHGVHGKGVSVRISDGRGGGNAYMTPQKALLMRGETNMLLMSPGETGTRHSNGVHHVDIETGKVVAQWRFEKDGTDITMRDIANDSKGAQLEPSGSTFLGLDDNRLCRWDMRDSRGRVQTIGSSSESPVLQWSQGHQFSRGTNFQCFASTGDGSIVVGSVDGKIRLYSKSSMRMAKTAFPGLGSPITHVDVTYDGKWILGTTDTYLILICTIFKDKDGKEKTGFSGRMGNRIAAPRLLKLSPLDSILAGSENKFHGGQFSWVTENGKQEKHLVATVGKFSVIWNFQQVKDSNHECYRDQEGLKSCYCYKVVLKDESIVDSRFMHEKFATTDSPEAPLVVATPMKVSSFSLANRRLH

SEQ ID NO: 23510 - protein, 540 aa, Neurospora crassa
MMLSRAAVRSIAGARVAAHAASPLLSQRTLPAVWTRSMAKDNKPPKFSKPESTPAQKATPKAPEPAESEKAEQKQQQQQQQQTPAESEPEPEIDLSKLPDLRGGIPTTLEYEMAQKEAGKKPVAGEEAETQAEGAEGPEAATSGSGGGGRKKGQLPDSAYVSSTEKRRQKMANWAFIAAGLALVGGTIYLGREWDEEELEKHHDIPNGWGLGLWWKRAKARMTGTVSYYQEPAFEKLLPDPDPSFERPYTLCISLEDMLVHSEWTRDHGWRLAKRPGVDYFLRYLSQYYEIVLFTSVPFANAEPIVRKMDPYRFIMWPLFREATKYKDGEIVKDLSYLNRDLSKVIIIDTDPKHVRAQPENAIVLPKWKGDPKDTELVSLVPFLEFIHTMNFPDVRKVLKSFEGQHIPTEFARREAIARAEHNKLVAAKAKKAGLGSLGARFGIKPSKLNPMAMEGEEDPSEAFAKGKMIQDIARERGMRNYLAMEEEIKKNGEMWLKMEQEAQEKAQKEMMKNMQSSVFGWFGGAPSGEQQSGESEKKA

SEQ ID NO: 23511 - protein, 294 aa, Arabidopsis thaliana [sequence omitted]

SEQ ID NO: 23512 - protein, 999 aa, Oryza sativa
MVAARRSAASSSFFLLLLVLAVRVRASSDRVQERDRSALLELRGAAGLLGRWPTGSAVADHCSWPGVTCDASRRVVAVAVAAPPASGSSELAGELSPAVGLLTELRELSLPSRGLRGEIPAEIWRLEKLEVVNLAGNSLHGALPLAFPPRMRVLDLASNRLHGEIQGTLSDCKSLMRLNLSGNRLTGSVPGVLGSLPKLKLLDLSRNLLTGRIPSELGDCRELRSLQLFSNLLEGSIPPEIGRLRRLQVLDISSNRLNGPVPMELGNCMDLSVLVLTSQFDAVNLSEFNMFIGGIPESVTALPKLRMLWAPRAGFEGNIPSNWGRCHSLEMVNLAENLLSGVIPRELGQCSNLKFLNLSSNKLSGSIDNGLCPHCIAVFDVSRNELSGTIPACANKGCTPQLLDDMPSRYPSFFMSKALAQPSSGYCKSGNCSVVYHNFANNNLGGHLTSLPFSADRFGNKILYAFHVDYNNFTGSLHEILLAQCNNVEGLIVSFRDNKISGGLTEEMSTKCSAIRALDLAGNRITGVMPGNIGLLSALVKMDISRNLLEGQIPSSFKELKSLKFLSLAENNLSGTIPSCLGKLRSLEVLDLSSNSLSGKIPRNLVTLTYLTSLLLNNNKLSGNIPDIAPSASLSIFNISFNNLSGPLPLNMHSLACNSIQGNPSLQPCGLSTLANTVMKARSLAEGDVPPSDSATVDSGGGFSKIEIASITSASAIVAVLLALIILYIYTRKCASRQSRRSIRRREVTVFVDIGAPLTYETVVRATGSFNASNCIGSGGFGATYKAEIAPGVLVAIKRLAIGRFQGIQQFQAEVKTLGRCRHPNLVTLIGYHLSDSEMFLIYNFLPGGNLERFIQERAKRPIDWRMLHKIALDIARALGFLHDSCVPRILHRDVKPSNILLDNEYNAYLSDFGLARLLGNSETHATTEYAMTCRVSDKADVYSYGVVLLELISDKKALDPSFSPYGNGFNIVAWACMLLQKGRAREFFIEGSNGTSEG

SEQ ID NO: 23513 - protein, 605 aa, Burkholderia pseudomallei K96243
MYRYTEFDKAFVRNRAAQFRDQLERWRQGALSEDAFRPLRLQNGWYVQRHAPMLRVAVPYGELSSAQIRMLARIARDYDVPEPARYRAACDAQARLGTVRLPTRNAHFTTRTNVQFNWIPLEKAADVMDLLATVDMHGIQTSGNCIRNISCDERAGVAPDEIADPRPFAEVMRQWTTLHPEFAFLPRKFKIAITGAADDRAATDWHDVGLRLVRDAAGELGFRVSVGGGMGRTPMTATLVRAFVPWRHVMNYIEAIVRVYNRYGRRDNRYKARIKILVKAEGQRYIDDVDEEFRQIVEHDGGPHTIEQAEFDRVGASFVPPVPPPCAAGRHAKTDIDADMDAALARMRTLAGAQPAFARWLERNVAPHRDPARRIVTLSFKRRHQAPGDASPEQLDALAHLAERFSAGEARVTHAQNVVLPWVRAIDLHALWEAARDAGLASANVRLLTDMIACPGGDFCALANARSIPIADAIAERFDDLDELHDIGDVDLHVSGCINSCGHHHSGHIGILGVDKDGDEWYQVTLGGSDGTAANGPAQPGKVIGPSFSADEIVDVVDALVATYLRVRRTEAGRVERFIDAYRRVGPEPFKAAANAARHPETSVA

SEQ ID NO: 23514 - protein, 1076 aa, Polaromonas sp. JS666
MPKRTDIKSVLIIGAGPIIIGQACEFDYSGVQACKALREEGYKVILINSNPATIMTDPATADVTYIEPITWQTVEKIIAKERPDAILPTMGGQTALNCALDLWHHGVLEKYKVELIGAKPEAIDKAEDRLKFKEAMTKIGLGSARSGIAHSMDEAWAVQKTVGFPTVIRPSFTLGGTGGGIAYNPEEFEVICKRGLEASPTNELLIEESLLGWKEYEMEVVRDTADNCIIVCSIENLDPMGVHTGDSITVAPAQTLTDKEYQILRNASLAVLREIGVDTGGSNVQFSINPVDGRMVVIEMNPRVSRSSALASKATGFPIAKVAAKLAVGYTLDELRNEITGGATPASFEPSIDYVVTKIPRFAFEKFPTADSRLTTQMKSVGEVMAMGRTFQESFQKALRGLEVGVDGMNEKTQDREVLEKELGAPGPDRIWYVGDAFALGMSVDEVFALTRIDPWFLVQIEQIVKIELELETTSLDKIDAVTLRALKQKGFSDRRLAKQLKTTDTAIREKRRELGVRPVYKRVDTCAAEFSTNTAYMYSTYEAEGSECEAAPTDKKKIMVLGGGPNRIGQGIEFDYCCVHAALAMREDGYETIMVNCNPETVSTDYDTSDRLYFEPLTLEDVLEIVDKEKPLGVIVQYGGQTPLKLALDLEANGVPIIGTSPDMIDAAEDRERFQKLLHELKLRQPPNATARTEPEALEKAAALGYPLVVRPSYVLGGRAMEIVHEQRDLERYMREAVKVSHDSPVLLDRFLNDAIECDVDCIRDDKGVTFIGGVMEHIEQAGVHSGDSACSLPPYSLRAETVTEIKRQTAAMAQALNVVGLMNVQFAIQNIDGKDVIYVLEVNPRASRTVPFVSKATGIQLAKVAARCMVGQSLASQGVTSEVTPPYFSVKEAVFPFVKFPGVDTILGPEMKSTGEVMGVGKTFGEAFVKSQLGAGTKLPTSGKVFLTVKNNDKPRAVEVARSLAALKFELVATKGTAAAIQAAGIACTVVNKVTEGRPHVVDMIKNDEIALVINTVEERRNAIADSRQIRTSALLARVTTYTTIAGAEAAVEGMKYLDNLNVYSVQELHAQLG

SEQ ID NO: 23515 - protein, 287 aa, Oryza sativa
  misc_feature (129)..(129): Xaa can be any naturally occurring amino acid
  unsure (1)..(287): unsure at all Xaa locations
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQXDTMTAVIGRRKTESGEPSFMVEKGIVKSADKLAFIIGHEKYVKGIEGSIPVLVKSANWIDTAEEIDDLFLGDAEVWRRPSIGTAGPLGGDFPLVTKEGHHVLDVIFTTPIPDLGKVAESLEKIAGVVDHGIVSSIPSYVVVALNGEVQVLDEKSSVIP

SEQ ID NO: 23516 - protein, 631 aa, Escherichia coli O6
MSATKLTRREQRAQAQHFIDTLEGSAFPNSKRIYITATQPGVRVPMREIQLSPTLIGGSKEQPQYEENEAIPVYDTSGPYGDPQIAINVQQGLAKLRQPWIDARGDTEELTVRSSDYTKARLADDGLDELRFSGVLTPKRAKAGRRVTQLHYARQGIITPEMEFIAIRENMGRERIRSEVLRHQHPGMSFGARLPENITAEFVRDEVAAGRAIIPANINHPESEPMIIGRNFLVKVNANIGNSAVTSSIEEEVEKLVWSTRWGADTVMDLSTGRYIHETREWILRNSPVPIGTVPIYQALEKVNGIAEDLTWEVFRDTLLEQAEQGVDYFTIHAGVLLRYVPMTAKRLTGIVSRGGSIMAKWCLSHHQENFLYQHFREICEICAAYDVSLSLGDGLRPGSIQDANDEAQFAELHTLGELTKIAWEYDVQVMIEGPGHVPMQMIRRNMTEELEHCHEAPFYTLGPLTTDIAPGYDHFTSGIGAAMIGWFGCAMLCYVTPKEHLGLPNKEDVKQGLITYKIAAHAADLAKGHPGAQIRDNAMSKARFEFRWEDQFNLALDPFTARAYHDETLPQESGKVAHFCSMCGPKFCSMKISQEVRDYAAAQTIEVGMADMSENFRARGGEIYLRKEEA

SEQ ID NO: 23517 - protein, 125 aa, Dehalococcoides sp. BAV1
MSKKYFSAPGAQGPYSLAVKAGDYLYISGQIGHTDADGRPLASVESQTKRCLEKMADLLKTAGASFDDVVKTTVFLKNQEDFTKMNGVYTIFFSGAKPARSTVIAGMVFPEIMVEIEAVAYLPEA

SEQ ID NO: 23518 - protein, 438 aa, Gibberella zeae PH-1
MASIDRYRPPREGYQPPTLPTGSRPERDSRSRSPRRRDAVPPAVPTPPQHSTRTSPPRPQARQPQSPARSGAQTPVAGSNQWAFTSDEVRSTPSILEGITPADERMRRAKGVNFIYQAGVMLDLPQITLWVAGVFFHRFYMRCHMVQEKGGIHHYNIAATALFLANKVEENCRKTKDIIIAVAKVAQKNSKLIIDEQSKEYWRWRDSILTYEEVMLEQLTFDLMVDNPYRHLFELLGKLDIVHNKHLRQAAWAFCNDACLTSIPLLIEARDVAISAIFFASVHTSQQIDDIGGKPWWKHLKGDEVLCSQAIEVMRQFYTENPLRKQNPSLPSPAFHLENTRRRGDTLLSQPDTLSSTTGTPLEADRASRSPGVNSRVNGASKDSEGRHLGSQSKLDENEVASKSPLKRREPDDGDTKSDRAEKRAKLSEDEEGELVED

SEQ ID NO: 23519 - protein, 282 aa, Glycine max
  misc_feature (126)..(126): Xaa can be any naturally occurring amino acid
  unsure (1)..(282): unsure at all Xaa locations
GLFEGLKAYRKQDGSILLFRPEENGLRMQIGAERMCMPSPTVEQFVEAVKETVLANKRWVPPAGKGSLYIRPLLMGSGPVLGLAPAPEYTFLIYVSPVGNYFKEGLAPINMIVENELHRATPAGTXCVKTIVDYAAVLKAQSEAKAKGYSDVLYLDCVHKRYLEEVSSCNIFVVKGNVISTPAIKGTILPGITRKSIIDVARSQGFQVEERLVSVDELLDADEVFCTGTAVVVSPVGSITYLDKRVAYGDGIGVVAQQLYTVLTRLQMGLTEDEMNWTVELR

SEQ ID NO: 23520 - protein, 338 aa, Burkholderia pseudomallei K96243
MSITRRTTLSKYLIEQQRETHNLPADLRLLIEVVARACKAISYNVSKGALGDALGTAGSENVQGEVQKKLDILSNEILLDANEWGGNLAAMASEEMETFFPIPANYPRGEYLLVFDPLDGSSNIDVNVSIGTIFSVLRCPDGQQATEQSFLQPGTEQVAAGYAVYGPQTVFVLTTGNGVNCFTLDREVGSWVLTQSNLRIPEDTREYAINASNARHWYEPVKRYIDELNAGAEGPRGENFNMRWIASMVADVHRILNRGGIFMYPADKRTPDRPGKLRLMYEANPMSFIVEQAGGAATTGLKRILDVQPTGLHQRVPVILGSKNEVERVARYHEQAQS

SEQ ID NO: 23521 - protein, 537 aa, Neurospora crassa
MTLLALKEDRPTPKAVYNWRVYTCAAIASFASCMIGYDSAFIGTTLALPSFTKEFDFASYTPGALALLQSNIVSVYQAGAFFGCLFAYATSYFLGRRKSLIAFSVVFIIGAAIMLAADGQGRGIDPIIAGRVLAGIGVGGASNMVPIYISELAPPAVRGRLVGIYELGWQIGGLVGFWINYGVNTTMAPTRSQWLIPFAVQLIPAGLLFLGSFWIPESPRWLYANGKREEAMKVLCWIRNLEPTDRYIVQEVSFIDADLERYTRQVGNGFWKPFLSLKQRKVQWRFFLGGMLFFWQNGSGINAINYYSPTVFRSIGITGTDTGFLTTGIFGVVKMVLTIIWLLWLVDLVGRRRILFIGAAGGSLCMWFIGAYIKIADPGSNKAEDAKLTSGGIAAIFFFYLWTAFYTPSWNGTPWVINSEMFDQNTRSLGQASAAANNWFWNFIISRFTPQMFIKMEYGVYFFFASLMLLSIVFIYFFLPVTKSIPLEAMDRLFEIKPVQNANKNLMAELNFDRNPEREESSSLDDKDRVTQTENAV

SEQ ID NO: 23522 - protein, 1136 aa, Frankia sp. EAN1pec
MPRREDLRSVLVIGSGPIVIGQACEFDYSGTQACRVLRAEGLRVILVNSNPATIMTDPEIADATYVEPITPDIVTKIIERERPDAILATMGGQTALNTAVALHDAGVLERFGVRLIGANIDAIRSGEDRQAFKDIVASVDGETARSAICTTVAECLVAAEEFSYPVVVRPSYTLGGAGSGFAHDPDELRRMSADGLAASPTTEVLVEESVLGWKEFELELMRDRADNVVVVCSIENIDPMGVHTGDSVTVAPAMTLTDREYQRMRDMSIAVMRAVGVDAGGCNIQFAVDPATGRLVVIEMNPRVSRSSALASKATGFPIAKISAKLALGYTLDEIPNDITRTTPAAFEPTLDYVVVKVPRFAFEKFPGADTMLTTTMKSVGEAMGVGRSFAEALQKALRSMEQSGLAFTFDPPGRSAAELLDAARTPHDGRLHTVQQALLAGATPAEVTDATGIDPWFVDQIVFINEIAASLVRNPDGIRRAKRAGFSDAQLAGLLGTKEDVVRSFRHRAGIRPVYKTVDTCAAEFASATPYHYSSYDSETEVAPSEKPRVIVLGSGPNRIGQGIEFDYACCHAVMALSEPGYETVMVNCNPETVSTDYDTADRLYVEPLTVEDVLEVVHAESQAGPLAGVIVSLGGQTPLGIAAALADAGVPLVGTPPKAIHLAEDRGQFGQVLAAAGLPSPPHGVATSYAEARTVADRIGYPVLVRPSYVLGGRGMEIVYDDPMLRDYIERATQISPEHPVLVDRFLDDAVEIDVDALYDGSELYLAGVMEHIEEAGVHSGDSACALPPITLGRSELDRIRESTRLIAEGVGVRGLLNVQYALQSDVLYVLEANPRASRTVPFVSKATAVPLAKAAARVMLGATVPELRAEGLLPEYGDGATLPLDSHISVKEAVLPFGRFRDAGGRGVDTVLGPEMRSTGEVMGIDDGFGTAYAKSQAAAYASLPTYGRVFVSVANRDKRAMIFPIKRLADLGFVVYATEGTADVLRRNGVKAVVLGKHRAPSENLIDCVEMIMSGQIDLVINTPWGVGPRLDGYEIRTACVSAGVPCITTIQGAAACVQGIESLVRGELGVRPLQEYHAALRSTWGTTPEGLPGATSGSGSRAPGARPGPAPGAGSGSGSAGGAPASTVADR

SEQ ID NO: 23523 - protein, 775 aa, delta proteobacterium MLMS-1
MVKRVRTAIIVMGFSGLVAEILLLRELLIVFAGNELSIGIILANWLILEAFGCYFAGGRAAESPRRVEVFTVITILFSLFLVAAVVATRLLKEMLGVSIGENVGFLPMFYSSFLILLPVSVLHGALFTSGCRIYADCAPAAGPDASPAGRVYVYETVGTIIGGIACTYLLIPYLDAMHTTAWLALLNFVVCLALLAPHRRRRRLTGMVAAALGGLILLTGTLLATGQVERLHWYTVAGQWQNLNVVEYRNSPYGNICVIENEGQYIYFLDGIATILTPIPDIPFVEEFVNVPLLTHRQPEKILILSGGAGGIINEALKHPSLAAVEYAEQDPLLFELLRKFPTELTESELDDPRVKIHHTDGRLLLQTTPRQYDLIFIGILEPSSLQTNRYFTREFFTLARERLNPGGILVFGLPGSMTYLNDELKNLNSSVFHTVKSVFPHVRVIPGDGHNLFLSSDAPDVAAVDAHQIMARLTEREIRAEAMLPWHIEKKLHPGWQEWFYEFIEESSRQLNRDFTPLGVFYSISHWNALYSPEFGRFFNKLERADLKGAALVPLLLLAAYLLLRAGVKRAVRPGIPLAIATTGFAGMISSLVLIFTFQAFYGYLFSWIGLLVAAFMAGAAAGAQLVTSALGRIQDHRQLFKRIELAIVVFSLLLPLGLLAANTWVASVAAFDLLRVLFLVVSLVAGFLLGAQFPLANKLYLGDNAHLSRTAALLYTADLLGGWLGGIVGAVVLLPVLGLVGTCLVMGLLKAVSFVIISFEFSDLVTVHQGRQP

SEQ ID NO: 23524 - protein, 477 aa, Arabidopsis thaliana
MKAICDRFVPSKCSSSSTSEKRDISSPTSLVSDSASSDNKSNLTLCSDVVASSSPVSQLCREASTSGHNPVCTTHSSWTVILKTASMASGAIRRFQDRVLGPSRTGISSSTSEIWLLGVCYKISEGESSEEADAGRVLAAFRQDFSSLILMTYRRGFEPIGDTTYTSDVNWGCMLRSGQMLFAQALLFQRLGRSWRKKDSEPADEKYLEILELFGDTEASAFSIHNLILAGESYGLAAGSWVGPYAVCRSWESLARKNKEETDDKHKSFSMAVHIVSGSEDGERGGAPILCIEDVTKTCLEFSEGETEWPPILLLVPLVLGLDRVNPRYIPSLIATFTFPQSLGILGGKPGASTYIVGVQEDKGFYLDPHDVQQVVTVKKENQDVDTSSYHCNTLRYVPLESLDPSLALGFYCQHKDDFDDFCIRATKLAGDSNGAPLFTVTQSHRRNDCGIAETSSSTETSTEISGEEHEDDWQLL

SEQ ID NO: 23525 - protein, 210 aa, Cyanidium caldarium
AAGGISEMSELPLSVHDTTDKLDALGNTTAAKGKDFYNGSVCGKCLALLVALVFEFGLAPVGLSKLCKSPQTSSHVIELDVILQLTDIYVVASMLVGIMLPHLFGALTMLGVSRAAQAMIVEVRRQFREIPGLREGGPGVSPEHQSSAIQIATKSAIIEMVLPGALAILSPLIIGFGFGQKALIAMLLAAIGSGYHDGIISNAGGAWDNA

SEQ ID NO: 23526 - protein, 105 aa, Zea mays
  misc_feature (37)..(37): Xaa can be any naturally occurring amino acid
  misc_feature (68)..(68): Xaa can be any naturally occurring amino acid
  unsure (1)..(105): unsure at all Xaa locations
MSGRGKGGKGLGKGGAKRHRKVLRDNIQGITKPAIRXRLARRGGIKRISGLIYEETRGVLKIFLENVXIRDAVTYTEHARRKTVTALDVVYALKRQGRTLYGFGG

SEQ ID NO: 23527 - protein, 381 aa, Mycobacterium sp. MCS
MAHSSHADVIVIGLGGMGSAAAYHLASRGQRVLGLERFTPAHDKGSSHGGSRIIRQSYFEDPAYVPLLLRAYDLWDRLATDSAREVYRMTGGLFIGPPNCLTVAGSLRASRQWGLPHEVLDADEIRRRYPNFTPREGDVALYEANAGFARPEMTVQAHLDLAEHAGATLRFGEEVTGWTATADGVRVTTPAGTYRAGQLVICPGAWAPQLLAEFGIPITVERQVLYWLDPVGGTEPFVDHPIFIAENERAEQIYGFPAIDGPHGGVKVAFFRKGVECTPDTIDRVVHEREIREMRDEAARLLPALDGPCVHSATCMYSNTPDQHFVIARHPDSVNVTVACGFSGHGFKFVPVVGEILADLATTGATDHPIGLFDPRRLVHA

SEQ ID NO: 23528 - protein, 354 aa, Oryza sativa (japonica cultivar-group)
MARRAASWPRLLLLSRAFAAAAAEPEAGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQEGIPGQGLLSKHKVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVPVTCE

SEQ ID NO: 23529 - protein, 442 aa, Zea mays
MDFSGGGGGGRSRAEPARWLEIARKLLAARDLVGCKRLAERAVEADPYLPGADELLAVADVLLASQRLLPSGRPDPVGVLQLQPAPGLDPAAAKRSFHRLSQLVSSPRNPRPAADTALHFIQEAFADLSSNASADPPPAPAPAAAPVPVPAPAPAAPPAPVPAPAAAPSLIPAPAPVSGDALASADGNAFWTVCPYCCHVYQYQRALVGRALRCQSAGCRRAFEATEIPNAPPIVPGTDMYYCAWGFFPMGFPKAADLSTNWRPFCPMFPGNSESPLQPAPAVTVNVDVQNLENNGGTDVQNVENNGIDDNSTPASVQPPGKSGDIDRAAGPSRGRMKKTTARKKVGAVSKKHSSSGVDSGIEPSMLGADSLNGNAGSGQTVGTREININEVAMPTDSATMLNFGGDEDIRFDLDVDATDAILGNLHNLPFLREDGNNRRMF

SEQ ID NO: 23530 - protein, 176 aa, Oryza sativa (japonica cultivar-group)
MSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 23531 - protein, 580 aa, Corynebacterium efficiens
MTPTQNEIHPKHSYSPIRKHGLEVPETEIALDDSPSGPNEPFRIYRTRGPETDPTLGLPRLRTPWITARGDVTEYTGRERLLIDDGRSAMRRGQASAEWKGQKPAPLKALPGKRVTQMAYARAGEITREMEFVALREHVDPEFVRSEVARGRAIIPNNVNHPESEPMIIGRKFLTKINANIGNSAVTSSIEEEVSKLQWATRWGADTVMDLSTGDDIHTTREWIIRNSPVPIGTVPIYQALEKVNGVAADLSWEVFRDTVIEQCEQGVDYMTIHAGVLLAYIPLTTRRVTGIVSRGGSIMAGWCLAHHRESFLFEHFDELCEIFAQYDVAFSLGDGLRPGSLADANDAAQFAELKTIGELTQRAWEYDVQVMVEGPGHVPLNMIQENNELEQKWAADAPFYTLGPLVTDIAPGYDHITSAIGAAHIAMGGTAMLCYVTPKEHLGLPNRNDVKTGVITYKLAAHAADVAKGHPGARAWDDAMSKARFEFRWNDQFALSLDPDTAIAYHDETLPAEPAKTAHFCSMCGPKFCSMRISQDIRDMFGEQIAELGMPGVGASDSTEGMKEKSREFVAGGGEVYRE

SEQ ID NO: 23532 - protein, 375 aa, Methanococcus maripaludis S2
MNVVPIGPIHPILKEPLRIKLLVEGENVKGAEIDMGYVHRGIERIMEGKHYLKCIHLSERVCGICSYIHTQSFAECIENMCDIEVPEKAKYLRVITCELERIHSHLIAAAVYNLTIEHETLGIWMLNVRESIMDLLELITGNRVNMGFNVVGGVRLDLNKEILDKIHKKIDEFEEDVKNIIEVFETGPLIGMRSKHIGKIGYKEIMKTRAAGPVARASGIPESDWRIRHETYKALNFKPDWRNEGDNYARMMVRHDEVLTSVELIRRALEHYAESSGIVRNKAEIRATEGEWYNEAHRGEVYYKIAITDGGLIKRIIIRTPTVMNLEAYKYMIKDCPTIADAVATYTSIDPCVSCTERTIQLKDLNTGKLSDYKI

SEQ ID NO: 23533 - protein, 506 aa, Candida tropicalis
MIEQVLHYWYYVLPAFIIHWIVSAIHTNSLRRKLGAKPFTHTQLDGFYGFKFGRDFLKAKRIGRQVDLINSRFPDDIDTFSSYTFGNHVIFTRDPENIKALLATQFNDFSLGGRIKFFKPLLGYGIFTLDGEGWKHSRAMLRPQFAREQLPMSPSLEPHFNVKAYPQEQRWVFDIQELFFRFTVDSATEFLFGESVNSLKSASIGCDEETELEERKKFAEAFNKAQEYISTRVALQQLYWFVNNSEFKECNEIVHKFTNYYVQKALDATPEELEKQSGYVFLYELVKQTRDPNVLRDHHSISLLAGRDTTAGLLSFAVFELARNPHIWAKLREDVESQFGLGEESRIEEITFESLKRCEYLKAVMNETLRLHPSVPRNARFALKDTTLPRGGGPDGKDPILVRKMSCSIFISGTQIDPKHYGKDAKLFRPERWFESSTRNLGWAYLPFNGGPRICLGQQFALTEAGYILVRLAQSFDTLELKPDTEYLTKISHLTMCLFGAFVKMD

SEQ ID NO: 23534 - protein, 205 aa, Oryza sativa (indica cultivar-group)
MVRVSVLNDALKTMYNAEKRGKRQVMIRPSSKVIIKFLIVMQKHGYIGEFEFVDDHRSGKIVVELNGRLNKCGVISPRFDVGVKEIESWTARLLPSRQFGYIVLTTSAGIMDHEEARRKNVGGKELEQCHERSDWRRSMKGSSGNRMRLGGFGHLVWGYEEDEVGEANGAELGEKAGKVGWQHVGEMGVECGHEEEVLTDKWVGG

SEQ ID NO: 23535 - protein, 216 aa, Ralstonia metallidurans CH34
MKDLIQGILKFQREEFPKRSALFKHLATQQNPKTLFIACSDSRVVPALLTQCEPGELFVIRNAGNIVPAYAVQPGGVSASVEYAVAGLKVRDIVICGHSDCGAMTAVATCQCLDHMPAVEEWLEHASGARRISLTRPHASDRARVDDMVRENVIEQLDHLRTHPSVAQALAEGRVDLHGWVYDIETGEIDALEGRTGKFVPLREQPDVTATLERVA

SEQ ID NO: 23536 - protein, 277 aa, Schizosaccharomyces pombe
MLVSSNEEQLTAHTPTSSSSIEPKILAACSYSLSVGPCSLAVSPKGVNSKSPSLKNETAFVVDSVSTLSAESSALLYNTQSSLLTGLSMNGYLGEYQEDIIHHLITREKNFLLNVHLSNQQPELRWSMRPALVNFIVEIHNGFDLSIDTLPLSISLMDSYVSRRVVYCKHIQLVACVCLWIASKFHETEDRVPLLQELKLACKNIYAEDLFIRMERHILDTLDWDISIPTPASYIPVLDPIFFLVLDASMFVPNLFKFPASKIACSVMNIVNEHVGS

SEQ ID NO: 23537 - protein, 280 aa, Oryza sativa (japonica cultivar-group)
DAWVLNESMGEGDAAYAKRVLLTAAGDDVSRGIASTLATHGCRLVLVGDEGALAGTAEEARRGGGGGDAVAVVGLDLHGCDEAAVDAAVGTAWRCFDGLDAMVNCYSYEGEVQDCLNISEDEFKKTMKANVMTPWFLVKAIAKRLRDSESSCGGSVVFLTQIIGAERGLYPGAAAYGTSLGAIHQLVRLSAMELGKHKMRVNAVCRGLHLGDRFPVWVGKEKAEKATGEVMPLRRWLDPEKDVASTVLYLVGDESRYMTGSTIFVDGAQSIVRPRMRSFM

SEQ ID NO: 23538 - protein, 209 aa, Micromonas pusilla
AGGISEMAVLPEDVRKQTDALDAVANTTKASTKGYAMGYAGLGALVLLAAYTQDLSFLAATSEPYPYFAGGVSDFSLSNPYVVVGLFVGGLLPYLFGSMGMMAVARAAGAIVEEVRRQFKEKPGIMQGTEKPDYGAAVDLLTKAAIKEMIIPMPCLPVLSPVVLYFHQSMAVADKYRGLLQQLGAMLLGVIITGLHVALSASGGAWDNA

SEQ ID NO: 23539 - protein, 70 aa, Triticum aestivum
MAFLVTSLIFAVVGIIASIFTRICFNQGPSTNLLHFTLVITATVCCWMMWAIVYIAQMKPLIVPILSEVE

SEQ ID NO: 23540 - protein, 430 aa, Triticum aestivum
  misc_feature (238)..(238): Xaa can be any naturally occurring amino acid
  misc_feature (275)..(275): Xaa can be any naturally occurring amino acid
  misc_feature (310)..(310): Xaa can be any naturally occurring amino acid
  misc_feature (323)..(323): Xaa can be any naturally occurring amino acid
  unsure (1)..(430): unsure at all Xaa locations
NKFVQKSRLVPVRNSRDIVDPRVRSPYPVIITLEDHLTPELQDKVAKMVLEVFGDILYYPQEEHPKELPSPEFLKGRVLLSTKPPKEYLEAKDGGAVKDGDAEQNPGKGTDDDAAWGTEVPDFKTEIQSAKQEDDASENRRDGDEDDDDEDEQKMQQHLAPQYKRLITIRAGKPKGGTTSDALKCDPNKVRRLSLSEQQLAKAVVNHGTEIVRFTQRNLLRIYPKGTRVTSSNYNPFXLGWVHGAQMVAFNMQGYGRALWLMHGFYKANGGCGYXVKKPDFLMQSEPEVFDPKKPQPGKRTLKVKVYMGXDGWRMDFKQTHFXQDSPPDFYARVGIAGVPADSVMRKTKAVEDNWVPVWGEEFSFGLTVPELALLRVEAHEYDMSEKDDFAGQTVLPVSELQPGIRAVALFDRKGNKFPNVKLLMRFEFV

SEQ ID NO: 23541 - protein, 193 aa, Picochlorum maculatum
AGGISEMALQDYPEVSEKTDALDAAGNTTAAIGKGFAIGSAALVSLALYGTFAVRIGIRNGVNILSPVTFAFLLIGSNLPYWFSALTMKSVGTAAMQMVMEVERQFREQPQLLNEGTTLPPDYTRCVDISTKAALKEMVPSRPPLVMGATRMIPGIVSFFNVAREAGVLTVGLVSGVQLAVSMSNTGGAWDNA

SEQ ID NO: 23542 - protein, 611 aa, Oryza sativa
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKAISDLSISEPKRESMSQCENIIGDGNDTCGLSCMNAFLCTYHCEANASLSVKKKPELALTRLEEDDTTYRQICAGAAAVRAMEEGRGGDPPSSSSSAAAAAGVAIGYPFLEPQQGARLRRRRTISPFKKYFSRGFAIGMEIAFIVFGTIVHFPVWARIFLIISLSILPFSAFSITFQEY

SEQ ID NO: 23543 - protein, 202 aa, Picochlorum maculatum
AGGIFEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFREVGAITDRSLLGAEVLAGYLMFGTETGIMMALFLTAGGAWDNA

SEQ ID NO: 23544 - protein, 189 aa, Nannochloropsis gaditana
AGGLAEMALQDYPEFREKTDALDAAGNTTAAIGKGIAIGSAALVSLALYGAFAVSIGIRNGVNILSPVTFAFLMIGSNLPYWFSALTIKSVGTAAMQMVMEVERQFREQPQLLNEGTTLRPDYTRCVDISTKAALKEMVPPTALVMLSPLIAGTFFGKYAVAGVLTVGLVSGVQLAVSMSNTGGAWDNA

SEQ ID NO: 23545 - protein, 356 aa, Ustilago maydis 521
MLTMLWAAPLCASSSPTRITNREWSSTPTKHGSVINIGNCLHHNAQSDHSLESTCSLLLLIHSHLSNMDRLDQPLSSSTAGSRTSGASSRYSPYNRTPRYSAADSEASWKHDRYQPDADAALRPDVRNGSSRAPLFFPADKAETNDVKPTGKLIIENLHYDVSESDLKNLFESIGPVTKAYIRYDRSDRSTGVAVVVYDNPNHALQAKAQFDGAKAKGQVISITQEMRAERLKGAHASQRTLLSRFNLSSRIKDGAEAGSRVHAAGASSSFADRLGPVQRGGRHGEQRNSTRSSRAQLGARSQNGAAKREKRKPVTAADLDAELEAFMKTPSSNINSTAEPQPTPTSSNAQDVDMS

SEQ ID NO: 23546 - protein, 523 aa, Polaromonas sp. JS666
MHHLMHHSMQKITNAVSQPLYSVAATRELELHAAAGLPPHTLMQRAGLAVARLALALAPHARRIWIACGPGNNGGDGFEAALHLHQWGKTVVVTWTGLPPGKTSLPADADASRQRALAAGVPMSAQPPEDFDFCIDALLGIGARLEPARAGTGSMQQWLDAMQASAAPRLAVDVPTGLDADTGTTNAAKPIAHGSRFTTENDLFTLSLLTLKPGLFTASGRDLAGQVWFDDLGVAANPSLATVPDAWLLGADRVARSARAGAAHASHKGSFGDVAVVGGESASGRHMTGAALLAARAALHAGAGRVYVALLTGVGEASLNVDPAQPELMFRSPEALNLKQQVVVCGCGGGEAVKTVLPKILSAAPRVVLDADALNAIAADPQLQTQLKARHYRGLGTVLTPHPLEAARLLGTTTPDVQADRLATARQLASRFQCVVVLKGSGSVIAVPGQPPCINASGNALLATPGTGDVLAGMIGAAMAGGQGPFEAACSAVFAHGNLADAWATRQPGVTLTASTLAGNARC

SEQ ID NO: 23547 - protein, 499 aa, marine gamma proteobacterium HTCC2143
MLFLPDKFLEKRMSLLLKDPSLLATGAYINGEWIQADSGETLAVTNPSTGEIIAEVAKCGAAETRRAIEAAYRVQKQWKLTTAKERAALLRGWFNLIMDNQDDLAEILTAEQGKPLQEAKGEIAYGANYIEWFAEEAKRIYGDTIPQPSNDKRLIVIKQPIGVVGAITPWNFPCAMLTRKIAPALAAGCTVVCKPANATPLSAYALAVLAERAGIPAGVIHVITGKTAEIGSEITGSELIRKVTFTGSTPVGKQLMKECADTVKRTSMELGGNAPFIVFDDADIDEAVAGAMASKYRNAGQTCVCSNRLLVQDAVYDEFAKKLLAAVNALVLGDGTGEGVTVGPLIDQKAARDVCEMIDDAVASGAEVMVGGGASSLGGSFVEPTILTNVSRDMRVFKEEIFGPVAPLIRFSSEEEALELANDTEVGLASYIYTRDIGRIWRVSEGLEYGIVGVNEGIISNEMAPFGGVKESGNGREGSKYGLEDYLEIKYLCLGGIDR

SEQ ID NO: 23548 - protein, 456 aa, Streptococcus thermophilus LMG 18311
MKGNIDMTTGKEYVASVFEKVKAQNSHEAEFLQAVEEVFNSLVPVFDKYPKYIEENLLERLVEPERIVSFRVPWVDDKGQVQVNRGFRVQFSSAIGPYKGGLRFHPSVNQSIIKFLGFEQIFKNSLTGQPIGGGKGGSNFDPKGKSDNEIMRFCQSFMTELSKHIGADTDVPAGDIGVGGREIGYLYGQYKRIRNEYTGVLTGKGLNWGGSLARTEATGYGAVYFAEQMLNARGENFNGKTAVVSGAGNVAIYAIEKLQSLGAKAVTCSDSSGFVYDPDGIDVDLLKEIKEVKRERIVKYAEARPNATFTPAGGEKTVWSIKADLAFPCATQNELDETDAETLVANGVLAVSEGANMPSTLGAIDVFLKAGVSFGPAKAANAGGVAVSALEMAQNSGRTSWTFDEVDAKLYDIMKGIYENAAAAAKEFGQEGNLVVGANIAGFLKVADAMSAQGIV

SEQ ID NO: 23549 - protein, 414 aa, marine gamma proteobacterium HTCC2143
MTQQYSLQRTLGFSTVTFYGVGAILGAGIYVLIGEVAGLAGYAAPLSFIVAAVIAIFSAFSYAELSARFPKSAGEAVYIEQAFGCKWLTITVGLLVILTGIVSAATMTTGIVGYAQVFVTLPSFALITVFVIAISSIAIWGIKQSAWLVTAITVLEVAGLLYVVYVASDNLTSLSIPPLPAGADMDSSVATGILLGSFLAFYAYIGFEDMVNIAEEIKQPEKVLPVAIVLALVIATLLYMLVAYTALSVLSPAQLSASKAPLADVVISKGYSGSWISLISLVAVINGAIIQIIMASRVIYGMASRELFPVWLASVNRVTSTPIPATLLCAAAVLILALLFPLSTLAQLTSLIVLSVFVLVNVALIRLNRRFLAGAKESKDTGHKTVNFPRWIPYIGALLCVGMLLVKAIFWWSL

SEQ ID NO: 23550 - protein, 145 aa, Zea mays
MMRGVGGPLLTIGDLLSDLAVDDPLVGVGDASVPSSPSAAQQAGRANPSDLSRLFEEHYDDLMKALQEKDPSWPSLMLKLCAALKTADRLMSCADTNAEQLLEKVKALEGVLDRSGHAVAEIVEALQRSGLANDGHGSPSKSASK

SEQ ID NO: 23551 - protein, 439 aa, Silene latifolia
MAFLPIIFILSSLLKFSNAQRVDRIGINYGKQGSNLPTPYQSIDTIANMKAGMVRLYDTDSETLRLVAGTSLHVVITVSNDDIVDLARKESLASKWVHDNIFAYYPRTMIRYIMVGNEVYSNRVVVPDQWDNLVLAMTHIMKVLKSHEIHNIKVGTPLGMDILSATFPPSNGTFKVDTLTTMVPLLQLLHRSNSYFCLNVYPYFPWSKDTTHMNLNFTLFEGGNLTYKDPYSGLVYNNVLDQMLDSVYSAMSKIGFPNVPIAISETGWPSKGDLDQPGANVYNAATYNRNLIKKIVAEPPLGTPARPGTIIPAFLFSLYDENLKDGPETERHWGLVKPNGTPVYQIDLTGTQTEFDPLPNATNNMPYKGEVWCVVQRSANMTELGSMVTNLCSRLNGTCEAAIGPGNDCYQPVSILWHASYTFSAYWAQFRRHGTYCQF

SEQ ID NO: 23552 - protein, 173 aa, Glycine max
  misc_feature (97)..(97): Xaa can be any naturally occurring amino acid
  unsure (1)..(173): unsure at all Xaa locations
MGGVSLRESWCFCKGVSKSERMKAAIFTGKAQAMATIAATAAPNGASGTGFLIHRNLLLTTHANLPSVVAADTAEIRLHNGVAATLAPQRYFITSSXFYLTILRVDDGDGDSNAQGQCPHYLKTSCKANLDLGSAVYLLGYTEKQELTVGEGKVVIATDNLIKLSTDGIQWSP

SEQ ID NO: 23553 - protein, 167 aa, Jasminum nudiflorum
MFPMVTEFMNYGQQTIRAARYIGQGFMITLSHANRLPVTIQYPYEKLITSERFRGRIHFEFDKCIACEVCVRVCPIDLPVVDWKLETDIRKKRLLNYSIDFGICIFCGNCVEYCPTNCLSMTEEYELSTYNRHELNYNQIALGRLPVSIIDDYTIRTISSSPQIKNG

SEQ ID NO: 23554 - protein, 526 aa, Triticum aestivum
MGCCGSSLRSWVHAEKPPGPRRPAPPPPPPHRPSFSLKAQKAASPPPAARGEEEDVPALAEFSLAELRAATDGFAAGNIVSESGEKAPNLVYRGRLRGASGGAAPRAIAVKKFAKHAWPDPKQFAEEAKGVGKLRHRRLANLIGYCCDGDERLLVAEFMSNDTLAKHLFHWENQTIEWAMRLRVAYYIAEALGYCSNEERSLYHDLNAYRVLFDENGDPRLSCFGLMKNSRDGKSYSTNLAYTPPEYLRNGRVTAESVIFSFGTVLLDLLSGKRIPPSHALDMIRSRNIQALMDSHLEGNYSTEEATTLVNLASQCLQYEPRDRPDIKKLVSILEPLQTKSEVPSYVMLGVPKPDEPSKAPPSPTPQPQHPLSPMGEACSRMDLTAIHQILVSMHYRDDEGSNELSFQEWTQQMRDMLDARKQGDFAFRDKDFKAAIDCYTQFVDVGTMVSPTVYARRSLCHLMCDQPDAALRDAMQAQCVYPDWPTAFYMQAVALSKLDMQSDATDMLNEASQLEEKRQKSARGP

SEQ ID NO: 23555 - protein, 443 aa, Dehalococcoides sp. BAV1
MTRAESVEYVLKTAKDHNVRFIRLWFTDILGSLKSFSIAYNELERALEDGMGFDGSSIEGYARIDESDMVALPDPDTFKIIPWSNGDYQVGRMFCDIKKPSGEQFEGDPRYVLKRNLKKAAEMGFTFYIGPELEYFYFKNDHSTEFLDEGGYFDLTPRDLATDLRRETIVALQDMGIIVEYAHHEVAPSQHEIDIRYTDALTMADNVMTYRLLVKEVAMRHGLHASFMPKPVGSVNGSGMHTHQSLFKGDRNAFFDAKDSYYLSTMAKQYIAGILKYAPEFTSVTNQWINSYKRLVPGFEAPVYLSWARRNRADLVRVPEYKPGHEKSTRIELRSADPGCNPYLAFSVMLAAGLKGIEEKLTPPAPIEENVYEMNEAERAKRGIGTLPGSLLEALKLTEGSSLVREALGDHVFDAFVANKKIEWSQYSIAVTDWELKRYLPVL

SEQ ID NO: 23556 - protein, 393 aa, Jasminum nudiflorum
MIAPTTRKDLMIINMGPHHPSMHGVLRLIITLDGEDVIDCEPILGYLHRGMEKIAENRTILQYLPYVTRWDYLATMFTEAISVNGPEQLGNIQVPKRASYIRTIMLELSRIASHLLWLGPFMADIGAQTPFFYIFREREFIYDLFEAATGMRMMHNFFRIGGIAADLPHGWIDKCLDFCDYFLRGVVEYQKLITRNPIFLERVEGVGIIGAEEALNWGLSGPMLRASGIQWDLRKMDHYECYDEFDWEVQWQKEGDSLARYLVRISEMTESIKIIQQALERIPGGPFENLEIRRFDRIKDTEWNDFEYRFISKKPSPTFELSKQELYVRVEAPKGELGIFLIGDQSVFPWRWKIRPPGFINLQILSQLVKRMKLADIMTILGSIDIIMGEVDR

SEQ ID NO: 23557 - protein, 194 aa, Triticum aestivum
  misc_feature (17)..(17): Xaa can be any naturally occurring amino acid
  unsure (1)..(194): unsure at all Xaa locations
MPPTGMASSATSVVPFXGLKSTPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESAQAYTAHSRQAIYKVPLQFCQL

SEQ ID NO: 23558 - protein, 170 aa, Synechococcus sp. CC9605
MLTTAALVATLGVTTAPGIAQTSSDNRVLAQSQGGFNPTAVRSILAEGDAAASRGDLAEARADYDKARKASKQLLAFYRDLSGAFRGLDARIPREMDTKGREALELLAETNLRLAALFRRQNQPEVAVPVLVEVVKLMTPAKPQGQKAYQSLLELGFVETEFRGASPAGR

SEQ ID NO: 23559 - protein, 789 aa, Burkholderia pseudomallei K96243
MSTTPSSASSEAGHAEATASSHARQYIDAVLEQSFRHLFGPTATPEQPRKHGVVSIAKLTAALADYLGAEEIKEVKAAFHFSDEAHLGQYRQSGEPYITHPVAVAEICAGWKLDAQAIMAALLHDVMEDQGVTKSELAERFGPKVAELVDGLSKLDKMEFRSREEAQAENFRKMLLAMARDVRVILVKLADRLHNMRTLGAVPMEKRRRVARETLDIYAPIAHRLGLNNTYRELQDMSFANFNPHRYATLEKAVKAARGNRREVIGKILESVQRAMADAKIDAEITGREKTIYSIYKKMRDKQLSFSQVLDVYGFRIVVEHPLDCYTCIGVLHALYKPVPGKFKDYIAIPKVNGYQSLHTTLVGPFGAPIEFQVRTRKMHEIAEAGVAAHWLYKNGGADLNDVQKRAHQWLKSLLDIQSEAGDSSEFLEHVKIDLFPDAVYVFTPKSKIMALPRGATALDFAYSIHSDLGNQCVAVKINNELLPLRTELKSGDIVEVITAPYSKPNPAWLGFVRTGKARSAIRHYLKTMRLNESVQLGERLVDQSLKGYGLALADVTPEVWEKLVQWTGNKSRQEIFADIGLGRRVAAVMAKRIEVLMSGRDADDDLPRAERHAANHAPPVVITGTEGMSVQLSACCRPIPGDDIMGYIGIGLGMAIHTTACRVAQRIHRRDPGRWIDVAWAPQPGRLFDVAVKALVKNTKGIFARVAADITSADANIVHIAMDEDLTHESTVLRFVIQVSDRVHLANVMRRVRTNPDVMRIMRERSNDDVVHARHDGGMRIDRERQDY

SEQ ID NO: 23560 - protein, 107 aa, Synechococcus sp. CC9605
MDPSTKARIETLVASSPIFVFMKGSKLMPQCGFSNNVVQILHSLGVTFETFDVLSDPEIRQGIKEFSSWPTIPQVYVKGEFIGGSDILIEMYNSGELREKLEIALAS

SEQ ID NO: 23561 - protein, 212 aa, Ashbya gossypii ATCC 10895
MSFRGNSRGGRGGARGGSRGGRGGFGGRQFQQGPPDSVVEMGAFMHDCEGDIVCRSINTKIPYFNAMIYLENKTEVGKVDEILGPLNEVFFTIKCAEGVKASSFKDGDKFYISPEKLLPIERFIPKPKVAGPPKPKRKRAAGGAPGRGGFGGRGGSRGGFGGRGGARGGFGGRGGARGGFGGFGGRGGSRGGFGGRGGARGGSRGGRGGKRF

SEQ ID NO: 23562 - protein, 358 aa, Ashbya gossypii ATCC 10895
MAATRRSANCLQQLRSYGIDVKQLVLNTKVNVPSKEATVKPSKVPVTLSKPIPKATTSISMQLFEEYNPGIVLPKAADMSLISRFFNSSKVKFEWCAREYLEIPGERYKIEQAQLQQQELLDEKSFNESLDIREPTEAYRVSADIKNRPIPNTEQLTRGSFLLHDELPEIIFLGRSNAGKSTLLNNLTTNFKQVQLNRHATTSKKAGHTRALYCYNVGNRLRLVDSPGYGVMSTQQQGECTMQYIRERKQLRRCFMLISAKDGFTKTDYGMLEFLMNYGIAFEVIFTKMDKVRDVKTLRDSISTSGILDAPIRPRLMFLNSVVNKAYPKRLGIAHLRQTIFEACNIKPNTLPSKAYKQ

SEQ ID NO: 23563 - protein, 185 aa, Phaeodactylum tricornutum
AGGIAEMSELPEEVRERTDILDSVGNTTAAIGKGFAIASAALTALALFAAYVEFTGIDGINIYKADVLAALFIGGMVPVVFSALAMNSVGKAAMEMVKEVRRQFKEIPGIMEGTGTPEYGKCVDISTKAALREMMLPGAITIVAPILIGFLMGPEALGSYMAGVAVSGVLWAIFQNNAGGAWDNA

SEQ ID NO: 23564 - protein, 189 aa, Phaeodactylum tricornutum
AGGIAEMAELEERVRDTTDALDALGNTTAATGKGFAIGSAVLTALSLLSAFTDKAGLGNVNVDIGEPVVLAGVLIGAMLPFLFAALTMLSVQKAAGAIIIEVRRQFAEIPGLREGTAEADSDKCVAISTQSSVEEMVLPGIYAILSPITVGFLIGPRCLTGLLGGAIASGMMLALMMIQSNAGGAWDNA

SEQ ID NO: 23565 - protein, 183 aa, Porphyra purpurea
AGGIAEMSGLPKEVRERTDILDAVGNTTATTGKGFAIAFAALTSLALFAAFVGIAGIDSIDIYKADVLAGLFVGAMVPFIFSALSIAAVGRAAMEMVQEVRRQFKEIPGIMEYKANPEYDKCVDISTKASIREMMLPGAIAIITPIVVGFIFGPEMLGGLLAGVTVSGVLMHFQNSGGAWDNA

SEQ ID NO: 23566 - protein, 349 aa, Rickettsia honei
ISMVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNALDFTENFLHMMFATPCTKYTVNPIIKNALNKIFILHADHEQNAFTSTVRIAGSSGANPFACISTGIASLWGPAHGGANESVISMLKEIGSSEYIPKYIAKAKDKNDPFRLMGFGHRVYKNYDPRAAVLKETCKEVLKELGQLDNNPLSQIAIELEAIALKDEYFIERELYPNVDFYSGIIYKAMGIPSQ

SEQ ID NO: 23567 - protein, 219 aa, Triticum aestivum
MDSSSSSTASSSQAQAQPDFDYLFKLLLIGDSGVGKSSLLLRFTSDSFEDLSPTIGVDFKVKMVNIAGKKLKLAVWDTAGQERFRTLTSSYYRGAQGIIMVYDVTRRETFTNLSDIWAKEIDLYSTNQDCIKMLVGNKVDKESERAVTKNEGIDFAREYGCLFLECSAKTKVNVEQCFEELVLKILDTPSLLADASSGAKKNIFKQKAPEADAAASGCC

SEQ ID NO: 23568 - protein, 208 aa, Porphyra purpurea
AGGISEMAELPSEVRERTDKLDAVGNTTAAVGKGFAIASAALTALALFAAFMKTAGVTAIDVSQPKIMAGLLVGGMLPFVFSALSMNAVGRAAMAMIEEVRRQFRDIPKLKAALEVMRAVDSDMTKASKEQRAIFDEADGVADYGKCIDISTKASIKEMVFPGLLAIVVPVAVGFLALEAEMVGGLLAGVTTGSLNAISNTGGAWDNA

SEQ ID NO: 23569 - protein, 240 aa, Mycobacterium smegmatis str. MC2 155
MQVTVLSGAGISAESGVPTFRDAETGLWAQVDPYEISSTDGWQRNPEKVWAWYLWRHYMMARVAPNEAHRTVAAWEDHLDVRVVTQNIDDLHERAGSTNVYHLHGSLFEFRCDACGSAFEGNLPEMPEPVETIDPPVCPCSGLIRPSVVWFGEPLPDAAWNRSVLAVSSADVVIVVGTSSIVYPAAGLPEAALAAGKPVIEVNPERTPLSDSATVSLRETASEALPTLLQRLPELLNRSA

SEQ ID NO: 23570 - protein, 336 aa, Clostridium thermocellum ATCC 27405
MAVKIGINGFGRIGRLVFRASLNNPNVEVVGINDPFIDLEYMQYMLKYDTVHGQFKGEISQDNGKLVVNGRKISVYGFTDPAEIPWSECGAEYIVESTGVFTTTEKASAHFKGGAKKVVISAPSADAPMFVMGVNHDKYTKDMNVVSNASCTTNCLAPLAKVIHENFGIVEGLMTTVHATTATQKTVDGPSKKDWRGGRAAAGNIIPSSTGAAKAVGKVIPELNGKLTGMAFRVPTLDVSVVDLTCRLEKPATYDEIKAAVKKASENELKGILGYTEDAVVSSDFIGDPRTSIFDAEAGISLNSNFVKLVAWYDNEWGYSNKVVDLIVHMASVDAK

SEQ ID NO: 23571 - protein, 397 aa, Clostridium thermocellum ATCC 27405
MAMMNKKTIEDIDVKGKKVIVRVDFNVPLDENRKITDDKRIVGALPTIKYLVEHGAKTILVSHLGRPKEGFEEKYSMAPTAVRLGELLGKEVIMAKDVIGPDAKAKAAALKEGEVLMLENVRFHKEETKNDPAFAKELASMAEIYVNDAFGTAHRAHASTAGLADYLPAVCGYLIQKEIEVMGKALSNPERPFVAILGGAKVSDKIGVIENLIDKVDTLIIGGGMAYTFFKAKGYSIGTSLCEDDKVELAKSLMDKAEKKGVKLLLPVDNVVGKEFSNDTERKTVPSDQIPDGWMGMDIGEETIKLYSEAIKNAKTVVWNGPMGVFEFSNFANGTREVARAVAESGAISIIGGGDSAAAIEQLGFADKITHISTGGGASLEFLEGKVLPGIDVLMDK

SEQ ID NO: 23572 - protein, 390 aa, Mycobacterium smegmatis str. MC2 155
MAQREWVEKDFYKELGVSSDASADEIKKAYRKLAAELHPDRNSDPGAAERFKAVSEANSVLSDPAKRKEYDETRRLFAGGFGRRFNQGGGGFGGGFGSDGVEFNLGDLFDAAGQTGGANIGDLFGGLFGRGPQQRPSRPRRGNDLETETELSFLEATKGVAMPLRLTSPAPCTNCHGSGARPGTSPKVCPSCNGSGVISRNQGAFGFSEPCTECRGSGSIIEHPCQECRGTGVTTRTRTINVRIPPGVEDGQRIRLAGQGEAGLRGAPSGDLYVTVHVRPDKVFGRDGDDLTVTVPVSFHELALGTTLSVPTLDGKVGVRVPKGTSDGRILRVRGRGVPKRSGGHGDLLVTVKVAVPPNLEGEAAEALEAYAKAERASGFDPRAGWAGNV

SEQ ID NO: 23573 - protein, 251 aa, Clostridium thermocellum ATCC 27405
MSRKVIAAGNWKMNKTPKEAVEFVQALKGRVADADTEVVVGVPFVCLPGVVEAAKGSNIKVAAQNMHWEEKGAFTGEVSGPMLAELGVDYVIIGHSERRQYFGETDETVNKKVHAAFKYGLKPIICVGESLTQREQGVTAELVRYQVKIALLGLSAEQVKEAVIAYEPIWAIGTGKTATNEQAEEVCGIIRECIKELYGQDVAEAIRIQYGGSVNAANAAELFNMPNIDGGLVGGASLKLDDFEKIAKYNK

SEQ ID NO: 23574 - protein, 511 aa, Clostridium thermocellum ATCC 27405
MKDKLVMLIILDGYGINPRKEGNAIEAANKPNIDRFMREYPNTIVRTSGMDVGLPDGQMGNSEVGHTNIGAGRIVYQELTRITKSIQDGDFFEKKEFLDAAENCRKHNSKLHLFGLLSDGGVHSHNTHLYGLLEFAKRQNLKDVYVHCFFDGRDVPPDSAMGYVEELENKIREIGVGEIATVMGRYYAMDRDNRWERVKLAYDAMVLGRGNQAQSAKEAVAESYKRQEFDEFVKPTVIMKNGSPVATVGENDSIIFFNFRPDRAREITRAFTEVNFSGFEREKGYFPVFFVCMTQYDKTFENVVVAFKPESLENTFGEYISKKGLRQLRIAETEKYAHVTFFFNGGVEAVYEGEDRILINSPKVATYDLKPEMSAYEVTDKVLECINKKEYDVIILNYANPDMVGHTGVFEAAKAAIEAIDECLGKVVPAVLEQNGVVLITADHGNSEQMIDYETGGPFTAHTTNPVPLIVIGLGDVKLREGRLADLAPTMLDILGFEKPKEMTGESLIVK

SEQ ID NO: 23575 - protein, 430 aa, marine gamma proteobacterium HTCC2143
MAEIVDIKAFEVLDSRGNPTVEADVILASGAVGSACAPSGASTGSREALELRDGDKSRYLGKGVLKAVNNINTTIKHLLVGKDAENQRALDQLMIDTDGTDNKGTLGANAILAVSLAAAKAVAIEKGIPLYQHIADINGTPGQYTMPVPMMNIINGGEHADNNVDIQEFMVQPVGASSFAEALRTGAEIFHSLKNVLKSKGLNTAVGDEGGFAPNLASNAEALAVIKQAVADAGYELGKDVTLALDCAASEFYKDGQYDLAGEGQVFSANGFSDYLAALCEQYPIISIEDGMDESDWDGWKYQTEILGDKIQLVGDDLFVTNTKILQEGIDKSIANSILIKFNQIGTLTETLEAIKMAKAAGYSVVISHRSGETEDTTIADLAVATSAGQIKTGSLCRSDRVAKYNRLLRIEAELAGAAPYRGRAEIRSQ

SEQ ID NO: 23576 - protein, 433 aa, Clostridium thermocellum ATCC 27405
MKQYLEIESVFAREILDSRGNPTVEVEVIAEGGFVGRAAVPSGASTGAFEAVELRDNDKNRYLGKGVQKAVENVNNIIAPEVEGMNVFDQAAVDNLMISLDGTPNKSKLGANAILGVSLATAKAAAEALGLSLYQYIGGVNAKTLPVPMMNIINGGKHADNSVNIQEFMIMPVGASSFRHALQMCAEVFHNLKKVLKDKGYSTAVGDEGGFAPNLKTDEEAIQVILEAVEKAGYKPGDDFRLAIDAASTEMYQEDGTYLFWKSGVKKTKEEMINYWEELVNKYPIISLEDGVAEEDWEGWKMLTERLGKRIQLVGDDLFVTNTTRLKKGIELGVANSILIKVNQIGTLTETLDAIEMANRAGYTAVVSHRSGETEDATIADIAVATNAGQIKTGAPSRTDRVAKYNQLLRIEEEIGAVSRYPGLDAWFNLKKK

SEQ ID NO: 23577 - protein, 280 aa, Zea mays
  misc_feature (210)..(210): Xaa can be any naturally occurring amino acid
  misc_feature (235)..(235): Xaa can be any naturally occurring amino acid
  unsure (1)..(280): unsure at all Xaa locations
MSRFGRSGPPPPIRDTYSLLVLNITFRTTADDLFPLFDKYGEIVDIYIPRDRRTGDSRGFAFVRYKYEDEAQKAVDRLDGRLVDGREIMVQFAKYGPNAERINKGRIMEPVPRPRGRSRSRSPRRRYRDDYRDDYQDRDYRKRSRSQSRDGYARDRYRDRDYRHRSLSRRYSPDDYKKRGRDSLSPARRSPSHSRSRSYTPDDYKRRGKXQVCKIERARFHFSLVFLDYSKHFSXTIISSASPASRSPSRSPPRKTPPSPKRSPVRHNDDRSPRSRSPST

SEQ ID NO: 23578 - protein, 435 aa, Dehalococcoides sp. BAV1
MKADYLIVGCSAGGIGAAEAIREVDRDGSIVIVGEEPYLAYSRPMIAKYLSGQKTVEKILFRRPEFYANNNITCLTDTKVEAVNTATHEVSLSNGEKISYGKLLLAPGGKPIVPPIDGSNKAGVFNFINMKDAVLIDGYVKAENVKKAVIIGGGLIGMSAADALTKLGIEVDIIELKGHILNTILDEAAGKIAAQTVTSYGVKLNTGRTVSKVLGLHKVAGVELDNGHQIESQMLVIAIGVIPRTELFKAAGLEVNRGVVVNDNMRTSNPDVYACGDACESFDFIYNSRRVTPIWPNAYIGGRIAGYNMAGMDTTYHGGTVMNSLNYFGMDIATAGMSVLPPDASGLEVLSTLTANGYKKLVLNAEGKIVGMLTLGETDTAGIIFGLMRDQSDVRPIKDNILNENFGLAYLSADSREEHLHGNTSGRVAPADFKH

SEQ ID NO: 23579 - protein, 425 aa, Oryza sativa (japonica cultivar-group)
MSSMESSYLPATTESIAKAQEAKDASESISILYRVLQDPSSSAEALRTKELAITNLTNYLTKENRAEELRNLLTQLRPFFSLIPKAKTAKIVRGIIDAVAKIPGTSELQISLCKEMVEWTRAEKRTFLRQRVEARLAALLLENQEYTEALTLLTGLIKEVRRLDDKLLLVDIDLLESKLHFSLRNLPKAKASLTAARTAANAIYVPPAQQGTIDLQSGILHAEEKDYKTAYSYFFEAFEAFSALEDPKAIFSLKYMLLCKIMVNQADDVAGIISSKAGLKYLGPDVDAMKAVADAYSKRSLKYFETALRDYKSQLEEDPIVHRHLSSLYDTLLEQNLCRLIEPYSRVEIAHIAEMIELPVDHVEKKLSQMILDKKFAGTLDQGAGCLIIFEDPKTEAIFPATLETISNVGKVVDSLYMRSAKIMA

SEQ ID NO: 23580 - protein, 199 aa, Brassica oleracea
MAEETKNVHEHEAPKVATEESSTATGEVTDRGLFDFLGKKKDETKPEETIDSEFEQKVHISEPVPEVKHEEEKEEKKHSLLEKLHRSDSSSSSSSEEEGEDGVKRKKKKDKKKVTATEGEVKTEEEKKGFMDKLKEKLPGHGKKPEEKPEDASPAPVVAPPVEEAHPAEKKGILEKIKEKLPGYHSKTVEEEKKDKDDH

SEQ ID NO: 23581 - protein, 196 aa, Arabidopsis thaliana
  misc_feature (74)..(74): Xaa can be any naturally occurring amino acid
  misc_feature (119)..(119): Xaa can be any naturally occurring amino acid
  misc_feature (132)..(132): Xaa can be any naturally occurring amino acid
  misc_feature (167)..(167): Xaa can be any naturally occurring amino acid
  unsure (1)..(196): unsure at all Xaa locations
EREREREFSIPPPPPEIEEEEEILVSYMISSDAELTSPAQDTMLAPFTVLKTSASFQVSRKANNDITSITTNVXTVSCMNERPPLGKKKFETISYLPDLTDSELLKEVDYLLRNQRIPXVQFDLYQGFEYRXEHRNTLVYYYGLYWNMWKIPLLRCSDSAQVLKEIXLCKKEYPVAFIMIIVFENNRQVQCISLIV

SEQ ID NO: 23582 - protein, 262 aa, Bacillus anthracis str. A2012
  misc_feature (63)..(63): Xaa can be any naturally occurring amino acid
  misc_feature (105)..(105): Xaa can be any naturally occurring amino acid
  unsure (1)..(262): unsure at all Xaa locations
MNMLKSYRAVLVSLSLLLVFVLSGCSNATPIDAHSTGIWDHYFVYPISFMIQFVAHHIPGASXGIAIIIMTLVIRSAMIPLAVSQYRSQAKMKKMQPELQKLKQXYGDVSKDLEKQKQYQKEMSELMKSGGWNPLAGCWPLLIQMPIFSALYYAISRTEEIRTSTFLWVNLGHADPYHILPIIAALTTFIQMKVFQSNSTSGEQVQMLKMQQIMMPAMILFMGFAAPSGLVLYWITGNLFTMMQTIVLRKIMEREELQLQKA

SEQ ID NO: 23583 - protein, 960 aa, Ashbya gossypii ATCC 10895
MGLASKRKRDTEEHSDEGEDFDIAGNIALDSEDSDDSVSDSDNEVQDIIEFSDDEKQNAPQVSKTAKGAKGAKVAAPRSDAAFPSLELSDGEDADNGDKDDVDSYFNTTSQLAASKAKKGSFASFGLSKFILGNISRKGFRQPTPIQRKTIPLILQQRDIVGMARTGSGKTAAFVLPLIEKLKMHSAKIGARAMILSPSRELAMQTHKVFKEFAKGSNLRSVLLTGGDGLEDQFSMMMSNPDVIIATPGRFLHLKVEMNLDLHSIEYVVFDEADRLFEMGFQEQLNELLGSLPTARQTLLFSATLPSSLVDFAKAGLTNPVLVRLDTETKVSENLEMLFLSVKNDEREANLLYLLQEVIKIPVATEEQLQRFRKQSNDDADDSDDETDKKKKHSKKSKQPLPSAKDMPSPNSTIIFVSTRHHVEYVSNLLKDCGYLVSYLYGTLDQHARRQQLHNFRCGLTNILVVTDVAARGVDIPLLANVVNMSLPASSKIFVHRVGRTARAGNKGWAYTILSESELPYLLDLELFLGKKVLLTPMYEATCDLLKKKWISEGNEGALFQPPKISYVNRLILGSAPRLDLEAMGDLFKNLVESNFELQNLKAVSIKAEKLYLRTRQPASAESIKRAKEVIAAGWDEQNVRFGKNIEKEKLEFLAKLQNRHNKETVFEFARNHDDEMAILMKRRRRQIAPIQQRAKERQQLLEKERQAGLRHTLEDEILKGEENEVGYSVPQELLRDFEDADELAAKRNTKKGFRDENFYLSHFAPASDIQDKQLQVASSFTNEVSKATFDLHNDDKVQVHKQTATVKWDKKRKKYVNVQGIDNKKYIIGESGQKIPASFRSGKFDEWSKARKLAPLKVGARESSIPANLLADPTGSRLANGKFKHKQIKAPKMPDKNRDDYQSQLKKVNKAMESGLHVKGYNAPGMKQELRTTEQIRKQRSMAEKRKAKNARPAKKRKF

SEQ ID NO: 23584 - protein, 216 aa, Porphyra purpurea
AGGIAEMTELPNFVDGRITKRKSDRLHTDAFGNTTSAVGKGFAIASAALTALAFYAAFQKHAGVDAMDVYQPKILAGLLVGGMLPFVFSALSMHSVGRAAMAMMKEVRRQFRDIPKIKPALEVMRAVDFEMTKAFQEQRPILDQPEGIRDYGKCIEFSTKAFLFKEMVLPGLLAILFPVAVGFLFGAEMIGGLLAGVTVSWGLNAISNTGGAWDNA

SEQ ID NO: 23585 - protein, 212 aa, Navicula pelliculosa
AGGIAEMMAEIPEEDGSREITDKLDAAGNTTAAIGKGFAIISAALTAAAVFTASTKAANESFIDMAPHGIIMGRIVAVMFPAVFTAFVINTVVRDPMPIIVEVRRQFTDIPQVQAVVEEIRGEVSNKAKGTPAEKRHILNAACGKPEYDKCVDISTEASIREMVSPGILAIVVPVAVGLISGAESVGGILVGAISGVLMALTSQSGGAWDNA

SEQ ID NO: 23586 - protein, 800 aa, Staphylococcus aureus
MLISNEWLKEYVTIDDSVSDLAERITRTGIEVDDLIDYTKDIKNLVVGFVKSKEKHPDADKLNVCQVDIGEDEPVQIVCGAPNVDAGQYVIVAKVGGRLPGGIKIKRAKLRGERSEGMICSLQEIGISSNYIPKSFESGIYVFSESQVPGTDALQALYLDDQVMEFDLTPNRADALSMIGTAYEVAALYNTKMTKPETTSNELELSANDELTVTIENEDKVPYYSARVVHDVTIEPSPIWMQARLIKAGIRPINNVVDISNYVLLEYGQPLHMFDQDAIGSQQIVVRQANEGEKMTTLDDTERELLTSDIVITNGQTPIALAGVMGGDFSEVKEQTSNIVIEGAIFDPVSIRHTSRRLNLRSESSSRFEKGIATEFVDEAVDRACYLLQTYANGKVLKDRVSSGELGAFITPIDITADKINRTIGFDLSQNDIVTIFNQLGFDTEINDDVITVLVPSRRKDITIKEDLIEEVARIYGYDDIPSTLPVFDKVTSGQLTDRQYKTRMVKEVLEGAGLDQAITYSLVSKEDATAFSMQQRQTIDLLMPMSEAHASLRQSLLPHLIEVASYNVARKNKDVKLFEIGNVFFANGEGELPDQVEYLSGILTGDYVVNQWQGKKETVDFYLAKGVVDRVSEKLNLEFSYRRADIDGLHPGRTAEILLENKVVGFIGELHPTLAADNDLKRTYVFELNFDALMAVSVGYINYQPIPRFPGMSRDIALEVDQNIPAADLLSTIHAHGGNILKDTLVFDVYQGEHLEKGKKSIAIRLNYLDTEETLTDERVSKVQAEIEAALIEQGAVIR

SEQ ID NO: 23587 - protein, 498 aa, Arabidopsis thaliana
MLEIITVRKVFLIGFLILILNWVWRAVNWVWLRPKRLEKYLKKQGFSGNSYRILMGDMRESNQMDQVAHSLPLPLDADFLPRMMPFLHHTVLKHGKKCFTWYGPYPNVIVMDPETLREIMSKHELFPKPKIGSHNHVFLSGLLNHEGPKWSKHRSILNPAFRIDNLKSILPAFNSSCKEMLEEWERLASAKGTMELDSWTHCHDLTRNMLARASFGDSYKDGIKIFEIQQEQIDLGLLAIRAVYIPGSKFLPTKFNRRLRETERDMRAMFKAMIETKEEEIKRGREQGPDSGLSLDDLIDDCKAFYLAGQNVTSSLFVWTLVALSQHQDWQNKARDEISQAFGNNEPDFEGLSHLKVVTMILHEVLRLYSPAYFTCRITKQEVKLERFSLPEGVVVTIPMLLVHHDSDLWGDDVKEFKPERFANGVAGATKGRLSFLPFSSGPRTCIGQNFSMLQAKLFLAMVLQRFSVELSPSYTHAPFPAATTFPQHGAHLIIRKL

SEQ ID NO: 23588 - protein, 184 aa, Navicula pelliculosa
AGGIAEMSELPEEVRERTDILDSVGNTTAAIGKGFAIASAALTALALFAAYVEFTGIDGINIYKADVLAALFIGGMVPVVFSALAMNSVGKAAMEMVKEVRRQFKEIPGIMEGTGTPEYGKCVDISTKAALREMMLPGAITIVAPILIGFLMGPEALGSYMAGVAVSGVLLAIFQNSGGAWDNA

SEQ ID NO: 23589 - protein, 208 aa, Rhodomonas salina
AGGIAEMAELEGSVRETTDTLDAVGNTTKAVTKGYAIGSAGLGALVLFAAYTEDLAYFASKPDVYPFFAGIEVDFALSNPYVVVGLLFGGLLPFLFAGMSMTAVGRAAQAVVEEVRRQFKEKPGIMTYEEKPDYGRAVDILTTAAIREMIIPSLLPVLAPIVLFTVLYFIADLNQALAAVGAMLLGVIVTGLFVAISNSSGGGAWDNA

SEQ ID NO: 23590 - protein, 394 aa, Solibacter usitatus Ellin6076
MAGKRIGILTGGGDVPGLNSVIKTVVYRGSEIGCEVIGIRRGWEGLTHVNLQDPASRTRYVLPLNRENTRTIDRTGGTYLHSSRTNPSKMKKLPPVLEGQDFPKVTSTKKGVTSEVFDVSKAVLKNIETLNLDYLIAIGGDDTLSYAAELDRQGFRVIAVPKTMDNDVQNTEYCIGFSTAITRAMDAIERQRTTVGSHERIGLFRVFGRDAGYTALYTAYVTSVRCCIPEHKVDLPKLIDLLVTDKKNNPSNYSLAILSEGAEWVGYTVKEYGEADAFGHRKKMSVAEDLSNEIKNSTGEETIVSDLTYDLRSGSADFVDRMVASTFAGMAMDAIQEGKHGLMTAISNGSYTMVGIPDPKLGPRRVDVASMYNTDRYRPVYDHKLGLPIFLTRA

SEQ ID NO: 23591 - protein, 1084 aa, Burkholderia pseudomallei K96243
MPKRTDINSILIIGAGPIIIGQACEFDYSGAQACKALREEGYKVILVNSNPATIMTDPNTADVTYIEPITWEVVERIIAKERPDAILPTMGGQTALNCALDLFHHGVLEKYGVELIGASPEAIDKAEDRQKFKDAMTKIGLGSAKSGIAHSMEEALKVHADIAAATGGSGYPVVIRPSFTLGGSGGGIAYNREEFEEICKRGLDLSPTRELLIEESLLGWKEYEMEVVRDRADNCIIVCSIENLDPMGVHTGDSITVAPAQTLTDKEYQILRNASLAVLREIGVDTGGSNVQFSINPKDGRMVVIEMNPRVSRSSALASKATGFPIAKVAAKLAVGYTLDELKNEITGGATPASFEPTIDYVVTKIPRFAFEKFREADSRLTTQMKSVGEVMAIGRTFQESFQKALRGLEVGVDGLDEKTTSRDEIIREIGEPGPDRIWYVGDAFRVGMSREQIFEETAIDPWFLAQIEQIVLKEKALAGRTLASLTKDELHYLKQSGFSDRRLAKLLGATPADVRARRLELNVRPVYKRVDTCAAEFATKTAYMYSTYEEECEAQPTGNRKIMVLGGGPNRIGQGIEFDYCCVHAALAMREDGYETIMVNCNPETVSTDYDTSDRLYFEPLTLEDVLEIVDKEKPVGVIVQYGGQTPLKLALDLEAHGVPIIGTSPDMIDAAEDRERFQKLLQDLGLRQPPNRTARAEDEALALADEIGYPLVVRPSYVLGGRAMEIVHEPRDLERYMREAVKVSNDSPVLLDRFLNDAIECDVDCICDGDAVFIGGVMEHIEQAGVHSGDSACSLPPYSLSTQTVAELKRQTGAMAKALNVVGLMNVQFAIQQVPRPDGSKEDIIYVLEVNPRASRTVPYVSKATSLPLAKIAARAMVGQKLAQQGVTKEVEPPYFSVKEAVFPFIKFPTVDPVLGPEMRSTGEVMGVGATFGEALFKSQLAAGSRLPESGTVLLTVMDADKPKAVEVAKMLHDLGYPLVATRGTAAAIEAAGVPVKVVNKVKDGRPHIVDMIKNGEIALVFTTVDETRAAIADSRSIRMSAQAHKVTYYTTMSGARAAVEGLRYLKDLEVYDLQGLHARLN

SEQ ID NO: 23592 - protein, 449 aa, Kluyveromyces lactis
MASNGTGGLPPIDFEKVRNDSDGSVTGMAKGLFNQFIEGNPYFAAGGGLMVLGTSLALLRRGVISTSRLAYHQLIVDLEIPSKDKSYLWFLQWMSRYPHRSSRHLSVETNYLQHNNGSVSTEVNFVPGVGNHLIRYKGAFMLIKRERSGQIANITNGTPFETVKLTTLYRDRHLFQELLMEAKDLAVKRQTGKTVIYTSWANEWRPFGQPKAKRNLKSVILDNGLKESILNDVNDFLQNGKWYYDRGIPYRRGYLLYGPPGSGKTSFIQALAGELDYNSCIMNLADPNLTDDRLNYLMNNLPERSLMLLEDIDAAFVKRSKNDEGFVNGVTFSGLLNALDGVASSEEIITFMTTNHPEKLDPAVMRPGRIDYKTYVGNATEYQIKQMFLRFYPEEKELSEQFVQKAVELDTPISTAQLQGLFDFNKQNPKNAVLMVESLRYPNHVFCCK

SEQ ID NO: 23593 - protein, 120 aa, Crocosphaera watsonii WH 8501
MNAQGIIKDIESEYIKNDLPTIHVGDTVRVGVRIREGGKERVQPYEGTVIAMRNGGINETITVRKTFQGVGVERVFLLHSPRIADIKIIRRGKVRRAKLYYLRDRVGKATRIRQRFDRPV

SEQ ID NO: 23594 - protein, 465 aa, Methanococcus maripaludis S2
MFIDGKWIIREDIDVFDPYTLENIEKITALDREETKNAIEVTEKHKEIMKNLSPSKRYKILMKVAEHLSSKKDFFAKTISIDVGKPIKQSKIEVDRTLTALKLSAFYAKELRGETINSENGLIFTKKEPLGVIGAITPFNFPLNLATHKIGPAIATGNSVVLHPSSKAPIVAIYLTKIIEHVLKQMDIPRGVFNLATGNGEIVGDEISKNDNVNMVSFTGSVEVGESISKNAKMKKVTLELGGNNPMIVLKDSDIKLAAKSAVKSKFLNAGQVCISVGQVLVEEEVVETFTKYVIEETKKLILGNPLDKNTDIGPLISPESALRIENLIKQSVSEGGELLIGGNRQNSLISPAVINIDEENILSKIETFGPILPILTVKDSEEAVNIANNSKYGLQAGLFTNNINNAMKIADELEYGGIMINSSPTFRKDNMPFGGVKKSGLGREGIKYTVEEMSETKTVVIHNI

SEQ ID NO: 23595 - protein, 667 aa, Streptococcus thermophilus LMG 18311
MTKTFYITTPIYYPSGKLHIGSAYTTIACDVLARYKRMMNYDVFYLTGLDEHGQKIQQRAEEAGITPQEYVDSMAVGVKDLWQLLDISYDKFIRTTDDYHEKVVAQVFERLLEKGDIYLGEYSGWYSVSDEEFFTESQLAEVYRDEEGNVIGGVAPSGHEVELVSEESYFFKLSNYADRLTAFYKEHPEFIQPDGRMNEMLKNFIEPGLEDLAVSRTTFTWGVKVPSDPKHVVYVWIDALINYITALGYGQNEHGNFDLFWQNDKNHEIIHMIGKDILRFHSIYWPIILMALDLPLPTRLVAHGWFVMKDGKMSKSKGNVIYPEMLVERFGLDPLRYYLMRSLPVGSDGTFTPEDYLARINYELANDLGNLLNRTVAMINKYFDGQVPAYIENVTDYDADLAKVVAENIEEFHKQMNAVDFPRALDAVWNIISRTNKYIDETAPWVLAKEDGDEEQLRAVMAHLAASLRVVAHLIQPFMMSTSNAIMEQLGLPVVFDLENLELSGFPENVTVISKGTPIFPRLDMDEEIAYIQSQMNAGKPQEKEWNPEEVELKSEKDQIKFEDFDKVEIRVAEVKEVEKVEGSDKLLRFRLDAGDGEDRQILSGIAKFYPNEQELVGKKLQVVANLKPRKMMKKYVSQGMILSAEHDGKLTVLTVDPSVPNGSVIG

SEQ ID NO: 23596 - protein, 527 aa, Mycobacterium smegmatis str. MC2 155
MTANITTDKPQGAGAAGLPTADELRQRVRRALDAIGATTALAEPGGASDGDLHASTPITGDVLFTLPAHTAEAADAAIAEAAQAFSVWRTTPAPVRGALVARLGQLLVEHKADLATLVTVEAGKITSEALGEVQEMIDICDFAVGLSRQLYGRTIASERPGHRLMETWHPLGVVGVITAFNFPVAVWSWNTAIALVCGDTVVWKPSELTPLTAIACQALIERAAADVGAPAAVSRLVQGGREVGERLVDDPRVALVSATGSVRMGREVGPRVAARFGKVLLELGGNNAAIVTPSADLDLAVRAIVFSAAGTAGQRCTTLRRLIVHSSVADEVVRRVVSAYQSLPIGDPSAEGTLVGPLIHARAYRDMVGALEQARADGGTVHGGERHELGDEEGAFYVAPAVVVMPAQTEIVHNETFAPILYVLTYDDLDEAIALNNAVPQGLSSAIFTTDVREAERFLAADGSDCGIANVNIGTSGAEIGGAFGGEKQTGGGRESGSDAWKAYMRRATNTVNYSSELPLAQGVHFG

SEQ ID NO: 23597 - protein, 386 aa, Acinetobacter sp. ADP1
MKLPLYFQSNMKDHLEDLVRTKDTPFLVLDLSVIEKHYLELKQGFPNTDIYYALKANPANEVIDRLNSLGSNFDLASVNELKKVQAFGVDASRLAFGNTIKKRIDIQYFYDQGVRLYVTDSDIDLNNIAHYAPGSKVFFRLSIDGSETADWPLSGKFGCNAECVIRLAIKAKELGLIPYGISFHVGSQQRKIDLWDSALQETKAIFDVLATEHNIRLKMLNLGGGLPAQYVQETEAFDNYSKQINAALEIFKSYHLEQIILEPGRSLVGNAGILVSEIVLISQRPQSGTKRWVYTDVGVFNGLIETLGESIQYPIMCKKTGNSDDIILAGPTCDSMDIMYQNKKYELPLSLEIGDHLYWLSTGAYTTSYSSIEFNGFPPLQYYALN

SEQ ID NO: 23598 - protein, 479 aa, Bacillus cereus ATCC 10987
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKAAMIPLVLELGGKDPGIVREDADLQDAANHIVSGAFSYSGQRCTAIKRVLVHENVADELVGLLQEQVAKLSVGSPEQDSTIVPLIDDKSADFVQGLVDDAVEKGATIVIGNKRERNLIYPTLIDHVTEDMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 23599 - protein, 189 aa, Yarrowia lipolytica
MSQIIDQVQAALQNIDKELEKYPALKELEKQIPVPKSYILLGFVGFYFILIFLNIGGIGQLLSNIAGLVIPGYYSLLALETPGKADDTQYLTYWVVFATLNVFEFWSKAILYWVPFYYLFKTAFLLYIGLPQYGGAELVYKAIVKPLAQKLVNIQPHGGPSDSLKAQAQSAVDAAESHVPQGHSTGVSH

SEQ ID NO: 23600 - protein, 273 aa, Xanthomonas axonopodis pv. citri str. 306
MLERAAAGGDAVSAALLAERLLRGEGVPPQPDAAAQLLQQLQPLGMTALPAVDIAPPDPADDTADHRIAFAPRVGPVRRHTAPRIEEYAAVLSADECRLLMLLARPHLRASKVIDPNDASTQRAPIRTSRGATLDPIIEDFAARAAQARLAACAQLPLAHAEPLSVLCYAPGEQYRAHRDYLPPGTIAADRPTAGNRQRTVCVYLNDVGAGGDTEFPIAGVRVRPRPGTLVCFDNLHADGRPDADSLHAGLPVTAGSKWLGTLWFRQQRYRHW

SEQ ID NO: 23601 - protein, 752 aa, Ashbya gossypii ATCC 10895
MSYQPVGPRQEAEHQAEVRNFDQFTTIDWILEEKSQRNSGARDVGYSGRWRRYLEEVWHRGQAFFTLTAIGVTVGCIAGFIQVLTETLVNWKTGYCARNWLLNKSFCCQRIAEDTRKFLVIEGAQCVEERLWVPWSNSVLAYFTFITLSVAFAMLSALMVKCLAPMATGSGISEIKVHVSGFQYKKEFFSLTTLAVKSVALPLAISSGLSVGKEGPSVHYATCCGFLIVQFLLRNTLKYAEQAEYLVASSAAGVAVAFGAPIGGVLFGLEEMSSSPHFNLSTLWKSFYVALSAVSTLQYLDPFRNGKIVLFEVKYDRDWHVEEIPIFILLGIFGGLYGHYIGNLNIWFVTFRRNYLSKWPLREVFVLALATTCLSYFNEFLKLDMTESMSLLFHECVEEKSGMNFEHRLCQLDGKFSFLSFLTLYCSLMFATVVRALGVVVSYGARVPAGIFVPSMAVGATFGRSISVLVENFITGPHVITPGTYAFLGAAAALSGITNMTPTVVVIMIELTGAFIYIIPTMIVVAIPRIVYSSFSKEGGIAEKMIMVNGFPFMECPQEHRDFLDEYCAADISTTDVVTIKESMHLSDLESLLEEVGNSYKGFPIIRNDDENEQEKRCIGYVTLQHIRSQLGMYTNDNTARNTVVDFTKKFLPDDENLIQFSDLVNYTPFTVDKSLSLSLLYQMFHKLGCKVVIVEDAGFLVGIITKKDFLRFQRTKRTELYGSINTFDEQSAERLWNLIMRVIRKLRSKQL

SEQ ID NO: 23602 - protein, 213 aa, Blastochloris viridis
AGGIAEMSGLPKEVRKATDALDAVGNTTKAVTKGYAIGSAGLGALVLFAAYSEDLKFFSANPTEFPYFKDVVIDFSLSNPYVVVGLLFGGLLPYLFGAMGMMAVGRAASAIVEEVRRQFRENPGIMDYKVKPDYGRAVDMLTKAAIKEMIIPSLLPVLSPVVVYFVIYFVAGGGAAGKSAAFSSVGALLLGVIVTGVFVAISMTSGGGAWDNA

SEQ ID NO: 23603 - protein, 749 aa, Spiroplasma citri
MDRDIKYEEVLAQIKLYIKDEATLKEIQKAYEYAEEKHHGQVRNSGAAYIIHPLWTTFFLAQWRMGPKTLIAGLLHDVLEDTPATFEELQELFGIEIANLVEGVTKVSYFAKENRTQIKAQYLRKLYLSMAKDIRVIIVKLADRLHNLKTIGYLKPERQQIIARESLEIYSAIAHRLGMKAVKQEIEDISFKIINPVQYNKIVSLLESSNKERENTINQKIEELKKILITEKKMSVKVYGRSKSIYSIYRKMNQFGKNFDDIHDILAVRIITNSVDDCYKVLGFVHQHYTPLNNRFKDYIATPKHNLYQSLHTTIVADDGLIFEVQIRTEEMDELAEQGVAAHWRYKEGENYDIAKKQKDIDERLDIFKRILDLENISVQERDEIQQEVYKPDHLMEQIIQNDIFSSLIYVLTPNGKVVTLPFGSTVLDFAYKIHSEIGEKTIGAKINGLFSPISTVLKSGDVVDIKTAATQKPNHSWLVVSKTSSALQKIKKYLKKELVEVTSDAKSVNLEKIKQTKSQIEEYIAKKDLKWKLVNSETQLERLHAINFNNIEDFLLDVANDEYTLEEAINLVYLDHETSQNEKILKKLQDKQYKKAQLKDDIIVQGISNIKVVISQCCLPIPYEDITGYVSKAEGIKVHLKTCRNIQSGDKQDRQVEVSWNEAVCKNKQYDCAIRIEAIDRPALLVDVTKVLSHLNASVQMMSANVSGDLMNLTIKTIIKVSNADRLQQIRSSLLTIPDIKVVERVMM

SEQ ID NO: 23604 - protein, 199 aa, Azospirillum brasilense
AGGIAEMADMPKDIRVTTDALDAVGNTTKAVTKGYAIGSAGLAALVLFAAYVQDLKHYFPNVTVEFRLDDPYVVVGLLIGGLLPYLFGAMGMTAVGRAAGSVVVEVRRQFREISGIMEGTAKPDYGRAVDMLTRAAIKEMVIPSLLPVLAPVVLYIVIAAIAGQAQAFAALGAMLLGTIVTGIFVAISMTAGGGAWDNA

SEQ ID NO: 23605 - protein, 368 aa, Malus x domestica
MGKGGQSCNGVVRDAKPVEQENMAAWLVDVNTIKILPFKLPAIGPNDVRIRIKAVGICGSDIHYLKTMKCGDFQVKDPMVIGHECAGIVDKVGSEVKHLVPGDRVAVEPGISCAHCQQCKGGRYNLCPDMKFFATPPVHGSLANQIVHPADLCFKLPENVSLEEGAMCEPLSVGVHACRRANVGPETTVLIVGAGPIGLVSVLAARAFGAPRIVIVDMDDRRLAMAKSLGADGTVKVSTKMEDLDDEVAKIKEAMGSEVDVTFDCVGFNKTMSTGLNATRPGGKVCLVGMGHGVMTVPLTPAAAREVDVVGVFRYKNTWPLCLEFLRSGKIDVKPLITHRFGFTEKEVEEAFATSARGGNAIKVMFTL

SEQ ID NO: 23606 - protein, 199 aa, Rhodothalassium salexigens
AGGIAEMAELEADVRERTDALDAVGNTTKAVTKGYAIGSAGLAALVLFGAYKADLDLYFADLAVSFELTNPYVVVGLFIGALLPYLFGAMGMTAVGRAGGAVVEEVRQQFRDKPGIMKGTEKPDYAKSVDLLTRTAIREMVVPSLLPVLAPLALYFAIYGVAGQGQAFAALGALLLGVIVSGLYVAISATAGGGAWDNA

SEQ ID NO: 23607 - protein, 209 aa, Rhodovibrio salinarum
AGGIAEMGELEDSVRETTDTLDAVGNSTKAVTKGYAIGSAGIGAIVLFASYTEDLSNFAAKPIVYPYFAGIEVDFALSNPYVVVGVVFGGLLPFLFAGHSMTAVGRAAQTVVEEVRLQFKEKPGIMTYQEKPDYGKRVDILTTAAIREMIIPSLLPVLAPVVLFHCGLLQAGHNACDRPALGAMLTGVIVTGLFVAISMTSGGGAWDNA

SEQ ID NO: 23608 - protein, 318 aa, Oryza sativa
WRSSSGDGDADGVDALAAEVGRASRDWGFFVVVRHGVPAEAVARAAEAQRTFFALPPERRAAVARSEAAPMGYYASEHTKNVRDWKEVFDLVPRQTPPPPTTAVADGDLVFDNKWPDDLPGFREAMEEYGEAVEELAFKLLELIARSLGLRPDRLHGFFKDDQTTFIRLNHYPPCPSPDLALGVGRHKDAGALTVLYQDDVGGLDVRRRSDGEWVRVRPVPHSFIINVGDIIQVWSNDRYESAEHRVAVNVEKERFSIPFFFNPAGHTMVEPLEEVVSDESPARYNPYNWGEFFSTRKNSNFKKLDVENVQITHFRKN

SEQ ID NO: 23609 - protein, 263 aa, Arabidopsis thaliana
MYHIHGVLHVSSIPLCLLLLLFFIPFSYFVDFPFQFLLQPAIKLPNKTISDRRNITKDSSPSDLPSIRFFSFLISLHCSNSAQNEGVTKACGCPLLPLKSHIKGPAPVSEQDKTDIVDEAITFFRANVFFTNFDIKSPADKLLIYLTFYINVALKRLEGCRTLAVGTKAIINLGLEDIPVPGETGFPFPGLFSLPQSQDEAVTWSLALCSVWLQMSELFRNYLKQVREETSGRLLSVAYRANGTPNKWWLAFAKRKFMNVVVL

SEQ ID NO: 23610 - protein, 163 aa, Methanococcus maripaludis S2
MIIGIISDTHIPERAKKLPKEIFEHFSDVDLIIHCGDVTSESVLNDLEKISELLVVSGNMDYMNYPKEYEITIENFKIGIIHGNQIHPRGDTLKMKYLCLEKNWDILISGHTHIPMIKEISLENKKILLLNPGSPTVPRYPLKTIMKLKIEEREIDAELISIK

SEQ ID NO: 23611 - protein, 393 aa, Streptococcus thermophilus LMG 18311
MLFEESDLLKELPEQFFAGLVAKVNAKVAEGADIINLGQGNPDQPTYDHIVEALRVSAKNPANHKYSQFRGNRPFKEAAASFYKNHYGVDLDSEREICVMGGAKIGLVELPLALMNPGDLLLLPDPGYPDYLSGVSLGRVAYETFPLTAENDFLPDLEAIPEGTARRAKFIYINYPNNPTGAVATKAFYEKLVAWAKTYEVGVVSDLAYGALGYQGYENPSFLATPGAKDVGIEFYTFSKTFNMAGWRLAFAGGNAEMIEALNLIQDHLFVGIFPALQEAGIAALLDPKSEEAVAQLNAVYDSRRDAFVQTAANIGWQAFPSRGSFYAWMPVPKGYTSESFADLLLEKAHVAVAPGKGFGPAGDAYVRIGLLVEPERLVEAVNRIADLHLFNN

SEQ ID NO: 23612 - protein, 153 aa, Triticum aestivum
MKRPSGSSAGRDPRAPPPASGGGGSSELAKKRQRTSSSSQAEASSSSSQPPPAPPGDARAVPDLGEDVMFEVLRRAEARTLAAAACVSRGWRVLAQDERLWEAPCVREWTGLGFSEQLLRAVVLPLGGFRRLHAVSVQARRRFGVGCGNWHGV

SEQ ID NO: 23613 - protein, 666 aa, Dehalococcoides sp. BAV1
MSNTKLDSLCINALRFLSVDAVQKANSGHPGAPMGMAAMAYALWQNFLKHNPQDPAWPNRDRFILSAGHASALLYSLLHLTGYDLPLDELKNFRQWGSKTPGHPEYGLTPGVEMTTGPLGQGFASGVGMAMAEAHLAAVFNQPDCKIIDHYTYGIVSDGDLMEGVASEAASLAGHLALGKLIYLYDDNDISIEGSTELAFTENAALRFESYGWQVIDHVDGLDPEAVSQAIKQAQSDTTRPSLIICKTIIGFGSPNKAGKASAHGEPLGTDEVSKSRKSLGWDYEPFVIPVEALTEFREALGKGKTAQQVWLSKLDYYLSHYPEKASLLQDMLSGNLPEDWDKDLDRLFDKAMASREASGLLINALASRLPSLMGGSADLSPSNKTVIKDGGEYEPHYYEGRNIHFGVREHAMGAIANGLALHGGIIPYVATFLIFYDYMRPAVRLASLMGQRVIYIFTHDSIGLGEDGPTHQPIEQLAGLRSVPGLVTIRPADSYETAQAWKTAILRKNGPTAIALSRQKLPLLDNSQTKSLNLPKGAYILQETDSHPQVALVASGSEVTIAVEAAEILKGKGISSRVVSFPSWQLFDNQPQTYRQSVLPSSLPRVIMEAGNSQGWCKYLGTNGTVISIDHFGASAPAPLLYKKFGLTPENMAEKALKLLENEHE

SEQ ID NO: 23614 - protein, 210 aa, Ustilago maydis 521
MKSIVSLTTLFTLVAALAVLLVSMPSTASTTDPTITHKVYFDISHNNKDIGRIVVGLYGKDVPRTAENFRALATGEKGFGYKGSKFHRVISSFMIQGGDFERGDGRGGYSIYGGKFDDENFKFKHTGPGIVSMANAGRNTNGAQFFICTVKTSHLDGRHVVFGRVLDGMDVVKYIEKVPTGYGDKPVHDVLVKDSGELPVDADEKVKDEL

SEQ ID NO: 23615 - protein, 357 aa, Ralstonia metallidurans CH34
MAGMQAAVFQGPGKIVLQEKPIPAVGPTDALIRITTTTICGTDIHILKGEYPVERGLTIGHEPVGIIEKLGSGVTGYHEGQRVIAGAICPSFYSYACQDGCASQDGQGHSHGYKPMGGWRFGNTIDGTQAEYVLVPDAQANLAPIPDGLTDEQVLMCPDIMSTGFSGAEHANIKIGDIVAVFAQGPIGLCATAGARLRGASLIIAVDGIDDRLNISRQMGADVTLNFRNTDVVQEILRITGGRGVDASIEALGTQATFESALRVLKPGGTLSSLGVYSSDLKIPLDAFAAGLGDHRIITSLCPGGKERMRRLMNVIETQRIDLGPLVTHRFKLADIEAAYDLFGHQRDGVLKVAITP

SEQ ID NO: 23616 - protein, 170 aa, Spiroplasma citri
MDLKKFIVDIPNYPERGVIFRDITPLLNNALAFTTVINQLAAYAVAQKATVIIAPEARGFLFGPAVSYSTNLRFIPVRKVGKLPRPVINVKYSYEYAENQLEIHAGDLQPSDRVLIVDDVLASGGTARAMCQLVNQEQATVAGLAFVIDLTYLNGKKDLDSYPIKTLIEY

SEQ ID NO: 23617 - protein, 295 aa, Photobacterium sp. SKA34
MSKINKVAVVGGTHGNEFSGIYLLKKWQSDPLQLARESFSVDTVFANPKAYGENKRYVDHDLNRQFGIDDLANNELTSYEQTRAKAINQQIGPKGKANSDFIIDLHNTTSNMGPSLILLQSDLFNRQLGAYVKSKMPKAVVVFEDHTSVDEHLFLCSIAKQGVIVEIGPQPQSVIRQDVLDWMEAMTKHILDFVHLNNTNEVPELPASYDAYCYEETLKLPVDEQGERIGMVHQSVQDNDFEPLRSGDPIFTLFDGTEIFWEGDYEAYPHFINEAAYYDNNLAMSLGKKIVVSTN

SEQ ID NO: 23618 - protein, 211 aa, Rhodopseudomonas palustris
AGGIAEMAGLPKEVRKSTERADAVGNTTKAVTKGYAIGSAGLGALVLFAAYNEDLKFFIAQKSPYFVGVAPDFSLNNPYVVVGLLFGGLLPYLFGAMGMTAVGRAAGAIVEEVRRQFREKPGIMKGTDKPDYGKAVDLLTKAAIKEMIIPSLLPVLSPIFVYFAIYAIAGGGAAGKSAAFSAVGAMLLGVIVTGLFVAISMTSGGGAWDNA

SEQ ID NO: 23619 - protein, 208 aa, Isochrysis galbana
AGGIAEMAELPSSVRDTTDALDAVGNTTKAVTKGYAIGSAGLGALVLFAAYNEDLKYFAATAAEGSFFDGIGVVNFSIANPYVVVGLLFGGLLPFLFGGMSMMAVGRAAQAVVEEVRSQFKNDPGIMEGTSKPNYGKAVDILTSAAIKEMIVPSLLPVLSPIVLFLLIWGIAGPSAALASVGAMLLGVIVTGLFVAISMSSGGAWDNA

SEQ ID NO: 23620 - protein, 276 aa, Oryza sativa
  misc_feature (262)..(262): Xaa can be any naturally occurring amino acid
  misc_feature (270)..(270): Xaa can be any naturally occurring amino acid
  unsure (1)..(276): unsure at all Xaa locations
MGSFASPLDAAPAPPTAKPSPPPAPAPANGLVTQEELKRVAAHRAVEMVEPGMTLGLGTGSTAAHALDRLGDLLRSGELAAVAGVPTSLKTEAHAARVGIPMLPLGEAGGIDLSIDGADEVDPELNLVKGRGGSLLREKMIEGSGGRFVVIVDESKLVPRLGCTGAVPVEVVPFGCDHTLGLVRKVFDGLPGFSARLRTVASKDGEGKEEMFVTDNGNYIVEMFFEDGIRGDLNEISDRLLRITGVVEHGMFLGMATSVVVXKKDGTVAXLLHKKK

SEQ ID NO: 23621 - protein, 600 aa, Mycoplasma mobile 163K
MFKFKFADIGEGLHEGLVAEIYKKEGDMVKEGEALFSVETDKVTSDIPSPATGKIVKVAMAQGDTIHVGQEIYYIDDGSSSQSIEVKPAEIKAEAPKKAGGGASVVGEVAVSDEVMSFGKKTSSTPTSSTSIQPTSFNGKITDKYDVIVLGSGPGGYLAAEEAGKNGKKTLIIEKEYWGGVCLNVGCIPTKALLKSTEVFEQLSHASDYGLDIDVSKLKMNWKKMQERKQKVVNTLVGGVLALMKGNKVKTINGEAKFLAPKVVQVNGEIYEAENIIIATGSKNRKLTLPGFEEAYKSGFAITAEEAIQIESLPKELVIIGGGVIGIEFAQIFAASGSKVTVIQNAPTIIPALDEDVIKVLSDKLISSGIQIVYNAETVKIEKDTLHYKVNGEAKTIKASKIMVSVGRIPVIANAKEVGYQIGEKGEIVINEFCQTNIPGAYAIGDVTFKTMLAHVAYQHAHIAIKHLLGNGDLSYTGKTVPACIYTHPEIASVGMSERQAKESGRAYISEKHQMKFIGKAIASDQTMGFSKLIIDKETHEILGAHIIGAHATDLISELVVAIDLETTVHEIANAIHPHPTFSEIIWENARTASHKLKKK

SEQ ID NO: 23622 - protein, 857 aa, Streptomyces filamentosus
MIFVPSAGSLIRAEDRQDGGVTLIDQLPQTADPDALFEAFSSWTESQGITMYPAQEEALIEVVSGANVILSTPTGSGKSLVAAGAHFTALAQDKVTFYTAPIKALVSEKFFDLCKLFGTENVGMLTGDASVNADAPVICCTAEVLASIALRDGKYADIGQVVMDEFHFYAEPDRGWAWQIPLLELPQAQFVLMSATLGDVSMFEKDLTRRTGRPTSVVRSATRPVPLSYEYRFTPITETLTELLDTRQSPVYIVHFTQAAAVERAQSLMSINMCTKEEKEKIADLIGSFRFTTKFGQNLSRYVRHGIGVHHAGMLPKYRRLVEKLAQAGLLKVICGTDTLGVGVNVPIRTVLFTALTKYDGNRVRTLRAREFHQIAGRAGRAGFDTAGFVVAQAPEHVIENEKALKKAGDDPKKKRKVVRKKAPEGFVAWSESTFDKLIQSEPEPLTSRFRVTHTMLLAVIARPGNAFEAMRHLLEDNHEPRRAQLRHIRRAIAIYRSLLDGGVVEQLDTPDAEGRIVRLTVDLQQDFALNQPLSTFALAAFDLLDAESPSYALDMVSVVESTLDDPRQILAAQQNKARGEAVGQMKADGVEYEERMERLQEVTYPKPLSELLWHAYDVYRTSHPWVNDHPVSPKSVIRDMYERAMTFTEFTSHYELARTEGIVLRYLASAYKALEHTIPDDVKSEDLQDLISWLGEMVRQVDSSLLDEWEQLANPEVETAEQAQEKADEVKPVTANARAFRVLVRNAMFRRVELAALDRAGALGELDGESGWDEDAWGEALDAYWDAHEEIGTGPDARGPKLLKIEEDPAHGLWRVWQAFADPAGDHDWGIKAEVDLAASDEEGRAVVRVTEVGQL

SEQ ID NO: 23623 - protein, 326 aa, Mycoplasma mobile 163K
MAKIKVNNIEAVTNALEIMMEKDKDVVLWGEDAGYEGGVFRATKGLQAKFGDKRIFDAPISEAAIAGVGVGAAIYGLKPVVEIQFSGFSFPAMMQLFTHAARYRNRSRGRFTVPMVVRIPMGGGIRALEHHSEALEALYAHIPGLKVILPSTPYDTKGLLIAAIKDPDPVIFFEPKKIYRAFKEEIPAEEYEVEIGKANVLTEGTDITLVTYGAQVHDSLAAIRELGSEMSVELIDLRTIKPLDIDTILESVKKTGKLIVVHEAVKSFSVSAEIITRVNEELFEYLSAAPVRLTGYDITVPLAKGENFFVISKEKIIAKLRELKAE

SEQ ID NO: 23624 - protein, 434 aa, Solibacter usitatus Ellin6076
MSFGGSRVATSTLPVSISLENEKNPWLAAAARFEEAAKRLKLDDGMRKVLGTPSKELTVHIPVQLDDGRIEVFTGYRVQHSVARGPAKGGIRFAPDVTLDEVRALASWMTWKCAVVNIPFGGGKGGVICDPHILSDTELEKLTRRYTAEIIDFIGPERDVPAPDVNTNEKVMAWMMDTYSMHARHTVTAIVTGKPMALGGSRGRPEATGRGCMMVTQRALNRMGKRPEDTSVVIQGFGNVGGMAAKLMSAVGFKIIAIVEYDGAAYNPNGLDIAALQLHRKETGSITGFSGGEDMDKTEAMFLECDVLIPAATENVITSQNAHRVRCRILCEGANGPTTPLADDILAEKKVFVIPDILANAGGVTVSYFEWVQDRQGFFWNEQLVNERLQEIMDESFDAIVAYAEAHQVNNRIAAYMVALDRVAQAIKLRGIYA

SEQ ID NO: 23625 - protein, 1099 aa, Arabidopsis thaliana
MADSKSGDTEVAHRSSDPSEKRGGWITLPFMLVTLLGMSITSFGWGMNLIVFLIEEFHIKNIAAAQISNVVNGVVNMLPVVAAILADSFFGNIPVISTSTFISLAGTSLLTLITSLNYLMPRPCETGSILCQSPSKLQLGILYVALALVIIGSAGTRFTLAAAGANQYKKPKEQGRFFNWFFLALYIGAITGTTAIVYTQDNASWKLGFGLCAVANLISFIVFIAGVRFYKHDKPLGSPYTSLIRVLVAATMKRKAVISSKDEDYHQYGLGKEAKTYTTMPSKSFRFLNRAALKNKEDLNTSGDSSNNMWRLCSVQEVEDFKAILRLVPLWAAVMFLSTPVAVQMSMTVLQALVMDRKLSPHFEVSAGSLQVIVLVFGCVFIMLNNWIIYPMYQKLIGKPLTPLQQVGIGHVFTILSMAISAVVEAKRLKTVENGGHPMSVLWLVPALVMVGIGEAFHFPANVAVFYGEFPESLKNTATSLTSVVIGISFYLSTAVIDVIQRTTSWLPNDINHGRVDNVYWVVVIGGVLNLGYFLVCSWFYKYRNLKDDDHEQDPKDMQHRVITKCFWVLFGAATLLGISVTSYGWVLNLIVFLIEEYNIKSIAAAQISNIVNGCLSMLPVVTAILADSFFGNIPVISASAFISLLGIFLLTLISSFENLRPRPCETGSILCQSPSKLHLGVLYAALALVTAGTSGTRVALASAGANQYDKPRDKGSFFNWYFLTVNTGAIISATAIVYTQENASWRLGFGLCAAANLISFIVFISGKRFYKHDKPMGSPFTSLIRVLVAAILKIKVVTSSKEEDYHREVEKESKTCIGMPSKSFRFLNRAALKSEKDLNQEDGLCHNPWRLCSVEEVEDFKSVLRVLPLWLAILFVGTSIGVQASMTVLQALVTDRGLDSKFKVPAGSLQVIVLISSCVFLVLNNWTIYPIYQKITHKQLTPLQQVGIGQVFNILSMAISAIVEAKRLKTVENEHPMSVLWLLPPLVIVGIGDAFHFPANVAVFYGEFPESMRNTATSLTSVVIGISFYLSTAVIDVIQRTTAWLPNDINHGRVDNVYWVVVIGGVLNLGYFLVCSWFYKYRNLKDDDHEQDPKDVTT

SEQ ID NO: 23626 - protein, 376 aa, Streptococcus thermophilus LMG 18311
MTKLFSNYKRAAIDFASAQGNYLTDTTGKTYLDFSSGIGVTNLGYHPRVNQALTDQVGNILHQPNLYYNQLQEDVAGLLTGDKDYLAFFCNSGAEANEAAIKIARKASGKQEIITFQNSFHGRTFGSMSATGQDKIKQGFGEGVPHFSYAIFNDMDSVKALANKETSAIMLELVQGESGVQPADKAFVKALSDYCQETGIYLIVDEVQTGIGRTGKLFACEHYDIEPDIFTLAKGLANGVPVGAMLAKSSLGGAFSYGSHGSTFGGNKLSMAAAKATLEVMLTPDFLDTALENGNKLQVKLQEVLSDKETVTTVRGLGYMIGIETTGNLSELVQAARDKGLIVLTAGTNVIRLLPPITLSDAEIEKGVAILSEIFD

SEQ ID NO: 23627 - protein, 475 aa, Streptomyces filamentosus
MNHPVNGAGERRTTQAREGTQTVAPPRILVVGAGFAGVECVRRLERRLAPGEAQITLVTPFSYQLYLPLLPQVASGVLTPQSVAVSLRRSRRHRTRIVPGGAIGVDTQAKVCVIRKITDEIVNEPYDYLVLAAGSVTRTFDIPGLLDNARGMKTLAEAAYVRDHVIAQLDLADASHDEAERASRLQFVVVGGGYAGTETAACLQRLTTNAVKHYPRLDPRLIKWHLIDIAPKLMPELGDKLGQAALEVLRKRNIEVSLGVSIAEAGPEEVTFTDGRVLPCRTLIWTAGVAASPLVATLGAETVRGRLAVTPQMRLPGADGVFSLGDAAAVPDLAKGDGAVCPPTAQHAMRQGRVLADNLIASLRHEPLKDYVHKDLGLVVDLGGTDAVSKPLGIELRGLPAQAVARGYHWSALRTNVAKTRVMTNWLLNAVAGDDFVRTGFQSRKPATLRDFEYTDVYLTPEQIKEHTAATVIKH

SEQ ID NO: 23628 - protein, 801 aa, Vibrio sp. Ex25
MKFSESWLREWVNPAVTTDELTHQITMAGLEVDDVLPVAGSFTGVKVGHVVECGQHPDADKLRVTKVDVGEEELLDIVCGAPNCRQGLKVAVATVGAVLPGDFKIKKAKLRGQPSHGMLCSFTELGIDVESDGIMELAEDAVIGTDFREFLGLDDVTVDVDLTANRADCFSIRGLAREVGVLNRADVTEPSVEAVAPSIDDKVSIEVKAPAACPRYLGRVVKNVNVQAETPLWMQEKLRRCGIRSIDPVVDITNYVLLEQGQPMHAFDLAKIEGGIVVRMAEQGEKLTLLDGSEAELNADTLVVADHNKALAIAGIFGGEESGVTTETKDVLLECAFFAPDHIRGRARSYGLHTDSSMRFERGVDYALQVSAMERATQLLVEICGGEVAPVVAVESEADLPKPNKVALRRTKLDNLLGHHIADADVVEILERLGLTVEASEEGWVAVAPTWRFDIAIEQDLIEEVGRIYGYDNIPNQHPAAALKMHNHVEADLPLKRVRDLLVDRGYHEAITYSFVEPEQQKLVVPGVEPLVLPNPISADMSAMRLGLIQGLLNTVVHNQKRQQPRVRLFEYGLRFIPCESAENGMRQEPMLAGVIAGTRGEEHWDIETNTVDFFDLKGDLEAILELSANEKAYSFAALSPESKKANPALHPGQSAAIIVDGKEVGVIGTVHPELERKFGLNGRTIVFEIEWSAINSKVIPEAVQLSKFPSNRRDIAVVVDEAVASGDIVNACLEQGGEFLKDAKLFDVYVGKGVEEGKKSLAIALTLQSVERTLEDADIAGAVDAIVAHVSEKFGASLRD

SEQ ID NO: 23629 - protein, 305 aa, Streptococcus suis
PCYPGSELGIVSDDVFAWEEYPLSVAVIGAGYIAVEMAGLIHGLGVQTDLFVRGNRPLRSFDTYIVDALMEEMQRTNLPLHTGKTPVSLEKTDDGQIQINFADGSNHIAQKVLWAIGRKPNIDKLNLKATSVQLTSSGHISVNEYQETAVPGIYALGDVTGEKELTPVAIKAGRLLAERLFNNKPTAKMDYTTIPTVVFSHPAIGTVGLTEDEAITQYGQDNVKVYTSAFTSMYTALENNRQMAKFKLVTVGENEKVVGLHGIGYGVDEMIQGFSVAIKMGATKEEFDAVVAIHPTGSEEFVTMR

SEQ ID NO: 23630 - protein, 142 aa, Triticum aestivum
GLIKDKKTSKIKKNSVAVTKFLDDLAKIDFPGAKLVSDAVAKSGTTPLSPAIVFILDKVAPFVPAPKEEPKAEPEAAAPAEETTTREVAVEEKEEEAEPSAAPAEAAPVEAAAPAAEVVEEKKEEEKPAEAAAPAAEEPEKK

SEQ ID NO: 23631 - protein, 510 aa, Acinetobacter sp. ADP1
MSTSDQIASFDVLIIGAGISGISAAYHLKKNRPNDTFAILEGRNAIGGTWSQFKYPGIRSDSDMPSFGFGFKPWTHKKAIAQASVICDYLQETIQENDISKHICFGYHVNQAEFSSEEQLWTITAVKLEDKSIVSFKARFLLLNTGYYDYQEGFSPKFEGTEKFKGQIIHPQHWPENLDYSNKKVVVIGSGATAVTLLPSMAGKAQHVTMLQRSPTYMVSFPAVDPIACMLNKLLGYEKAYPIIRKKNIALNRALYKACRNYPQVMKKLLLADVRRRLPKGYDVDTHFTPRYNPWDERLCLVPDGDLFKSISEGKASVVTDRIKQFTQDGILLESGKNLDADIIVTATGLNMLAFSRIQLSVDGKEVQYPDTTIFKSMMLSDVPNLAFAFGYTNIAWTLKVDLAWEHFCRLLDYMDANGYSIFKPVVHNPAMKRVPFIDLSPGYVQRGLAQFPMAGTEGPWTLQHAYEHDFERLRNGPVFDKELQFTNIAQKNKLTVVKGTCAKPLKAQA

SEQ ID NO: 23632 - protein, 352 aa, Thermoanaerobacter ethanolicus
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELAEIELGATVAVLGIGPVGLMAVAGAKLRGAGRIIAVGSRPVCVDAAKYYGATDIVNYKNGPIESQIMDLTEGKGVDAAIIAGGNADIMATAVKIVKPGGTIANVNYFGEGDVLPVPRLEWGCGMAHKAIKGGLCPGGRLRMERLIDLVFYKRVDPSKLVTHVFQGFDNIEKALMLMKDKPKDLIKPVVILA

SEQ ID NO: 23633 - protein, 1083 aa, Rhodopirellula baltica SH 1
MPRRDDIKKILLIGSGPIVIGQACEFDYSGTQACKALREEGYEVVLVNSNPATIMTDPATADATYIEPLTWQIVEKVIAKERPDALLPTLGGQTGLNVAMDLDANGVLEKYGVEMIAANAKVIAKAEEREQFKQAMDKIGLDVCKGFTVRTLADARKALAEVGLPAVVRPSFTMGGSGSAIAYNKDDFDSLVQNGLDQSPVTEVLIEESIIGWKEYEMEVMRDCDDNVVIICAIENFDPMGVHTGDSITVAPAQTLSDKEYQRMRDASLAVIREIGVETGGSNIQFAIEPDTGRMIVIEMNPRVSRSSALASKATGFPIAKIAAKLAVGYRLWELPNDITQKTKACFEPTIDYVVTKMPRFAFEKFPEADATLTTQMKSVGETMSIGRTFQESFQKALRGLEVGAFGFGSDPKDLWGTEDQPSRDEIRAKLSTPGSERVFYIRYAFKDGMTAAEIHSLTNIDPWFLDHLQQLIETEDNLRAIGKLDAIDVDTMRDAKRRGFSDRQIATITSKTESQVRAKRLEMGIRPVYKSVDTCAAEFEAFTPYYYSTYESETEVPAKGDKKRVVILGGGPNRIGQGIEFDYCCCHASFALQEMGIESIMVNSNPETVSTDYDTSDILFFEPLTIEDVLNICDAMQPDGVIVQFGGQTPLNLARGLEQAGVPIIGTSVDTIDTAEDRELFSSLIDELGLRQPPSGIARNMDEARVEAKRIGYPALVRPSFVLGGRAMEICYDHSQFARYVAEAFIVADGQPVLIDRFLEDATEVDVDAISDGNDCVIMGIMEHIEEAGVHSGDSACCIPPFSLTQPVLAEIRDATRKLAARLNVVGLMNIQFAVKMEGTQPTLYILEVNPRASRTVPFVAKATGVPVANLATKVMAGKTLKELNVTEEPIPRHVSIKESVLPFRKFAGVDIVLGPEMRSTGEVMGVSELFSIAFAKSQLAAGTVLPESGKIFLSLSANHKEAAESLGKSLIELGFELLATEGTAVRLEANGIAVTRVKKLSEGHPNLIDYLKNDDVQLILNTPSGKGARTDEGKIRAAGVQHGVPCITTLAAAEAAVRAMVAMRDTPMEVESLQRRYAQNV

SEQ ID NO: 23634 - protein, 683 aa, Mesorhizobium loti MAFF303099
MSRTFSRALPSPQTPTFGGTMTSREQHDRMANAIRFLSMDAVEKAQSGHPGLPMGCADIATVLFTRFLKYDPKAPHWPDRDRFILSAGHGSMLLYSLLHLTGYEDMTIDQIKHFRQLGSKTAGHPEYGHATGIETTTGPLGQGLANSVGFALGERIMNAAFGNDLVSHYTYVLAGDGCLMEGVSQEAIALAGHLKLNKLIVFWDNNNISIDGPVSLADNTDQVARFQASGWNASHIDGTDPEAIAYAIEAARHSDKPTMIACKTTIGFGAPTKAGTNKAHGSPLGADEIAGARKFFNWESPPFEIPADILDAWRTAGKAGAKPRADWEGRLAKAEPKLKAEFERRLAGKLPSNFDAVIADYKKKLSADKPKVATRKSSEMALEVINGAVPETIGGSADLTGSNNTKTSQTKNITPDDYGQRYVHYGIREHGMAAAINGLTLHGGLIAYGGTFMCFSDYARPSMRLSSLMGIRSIFVMTHDSIGLGEDGPTHQPVEHLAALRAIPNHNVFRPADAVETAECWQIALESEKTPSTLALTRQNLPTVRIEHSAKNLSSQGAYELAAASGEAAVTIFATGSEVEIALGARDLLEKHGHPTRVVSVPCFELFDKQSDDYRKKTIGNAPIKMAIEAGIRQGWDHLIGSDGIFVGMTGFGASGTIEQLYPHFGITAEAAAKAAEARLHAK

SEQ ID NO: 23635 - protein, 104 aa, Zea mays
MGKGKVHPSPPPAAAAAAAGSEPGKTTADAVLMRLLPAAVLTAAAPLAAEGKEVLAYLVLASLRSSAPPTPTPTPARGDGHPPELGRCCFGCSTAYWSRWDGSP

SEQ ID NO: 23636 - protein, 336 aa, Mesorhizobium loti MAFF303099
MTVRVAINGFGRIGRNILRAIHESGRKDIDVVAVNDLGPVETNAHLLRYDSVHGRFPHEVSVSGDQITVGKEKFKVTAIKDPTQLPWKELGVDIALECTGIFTARDKAASHLTAGAKRVLVSAPADGADLTVVYGINHDKLTKDHIVISNASCTTNCLAPLAAVLHETVGIEKGMMTTIHSYTGDQPTLDTMHKDLYRARAAALSQIPTSTGAAKAIGLVLPDLKGKLDGISIRVPTPNVSVVDFKFIAKRATTVQEINEAVIAASNGKLKGILGVTHHPNVSIDFNHDPRSSIMALDQTKVMDGNFVSVLSWYDNEWGFSNRMGDTAVAFGKTIA

SEQ ID NO: 23637 - protein, 337 aa, Oryza sativa
QWLLVGDGAAAAAAAEPNLVVSFGEMLIDFVPDVAGVSLAESGGFVKAPGGAPANVACAISKLGGSSAFVGKFGDDEFGHMLVDILKKNGVNAEGCLFDEHARTALAFVTLKSNGEREFMFYRNPSADMLLTEAELNLDLIRRAKIFHYGSISLITEPCRSAHVAAMRAAKSAGILCSYDPNVRLPLWPSEDAARAGILSIWKEADFIKVSDDEVAFLTQGDANDEKNVLSLWFDGLKLLIVTDGEKGCRYFTKDFKGSVPGFSVNTVDTTGAGDAFVGSLLVNVAKDDSIFHNEEKLREALKFSNACGAICTTKKGAIPALPTVAVAQELISKAAN

SEQ ID NO: 23638 - protein, 398 aa, Mesorhizobium loti MAFF303099
MAAFKTLDDIGNISGKRVLVRVDLNVPVADGKVTDATRIERIAPTIAELSGKGAKVILLAHFGRPKDGPSPEFSLEPIARATAEVLGRPVGFASDCVGDMAGSAVAAMNKGDVLLFENTRFYKAEEKNDPAFSERLAANGDIFVNDAFSAAHRAHSSTEGLARLLPSFAGRTMQAELEALEKGLGNPVRPVVAIVGGAKVSTKIDLLMNLVKKVDALVIGGGMANTFLAARGTDVGKSLCEHDLAPTAKQIMIEAAEAGCAIILPVDGVVAKEFKAGAACETVAISDVPADGMILDVGEKTVKTIGEWIDRAATLVWNGPLGAFEIEPFDHATVAAAKHAAARTKAGKLVSVAGGGDTVAALNHAGVADDFTYVSTAGGAFLEWMEGKPLPGVDVLKR

SEQ ID NO: 23639 - protein, 342 aa, Mesorhizobium loti MAFF303099
MMSERLEDIAAAIVANGKGLLAADESSGTIKKRFDVIGVESTADSRRDYREMMFRARDAMTKYISGVILYDETIRQKAADGTPLVDIIKASGAIPGIKVDAGAKPLAGFPGDTVTEGLDGLRERLADYYKLGARFAKWRAVIDIDTGKGVPSANSINSNTHALARYAALCQEAGIVPIVEPEVLMDGAHDIGTCYDVSKATLIKLYDELHAARVVLEGTILKPNMVLSGKKSGTVDSPEKVAEMTIKLFRETVPAAVPGIAFLSGGQEDEEATANLNAINAIGPHPWKLTFSYGRALQAAPQKAWSGKASNVAAGQAAFTHRAHMNYLAALGKWKASLEQAA

SEQ ID NO: 23640 - protein, 579 aa, Oryza sativa
  misc_feature (260)..(260): Xaa can be any naturally occurring amino acid
  misc_feature (319)..(319): Xaa can be any naturally occurring amino acid
  misc_feature (335)..(335): Xaa can be any naturally occurring amino acid
  misc_feature (464)..(464): Xaa can be any naturally occurring amino acid
  misc_feature (470)..(470): Xaa can be any naturally occurring amino acid
  unsure (1)..(579): unsure at all Xaa locations
TYTSFDCLGRDSLVMDIPHALFEEKLEAMKAVKGLHNDTDLTATDLKELVAQYKDVYVEAKGEPFPSDPKKQLQLAVLAVFNSWDSPRAIKYRSINKITGLKGTAVNVQTMVFGNMGNTSGTGVLFTRNPSTGEKKLYGEFLVNAQGEDVVAGIRTPEDLDAMRDHMPEPYEELVENCKILESHYKEMMDIEFTVQENRLWMLQCRTGKRTGKGAVKIAVDMVNEGLVERRTALKMVEPGHLDQLLHPQFENPSGYKDKXVFTAEDAEAWHAQGKDVILVRTETSPEDVGGMHAAVGILTARGGMTSHAAVVARGWGKXLPFYTADSCLICCVSXIVVIEDKALHEGEWLSLNGSTGEVIIGKQPLCPPALSGDLETFMSWVDEVRKLKVMANADTPEDATTARQNGAEGIGLCRTEHMFFASDERIKAVRQMIMASSLELRQKALDRLLPRRRSDFEGIFRAXDGLPVXIRLLDPPLHEFLPEGHVEDMVRELCSETGAAQDDVLARVEKLSEVGPMLGFRGCRLGISYPELTEMQARAIFEAAITMTNQGIQVFPEIMVPLVGTPQESGHQVDVIRQ

SEQ ID NO: 23641 - protein, 189 aa, Nannochloropsis oculata
AGGIAEMALQDYPEVREKTDALDAAGNTTAAIGKGFAIGSAALVSLALYGAFAVRVGIRNGVNILSPVTFAFLLIGSNLPYWFSALTMKSVGTAAMEMVMEVERQFRECPELLNEGTTLRPDYTRCVDISTKAALREMVPPAALVMLSPLIAGTFFGKYAVAGVLTGGLVSGVQLAVSMCNTGGAWDNA

SEQ ID NO: 23642 - protein, 203 aa, Nannochloropsis oculata
AGGIAEMSQQPEFVRESTDRLDAAGNVTKAITKGYSIGSASLACFLLFGAFMDEFSQFSGKPFRTVDIAVPEVLIGGLIGTMMVFYFVGLTVAAVGKTAGEVVKEVRRQFRDNPDIMTFKARPDYRSCVALVTRAALQEMVWPGLLATGLPVVVGLVFRGVGAFTDRPLLGAEVLAGYLMFGTVTGIMMALFNRTMGGAWDNA

SEQ ID NO: 23643 - protein, 521 aa, Nicotiana tabacum
MGSVGLLKNSAMVCAPLMAPSVEQLVHGMLQAKAQGADLVEIRLDGINNFQPQKDLQVLLNNNPLPVLIVYRPIWEGNEFEEDDDHIHKQLEVLRWAKELGADYIELDLKIASDFTKKEKPRWSSGCKVIASCFVDNVTSKEDLSQVVAHMQSTGADILKIVTNANDITELEKMFHLLSHCQVPLIAYSLGERGLISQLLGPKFGSVLVYGSLDCNAVPGLPTLGSLRQAYGVDFMDTDTKVFGLISKPVGHSKGPILHNPTFRHVGYNGIYVPMFVDDLKEFFRVYSSPDFAGFSVGIPYKEAVVSFCDEVDPLAKSIGAVNTIIQRPCDGKLIGYNTDCEASITAIEDALKVNGLTNGAAFLPSPLAGKLFVLVGAGGAGRALAFGAKSRRAEIVIFDIDFDRAKALAAAVSGEALPFENLASFQPEKGAILANATPIGMHPNKDRIPVSEASLKDYVVVFDAVYTPRKTTLLKDAEAAGAITVSGVEMFLRQAIGQFHLFTRTKAPEEFMRDIVMAKF

SEQ ID NO: 23644 - protein, 523 aa, Deinococcus radiodurans R1
MIKVQDYRPQPFTDFTKEENVQAYQAALAKVRKELLGKHYPLIIDGQEVDTEGKIQSINPCDTSEVVGTTAKATIGDAENALQGAWKAFESWKKWDMDARARILLKAAAILKRRRLEACALMSIEVGKNYAEADVEVAEAIDFLEYYARSAMKYAGFGSSETTWFEGEENGLMSIPLGVGVSISPWNFPCAIFVGMAAAPIVAGNCVVVKPAEDAGLIAGFMVDILREAGLPAGVLQFLPGVGKEVGEYLTTHAKTRFITFTGSRAVGLHINEVAAKVQPGQKWIKRVIMELGGKDGLIVDETADIENAITAATQGAFGFNGQKCSAMSRLIVVDSVYDEVVNGFVERAKALKMGTGEENANVTAVVNQMSFNKIKGYLELAPSEGKVLLGGEATGEANGKQGYYIQPTIVGDVDRNSRLAQEEIFGPVVAVLRAKDWQDALDIANSTEYGLTGGVCSNSRERLEQARAEFEVGNLYFNRKITGAIVGVQPFGGYNMSGTDSKAGGPDYLSNFMQLKTVTERW

SEQ ID NO: 23645 - protein, 203 aa, Nannochloropsis salina
AGGEISEMSQQPEFVRESTDRLDAAGNVTKAITKGYSIGSASLACFLLFGAFMDEFSQFSGKPFRVVDIAVPEVLIGGIIGTMMVFYFVGLTVAAVGKTAGEVVKEVRRQFRDNPEIMTFKARPDYRSCVALVTHAALKEMVWPGLLATGLPIVVGVVFRGVGAITDRSLLGAEVLAGYLMFGTETGIMMALFLTAGGAWDNA

SEQ ID NO: 23646 - protein, 219 aa, Haemophilus influenzae Rd KW20
MNQLEMKKLAAQAALQYVKADTIVGVGSGSTVNCFIEALGTIKDKIQGAVAASKESEELLRKQGIEVFNANDVSSLDIYVDGADEINPQKMMIKGGGAALTREKIVAALAKKFICIVDSSKQVDVLGSTFPLPVEVIPMARSQVGRKLAALGGSPEYREGVVTDNGNVILDVHNFSILNPVEIEKELNNVAGVVTNGIFALRGADVVIVGTPEGAKVID

SEQ ID NO: 23647 - protein, 189 aa, Skeletonema costatum
AGGISEMAELGPETRAITDGLDEVGNTTAAIGKGFAIGAAGLAALAIIAAFIQVISSQVEGFSLDIGNPKVLMGMFLGGIFPFIVSAMTMRAVGDAAFDMIKEIRRQFKEIPGLMEGKAKPDSKKCVDIATKAALRRMMGPGALAVLAPVVVGFGLGADSLGGMLGGALITCVLLAITMQAGGGAWDNA

SEQ ID NO: 23648 - protein, 307 aa, Leptospira interrogans serovar Lai str. 56601
MIAKSGSNQESNPMFQGVYTAIITPFKNDKIDYDSYFKLLEKQIKAGVSGVVPCGTTGESPTLSHSEHAELIRETVKAVQGKIQVVAGTGSNSTKEAIELTEAACKDGVDGILSVNPYYNKPTQEGLFQHFKSIAEHSTVPVMLYNIPGRTSVNLLPETVLRLSEVKQIRSMKEATGDLGQMGKLISLVGNKMTVLSGDDNLTLPLLAIGGVGVVSVISNLFPKALVQLVESFQQGKISEAKKIHYDFIEVFALAFMETNPIPIKAAMCWFGHCGPEIRLPLTPLSQNETSSKFKKVLEGLKEKGYE

SEQ ID NO: 23649 - protein, 210 aa, Tetraselmis chuii
AGGIAEMAELPSSVRDTTDALDAVGNTTKAVTKGYAIGSAGLGALVLFAAYNEDLKYFIANATEGSFFYGMGAVDFSIANPYVVVGLLFGGLLPFLFGGMSMMAVGRAAQAVVEEVRRQFREKPGIMTYDEKPDYGRAVDILTSAAIKEMIVPSLLPVLSPIVPVLCDLGYCWTHLLHLRTVGAMLLGVIVTGLFVAISNDSVGGAWDNA

SEQ ID NO: 23650 - protein, 362 aa, Haemophilus influenzae Rd KW20
MQPTLFIDRDGTLIDEPKTDFQIDSLEKLKLEPKVIPALLRLKAKYRFVIVSNQDGLGTDAFPQTDFDKPHNVMMALFESQGITFDEVLICPHKPEENCLCRKPKIKLLDHYIRKNLFDIDRSFVIGDRETDVQLAENLGIRAIQYDPQKMNWDLIAEKLLGETVTNCGKRPPRFAEVIRQTKETDIKVQVWLDEAGVNEIKTGVGFFDHMLDQIATHGGFRMNVQCKGDLWIDEHHTVEDTALALGQALKQAVGDKRGIARFGFVLPMDECKAECALDLSGRPWIKFNACFKRDKVGDFSTELTEHFFQSLAFSMLATLHLNVTGNNDHHKIESLFKAFGRTLRQAIRIEGNEMPSSKGVL

SEQ ID NO: 23651 - protein, 500 aa, Zea mays
  misc_feature (191)..(191): Xaa can be any naturally occurring amino acid
  unsure (1)..(500): unsure at all Xaa locations
MAAANLLSRSLLPTPNTIRTSHPTPRSPAVVSFPRRRARLSVCASVSMASPSPPPQPAAAGVPKHCFRRGADGYLYCEGVRVEDAMAAAERSPFYLYSKLQILRNFAAYRDALQGLRSIVGYAVKANNNLPVLRVLRELGCGAVLVSGNELRLALQAGFDPARCIFNGNGKTLEDLKLAAESGVFVNVDSXEFDLENIVRAARATGKKVPVLLRINPDVDPQVHPYVATGNKTSKFGIRNEKLQWFLNSIKSYSNEIKLVGVHCHLGSTITKVDIFRDAAVLMVNYVDEIRAQGFKLEYLNIGGGLGIDYHHTDAVLPTPMDLINTVRELVLSQDLTLIIEPGRSLIANTCCFVNRVTGVKSNGTKNFIVVDGSMAELIRPSLYGAYQHIELVSPPTPGAEVATFDIVGPVCESADFLGKDRELPTPDEGAGLVVHDAGAYCMSMASTYNLKLRPPEYWVEEDGSIVKIRHEEKLDDYMKFFDGLPVDVIVTLGDVSGNN

SEQ ID NO: 23652 - protein, 218 aa, Rosa rugosa
NGLLKKAYELSILCDAEVALIIFSNRGKLYEFCSSSSILKTLERYQKCSYGAMEVNEPAKELEQSSYREYLKLKTRCESLQRTQRNLLGEDLGPLNTKELEQLERQLESSLKHVRSTKTQYMLDQLSDLQSKEHMLIEANRDLTMKLDEINSGTQLRQTWERGHAHQTMLYGTQHAQTQGLMFQPLDCNPTLQIGYNAVGSQQMTAATPAPTQPVNGF

SEQ ID NO: 23653 - protein, 352 aa, Mycobacterium smegmatis str. MC2 155
MSSFRVPAIDISPYVTQGSASSRAAVAEAMDHACSTVGFVQIHGHGIDPGVIAGLTDAADAFFGLPLAEKNRWRRPASENRGYSPPKSESLRLSLDAASTNNMNDFFEAFNVGRSLDDYPNVPDDVRHHYATNTWPDVDGFDSAVWAYFGEAERVATTMTTIFADALHLPVDYFTSRTGHSVNTLRINNYALPEDTRVPTDGELIGMGEHTDYGIVTVLWADQAPGLQILGSDGAWHDVRPDDGALLINLGDLTARLTNERWLSTLHRVRPPVVDGRVQRRRSAAFFFDANADAVIAPHPSFVDASRPALYEPVTVDEHLRAKLADSRIGIPNTAAERESARLHASSSSGAQ

SEQ ID NO: 23654 - protein, 224 aa, Methanococcus maripaludis S2
MHFVDVLNIGKDIIKANNKNADKNRKILEDHGIVAFDFMGAIGSGKTLLIEKLINELKDEYKIACIAGDVIAKYDAGRMEKHGVKVIPLNTGKECHLDAHQIGHCFHDLDLDNLDIIFIENVGNLICPTDFDLGTHKRTVVVSVTEGDDTVEKHPEIFKTANLTIINKIDISEAVGADPQKMLNDAKKINKDMEVLLTAIKHDNGVSDVVNFIKKTIEEVKAQK

SEQ ID NO: 23655 - protein, 509 aa, Triticum aestivum
  misc_feature (445)..(445): Xaa can be any naturally occurring amino acid
  misc_feature (457)..(457): Xaa can be any naturally occurring amino acid
  misc_feature (487)..(487): Xaa can be any naturally occurring amino acid
  misc_feature (489)..(489): Xaa can be any naturally occurring amino acid
  misc_feature (491)..(491): Xaa can be any naturally occurring amino acid
  unsure (1)..(509): unsure at all Xaa locations
ASGTTSAYITVIVLLLGAVCSGLAGYVGMWVSVRANVRVSSAARRSAREALRMAGRAGGFSAIVVVGMAVFGVALLYATFYVWLGVDSPDSMKVTDLPLLLVGYGFGASFVALFAQLGGGIYTKAADVGADLVGKVEQGIPEDDPRNPAVIADLVGDNVGDCAARGADLFESIAAEIISAMILGATMAQRCKIEDPSGFILFPLVVHSFDLVVSSVGILSIRGTRDSGLISPIEDPMAIMQKGYSITILLAVLTLGGSTRWLLYTEQAPTAWFNFAWCGLVGIITAYAFVWISKYYTDYKHEPVRLLALSSSTGHGTNIIAGVSLGMEATALPVLVISIAIISAFWLGRTCGLVDELGNPTGGLFGTAVATMGMLSTAAYVLTMDMFGPIADNAGGIVEMSQQPESVREITDILDAVGNTTKATTKEFAIGSAALASFLLFSAYXEVAAFAQLPFKXEVDIAIPEVFVGGLLGSMLIFLFSGWGLFXLXAXTAQRLLLKGQDFIRAWLL

SEQ ID NO: 23656 - protein, 279 aa, Triticum aestivum
NMFVYVFKTGQLAIIALVTMSVFLRTRMTISFTHANYYMGALFFSIFMIMLNGIPEMSMQIGRLPSFYKQKSYYFYSSWAYAIPASVLKVPISILDSLVWISITYYGIGYTPTVSRFFCQFLILCLLHHSVTSQYRFIASYFQTPIVSFFYLFLALTVFLTFGGFILPKTSMPGWLNWGFWISPMTYAEISIVINEFLAPRWQKESIQNITIGNQILVNHGLYYSWHYYWISFGALLGSILLFYIAFGLALDYRTPTEEYHGSRPTKSLCQQQEKDYTI

SEQ ID NO: 23657 - protein, 411 aa, Arabidopsis thaliana
MGILNDDAVLIEPGKISGDPTVVTVNCPDESGLGSTLCRIILEFGLSITRADFSTDGRWCYIVFWVTPDISSPKIDWDSLKNRLLSACPSCLGSFYFCLQSNVSKPPSLYLLKFFCRDRKGLLHDVTKVLTELEFTIQRVKVMTTPDGRVLDMFFITDAMDLLHTKQRQTKTCDHLTAVLGEHGVSCELELAGPELESVQRFSSLPPLAADELFGPDGFDISGSSSNKAVLTVDNQLSPAHTLLQIRCVDQKGLFYDILRTSKDCDVHIAYGRFSSKVKGYRNLELFVRGTDENKIMDPKHQANFCARLKEEMVCPLRVIIVNRGPDTELLVANPVELSGKGRPRVFYDVTLALKSLGICIFSAEIGRHSTLDRQWEVYRFLLDESREFPLASLRARNQVVDRVTKTLMGW

SEQ ID NO: 23658 - protein, 330 aa, Yarrowia lipolytica CLIB122
MSLENPNTLPFNDPETSPKTALVTGASSGIGWYTTLHLYMHGWDVFLGVRNVLKGQKAIDDIKAEAQKRQLDGSIPATAKFGQLAIVEMDLLDIKSLDKVEAQLQNTEKLDLLIHNAGIMAVPRENSKDGWEVQMQTNYVAPFVLTDRLLDLLQKAPKPRIVYLSSIGHHFAMKPAPLDKRQDGFPGLYYGFVRYGYSKTAGMQLINQLAKDYPHILSMSVHPGFVMETELYRHWNSLPLVGPLFNLGFRSFGVVFGVSKEEGCYSTLVAALSPNLTAPTDSGEFLWTKGSEGNPSSLVKDEKYALKNWNWTVDQMEQKNVRIRHFQHKR

SEQ ID NO: 23659 - protein, 435 aa, Oryza sativa
MASSGCSSNRLRQTIVVALLLLASSSCLASAKHRGNGTTTTVPFHGKDELRRYRKIMAQSPDGDVIDCVPAHLQPAFEHPKLRGQKPEAEPEERPKVGGAAAAEAEEEAVFPQAWTDGGESCPEKTVPVRRTRRRDVLRSSSAVRFGMKQPRAAGVVRRDSTSDGHEVSQSTNSPVTGELAVGKLALHHAVGYVTGDQFYGAKASLNVWSARVATAAEFSLSQIWVISGSFGNDLNTIEAGWQVSPELYGDNNPRFFTYWTTDAYQATGCYNLHCSGFVQTNNRIAIGAAISPTSVYNGRQFDISLLIWKDPRRGHWWLQLGSGPLVGYWPSSLFTHLGGHANMVQFGGEVVNTRPSGSHTPTQMGSGHFPREGFNRAAYFRNLQVVDWDNNLLPAAALRLVADHPSCYDIQGGYNRAWGNYFYYGGPGRNVRCP

SEQ ID NO: 23660 - protein, 121 aa, Synechococcus sp. PCC 7002
TNHAPAPVGPYNQAIAASGKMLFCSGQIALDPATGQIIEGDVQAQTKQVMANLAAVLKEAGATWENVVKTGVFLKDMNDFAAVNAVYATYFDEATAPARACVEVARLPKDVLVEIECIAVL

SEQ ID NO: 23661 - protein, 540 aa, Oryza sativa (japonica cultivar-group)
MATGPRRWPAGDHDDPWDVTVTLAELRGTLVVAHDDHRAGVLDLWFLLAGDGDGGKVGPQHWTKLYTVTMPYHALGLPLPWDAESAEPAVVLVDDGRVVFWVWANGSSEHGRGVIRVYDPATGGQTDVAAMVPVGGCYRLIDIPMSNCINSKINKIYVLTQFNSQSLNRHIARTYNIGEGVGFGDGFVEVLAATQTTGESGKRWFQGTADAVRQFLWLFEDARLKRIENILILSGDHLYRMDYMDFVQKHVDKGADISVACVPVDESRASDFGLMKTDKNGRITDFLEKPKDESLKSMQLDMGTFGLRPEVADTCKYMASMGIYVFRTDILLRLLRGHYPTANDFGSEVIPMAAKDYNVQAYLFDGYWEDIGTIKSFFEANLALTDQSPNFYFYDPVKPIFTSPRFLPPTKVENCKVLNSIVSHGCFLTECSVDRSVIGVRSRLEPGVQLKDTMMMGADYYQTEAERFSELSDGKVPVGVGENTIIRNCIIDKNARIGKNVMIMNSQNVQEAERPLEGFYIRSGITVVLKNAVIPDGTVI

SEQ ID NO: 23662 - protein, 272 aa, Oryza sativa (japonica cultivar-group)
MGHLQFLFTLLGMGRRSWCRGTVPLDGRFIRRCKQGCLQFVILKPILVVITFILYAKGKYEDGNFSVNQSYLYITIIYTISYSMALFALALFYVACRDLLQPYNPVPKFIIIKSVVFLTYWQMLIAAIGHQFAFSYKEYAGSNARPFGGFRGSLFHALKFNDFYHDTVHQFAPTYHEYVLYSNEEEDEPTKYSSASVVSTVQDIQLVEVSVVDSKAPLASVILTHEADKTMPSHGMEETVAPSEPYDLSNLVDVELSNYSAEVPAIPDVGKQ

SEQ ID NO: 23663 - protein, 475 aa, Oryza sativa (japonica cultivar-group)
MNAAAAAPAPTMNFAAIHSVWHDNFDAESAQLLAVAPRAVHVAVSVQYPGCAVAQAGTSGRKKYGSLTAEKRYDMVKANIDELHPIQVGLAIRANDDDGDSGELVVFEFNLRGFDINNPADLRDPASIAHLRGRGVDFGRLPCAGVEPHRLRLLLLGSGLLQAWPSWATFTGAYHVGYLMKILTGAELPSGLDAFTTMATGTLGEGVYDVKRLAAEVNTACGFSLREIAACIGVVPVAAQHGMVASAGAVSTLQCFKALRERLGQLQGRVRHPTLRRAARPPRRAYINVQYPGCPVPGGEPRPFEQLTAEQRYGVLKANVDALRAIQVGLAIRTGDGGGEAFVFESNLNGFDVGNLDLPRQRDARSIAHLRCEPAASTSPEAAARRRRLATFAVGYHVAYAVKLLTGRDRAPGQLDGFTRLVASIFVRRVYDVKRIAREHEPVHVGALTSLAERLGVFIVYLYDIYIRLGMGCHA

SEQ ID NO: 23664 - protein, 463 aa, Triticum aestivum
  misc_feature (166)..(166): Xaa can be any naturally occurring amino acid
  misc_feature (187)..(187): Xaa can be any naturally occurring amino acid
  misc_feature (310)..(310): Xaa can be any naturally occurring amino acid
  misc_feature (366)..(366): Xaa can be any naturally occurring amino acid
  unsure (1)..(463): unsure at all Xaa locations
LLEQVCTKKHSRTGPEFPGYRRPTRPPTSGLDARAAAIVMRAIKNVADTGRTVVCTIHQPSIDIFEAFDELMLMRRGGELIYAGPVGHHSCEVIQYFQAIPAIPRIKDKYNPSTWMLEVTSTSMEAQVGADFVQMYRASSMCKDKDMLVKRLSVPVPGTSDLHFPXTQFPQKFREQFKACLWKQCLXSYWRTPSYNLVRLASMLGFCIFFGALFWQRGNINHINDQRGLFTILGCMYGITLFTGTNICQAVMPFVSIERSVVYRERFAGMYSPWAYSFAQVAMEIPYVLAQVVMFMLIAYPMIGYAVDTXAKFFWFMYTMSCTLLYFVYLGMMIVSLTPNIQLAFVLTSVCHGLQNLISGFLVPCXPKYRRWWVWLYYISPMSWSLNVFLTTQFGDYNDSMIVVFGETQSIATFVKDYYGFRRDLLPLAAVVLAAFPVVFAVLFGYSISKLNFQRRYTHMYSK

SEQ ID NO: 23665 - protein, 210 aa, Phaeodactylum tricornutum
AGGIAEMAECEPEVRERTDKLDAVGNTTAAIGKGFAIASAALTALALFSAFMKVANVSSIDVSQPKIMAGLLVGAMLPFVFSALSMNAVGRAAMAMIEEVRRQFRDIPQLKAALEVMRAVDSDMSKATPAQREIFDAADGYAEYDKCVDISTKASIREMVLPGLLAIVVPVAVGFIGGAEMLGGLLAGVTSAGVLMAIFQSNAGGAWDNA

SEQ ID NO: 23666 - protein, 547 aa, Ashbya gossypii ATCC 10895
MTLVDKLLLRNIEYKGTAYDYFPKVYNVYLVAVVACISGMMFGFDISSMSSMQDFEPYKDYFKHPNELTQGGITASMAAGSLLGSILSPGISDAFGRRVSLHMCSSLWIIGAVLQTAAQNQAMLFVGRIVAGLGVGFGSSVAPVYTAEVSPPKIRGAVGGLFQLSVTVGILVMFLIGYGSVSLNSVASFRVAWSMQLVPGVVLLLATFLLPESPRWLANHGRWDETTLVVEKVGRSVNVSDEELRIHINEIRERVALDEMARDFTYADLFRRKTQRKIFIGMAAQMWQQLCGMNVMMYYIVHVFKMAGFSGNQNLVSSIVQYVLNVGMTIPSLFLVDRAGRRPVLIIGGVLMFTWLYAVAGILATYSVPRPNGVEGNTTVRIEIPPERSSAAKAVIVCSYLFVCSFAPTWGIGIWVYCAEIFNNIERARGSALCTSVNWAFNFALAMFVPTAFKNITWRTYIIFGTFSVALTIHAFLSFPETKGKTLEEIDEMWDAHIPAWRTASYKPELAQMAAPKLSSGSISDATGGLHEKKAAAGSPGASAGSS

SEQ ID NO: 23667 - protein, 551 aa, Archaeoglobus fulgidus DSM 4304
MNVVVIGGGAAGLKAASRIRRKDGDASITVVEAGKYVSLGRCGLPYYVGGLVHEVDNLRETTYGAVRDEAYFKKLKNIDVLTETVATEIDRSRKTVKIVRNGSEDELNYDYLVIATGARPAKPPIEGIEAEGVVTLTSAEEAEKIIEMWEEGAEKAVVIGAGFIGLESAEALKNLDMEVTVIEMMDRVAPAMLDREMAVLVENHLREKGVNVVTSTRVEKIVSQDDKVRAVIANGKEYPADVVVVATGIKPNSELAEKAGLKIGETGAIWVDEYMRTSDESIYAGGDCVETTCLVTGKKIIAPFGDVANKQGRVIGENITGGRAVFPGVIRTAIFKVFDFTAASAGVNEQMAKEAGLDYFTVIAPSPDRAHYYPQANYIRLKLIVEKGSWRVIGAQGVGMGEVAKRIDVLSTAIQAGMTIDQLANLDLAYAPPYSPALDPVITIANVAMNKRDGLFEGINVFELKEKLEKEDIVILDVRSEEEFKTRRIESEKVIHIPILELRERLDEIPRDKEIVVVCAIGLRSFEASRILKHAGFEKVKILEGGMAFWF

SEQ ID NO: 23668 - protein, 103 aa, Glycine max
MASSADPWVREYGEAARLADDVASMVADRAALPQSGPEVMRHTSAIRRKITILGTRLDSLEGMLARLPPKSITDKELNKRRDTLSNLKSRAKQMAESFNMSTF

SEQ ID NO: 23669 - protein, 447 aa, Ashbya gossypii ATCC 10895
MGRSWGLLWMACLLYGVFTECRRSSQHAHTGKMSLSSKLTVKDLSLAGKRVFIRVDFNVPLDGKTITSNQRIVAALPTIKYVLEQGPKAVVLASHLGRPNGERNEKYSLAPVAAELEKLLGQKVNSWTLRGQHVTAAVNGAAAGSVFLLENLRFHIEEEGSRKVDGEKVKASAEDVQKFRQGLMSLADVYVNDAFGTAHRAHSSMVGFELPERAGGFLLSRELEYFSKALENPTRPFLAILGGAKVADKIQLIDNLLDKVDSIVIGGGMAFTFKKVLENMEIGNSIYDKAGAEIVPKLAEKAKKNGVKIVLPVDFVIGDDFSQDANTKIVSASEGIPSGWEGLDCGPESRKLFSETIASAKTIVWNGPPGVFEIPKFSEGTQAMLAAAVKASEAGSTVIIGGGDTATVAKKYGVVEKISHVSTGGGASLELLEGKDLPGVTFLSSKQ

SEQ ID NO: 23670 - protein, 221 aa, Haemophilus influenzae Rd KW20
MNITKIDWQKVNGLLPVIIQNISTREVLMLGYMNEEALTKTIKERKVTFFSRTKQRLWTKGEISGNFLNVEEMSLDCDNDTLLILVDPIGATCHTGEYSCFHQFTSPQSENKKQQFANWAWFIKLEQHLKEKKNADPSNSYTATLHAKGTKKIAQKVGEEGVETALAAVAQDKAEVISEATDLVYHLTVLLHNQDLQWYEIIAKLQERHQGIGLHPEGGNK

SEQ ID NO: 23671 - protein, 158 aa, Brassica napus
KIPKKEEPLPNLGLFELVRIPNVSVWYWTAPTDFVSFGEMLIDFVPTESGVSLAEAPGFLKAPGGTPAIVAIAVSRLGGRSAFVRKLGDDEFGHMLAGILRKNGVADQGINFDTGARTALAFVTLKANGDREFMFYRNHSADMLLRPDELNLELIRSL

SEQ ID NO: 23672 - protein, 428 aa, Neisseria meningitidis MC58
MSAIVDIFAREILDSRGNPTVECDVLLESGVMGRAAVPSGASTGQKEALELRDGDKSRYSGKGVLKAVEHVNNQIAQALIGIDANEQSYIDQIMIELDGTENKGNLGANATLAVSMAVARAAAEDSGLPLYRYLGGAGPMSLPVPMMNVINGGEHANNSLNIQEFMIMPVGAKSFREALRCGAEIFHALKKLCDSKGFPTTVGDEGGFAPNLNSHKEALQLMVEATEAAGYKAGEDVLFALDCASSEFYKDGKYHLEAEGRSYTNAEFAEYLEGLVNEFPIISIEDGMDENDWEGWKLLTEKLGGRVQLVGDDLFVTNPKILAEGIEKGVANALLVKVNQIGTLSETLKAVDLAKRNRYASVMSHRSGETEDSTIADLAVATNCMQIKTGSLSRSDRMAKYNQLLRIEEELAEAADYPSKAAFYQLGK

SEQ ID NO: 23673 - protein, 309 aa, Blastopirellula marina DSM 3645
MAAVEEILNREMSSRYESVNEVVSYGCMLGGKRMRPALLLLAAKACGQVTDAHYTLGAVIEMIHTATLVHDDVLDEADQRRHLATVNSRWNNETSVLLGDFLFSHAFYLATMLPTTCAARMIGRSTNIVCEGELRQIASRQAFETTEEEYLAIIDAKTAELCACACELGARYAEASEEQIAALEKFGRDLGIAFQIADDLLDVEGNEVETGKSLGTDLEKQKPTLPLIYALHYFQGEQREQVLAIVEGPAENRGPGLRPWLAQCDALGYARRRANEYIQSAIAALSILPHSESRTTLEQLASFVTARSC

SEQ ID NO: 23674 - protein, 252 aa, Streptococcus thermophilus LMG 18311
MSRKPFIAGNWKMNKNPEEAKAFVEAVASKLPSADLVEAGIAVPAVDLTTVIAAAKGSNLKVAAQNTYFENSGAFTGETSPQVLKEIGTDYVVIGHSERRDYFHETDEDINKKAKAIFANGMIPIICCGESLETYEAGKAAEFVGAQVSAALAGLTPEQVASSVIAYEPIWAIGTGKSASQDDAQKMCKVVRDVVAADFGQEVADKVRVLYGGSVKPENVAEYMACPDVDGALVGGASLEPESFLALLDFVK

SEQ ID NO: 23675 - protein, 416 aa, Methanococcus maripaludis S2
MESYIQNLFAERIGGKSFGKEDVIYKFEKIKRAKQAAKLKYPDMELIDMGVGEPDEMADESVVEVLCEEAKKHVNRGYSDNGVQALKDEIPIYLEKIFGVKDLDPVNEVVHSIGSKPALAYITSVFINPGDVTLMTVPGYPVTATHTKWYGGSVETLPLLEKNNFLPELDAISKEVRENAKILYLNYPNNPTGAQATKKFYKEAVDFAFENDLIVIQDAAYAALTYGDKPLSFLSVKDAKEVGVEIHSFSKAYNMTGWRLAFVAGNELIVRGFAAVKDNYDSGQFIPIQKAGIHCLRHPEITEKTRAKYERRLSKMVKILKEAGFNAKMPGGTFYLYVKAPIGTKDGAKFANAEEFSQFMIKEKLISTVPWDDAGNFVRMAACFEAFKDGEISIEEEDRILNEVKRRLTEVEFVFE

SEQ ID NO: 23676 - protein, 243 aa, Oryza sativa (japonica cultivar-group)
MAIARTGVYVDDYLEYSSTLAGDLQRILSTMRELDERAHGIMGQTKEQIKYLLGVPSHGFDRSNMDDDESASERMKKDIEASQDNALSLCTEKVLLARQAYDLIESHIKRLDEDLGQFAEDLKQEGKIPPDEPSILPAISAFSRDDKRRPGFSTPQATKKFREREWDRERGMDFDLMPPPGSNKKTTAPMDVDQTIDPNEPTYCICHQISYGDMIACDNDNVIIIFFTPNELYISVEQSGKLN

SEQ ID NO: 23677 - protein, 431 aa, Methanococcus maripaludis S2
MLQRTNLTKSRKNGGIIMFLTLDDFELEGKTVALRVDINSPIDVNTGDILDDTRIKACSDTIKSLSEKGAKVVILAHQSRPGKKDFTTLEAHAKKLSEVLNMEVTHVDGLICASAREAILAMDNGEIILLENVRLLAEEVLSDWKSWEEITPEKQAKTVMIKKLHPFFDYFVNDAFAAAHRAQPSLVGFSYYVPMLCGRVMEKELFTLTKVLKNPERPCVFALGGAKADDSIEVLKNVLEKQTADQVLTSGVVANIFLVAKGYKIGPNENVIADMGYTNQIEIAKELISKYGDKIVVPIDAALNVDGERVEKELDLNEEITYPIHDMGEKTMKLYEEILKDAKTVVANGPAGVFENKNFLKGTEELLKSTANSKGFSVIGGGHLSAAAEVVGLAGKMDHISTGGGACIEFLAGKKLPVIEMLSKSYEKHKL

SEQ ID NO: 23678 - protein, 494 aa, Bacillus cereus G9241
MSQLAVNLHEKVEKFLQGTKKLYVNGFFIESASGKTFNTPNPATGETLAVVSEAGREDIHKAVVAARMAFDEGPWSRMSTAERSRLMYKLADLMEEHKEELAQLETLDNGKPIRETMAADIPLAIEHMRYYAGWATKIVGQTIPVSGDYFNYTRHEAVGVVGQIIPWNFPLLMAMWKMGAALATGCTIVLKPAEQTPLSALYLAELIEEAGFPKGVINIVPGFGESAGQALVNHPLVDKIAFTGSTPVGKQIMRQASETLKRVTLELGGKSPNIILPDADLSRAIPGALSGVMFNQGQVCSAGSRLFVPKKMYDNVMADLVLYSKKLNQGAGLSPETTIGPLVSEEQQKRVMGYIEKGIEEGAEVLCGGSNPFDQGYFVSPTVFADVNDEMTIAKEEIFGPVISAIPFNDIDEVIERANKSQFGLAAGVWTENVKTAHYVASKVRAGTVWVNCYNVFDAASPFGGFKQSGLGREMGSYALNNYTEVKSVWLNLN

SEQ ID NO: 23679 - protein, 136 aa, Arabidopsis thaliana
MLLGKRQRPPIKRTTSLSEIKFDLNQPSEQEPSDHQIQLVNVDEHRQVHQRLLDQRLLAMVSPRGTQRRHSSDYSEDFLRSCSLCKRLLVHGRDIYMYRQQQITVDERKEKKKGSVRSTIVVATGTTTGERVSAAV

SEQ ID NO: 23680 - protein, 131 aa, Bacillus cereus G9241
MAAVISWFLAQLTKVVFKLVKTGEFDFAKFFASGGMPSSHASTVTALATGVGVVEGVESSMFAVATIFAIIVMYDASGVRLAVSKQAKILNEFFHGRQTEYKKLNELVGHTPYEVVVGALLGIIVGVGYCL

SEQ ID NO: 23681 - protein, 556 aa, Rhizobium leguminosarum bv. viciae 3841
MYRYDEFDHAFVTERVEQFRDQVERRLSGELAEDAFKPLRLMNGVYLQLHAYMLRIAIPYGTLSSRQLRMLAHIARTYDRGYGHFTTRQNLQFNWPKLCDIPDALADLASVEMHALQTSGNCIRNVTADHFAGAAADEIADPRPYAEILRQWSSVHPEFSFLPRKFKIAVTGAERDRAAIQVHDIGLHVKKNDKGEIGFAVYVGGGQGRTPMIAKLIRDFLPEEDLLSYTTAIVRVYNLHGRRDNKYKARIKILVHETGTEELTRQVEAEFAALKDTELKLPEKDVQSIAAYFAPPDLPQRAEGWENLARWKKADSGFSRWVQQNVQPHKNPDYGMVTISLKPIGGIPGDASDAQMDAIADLAEEYAFDEIRVSHEQNLILPHVALADLEAVYRGLVAINLAEANAGLITDIIACPGLDYCALANARSIPLAQEISRRFGNAERQAEIGELKIKISGCINACGHHHVGHIGLLGVEKKGAELYQITLGGSGDEHTSIGEIIGRGFEPDRVTDAIETIVDTYLGLRLDHSENFLAAYRRVGPQPFKTALYGSAAEAA

SEQ ID NO: 23682 - protein, 386 aa, Archaeoglobus fulgidus DSM 4304
MFKLADRLEKIPPYLFAEIDAMKRKKLQEGVKVIDFGVGDPDLPTPEHIVEALKNAAEKVERQKYPSYEGMLSFRESVARFYRRRKGVNLDPESEVISLIGSKEGIAHLPLAFVNDGDYVLVPEPGYPVYYSSTLLADGVPYEMPLKEENKFLPDFQLIPDEIARKAKIMFLNYPNNPTAAVAPKEFIKEAIDFCIDNKIILAHDAAYSEITFDGYKAPSFLEFEDAFEVCVEFNSLSKTYNMTGWRIGFACGNRDILAGLLKVKTNVDSGVFEAIQEAAIAAMDGPDRVIEENCKVYQRRRDLLVEGLRDVGIDAEKPKATFYVWAKVGGSSIEFVKQLIDKAGIVATPGIGFGKSGEGFVRFALTRGEGVIEEAIDRLKTILHK

SEQ ID NO: 23683 - protein, 461 aa, Solibacter usitatus Ellin6076
MQKSPRTELKRDLGPWAAASIVVGTVIGSGIFLVPKTMIQKVGTVEAVFAVWVVGGLLSLAGALSYAELAAALPEAGGEYAFLREAYGPMWGFLYSWTQMWVAKSGSIATLATGFFLYLTTFFEPLKGVFYTIPLPIGPNGGPLEIQYGQIFAIFLILALGWLNYFGVRIGGNVQVAVTVIKVGLIAAIIFAGLVFGHAHETAAGPVAPITFSGFIAALVAALWAYDGWNNVSMVSSEIKDPQKNLPRALIGGTLCVIAIYMAANAAYFHVMSPAEVAGSTRVAAEMMRKIFSAPGAAAVSIAAMISIFAALNGSILSGARVPYAAARDGYFFHAIGRVHPKYHTPGVSIIVLNLWACLLVLSGKYDDLFNLVIFASWILYGMTAAAVVVLRIKQPELQRPYRTMGYPVVPVLFIIGAVILLVSTAWERPRESMMGIALILLGLPFYYYWKKRIPATIREV

SEQ ID NO: 23684 - protein, 293 aa, Brucella suis 1330
MLKGSITALVTPFDREGAFDEKAFRAFVNWQIEEGTKGLVPVGTTGETPTLSHDEHKRVIEVCIEVAAGRVPVIAGAGSNNTVEAIELAQHAEKAGADAVLVVTPYYNKPNQRGLYEHFSRVVRSISIPLVIYNIPGRSIIDMTPETMGALVRDCKNIVGVKDATGKIERVSEQRAICGKEFIQLSGEDATALGFNAHGGVGCISVTSNIAPRLCAEFQEACQAGNFAKALELQDRLMPLHKALFLEPNPSGPKYALSRLGRIENVLRSPMVTIEAATAEKIDHAMKHAGLIN

SEQ ID NO: 23685 - protein, 321 aa, Triticum aestivum
  misc_feature (290)..(290): Xaa can be any naturally occurring amino acid
  unsure (1)..(321): unsure at all Xaa locations
MAIPLVLVLLPLGLLFLLSGLVVNTVQAVLFLTIRPFSKRLYRQINVFLAELLWLQLIWLVDWWAGIKVQVYADPATWKLMGKEHALLISNHRSDIDWLVGWILAQRSGCLGSAIAIMKKSSKFLPVIGWSMWFAEYLFLERSWAKDEKTLKSGLQRLKDFPRSFWLALFVEGTRFTPAKLLAAQEYAISQGLTAPRNVLIPRTKGFVSAVSIMRDFVPAIYDTTVIIPEDSPKPTMLRILQGQSSVVHVRIKRHSMSDMPNSDEDVSKWCKDIFVAKDALLDKHIATGXFDEEIIPIGRPVKSLMVKHNQGTILCNIINF

SEQ ID NO: 23686 - protein, 235 aa, Zea mays
MKQEAATSIVVTQEDVLHHYKEPPPRREDDPPALAASLSLPSSLSEDDGDAMPQPSSYAVLPRREGELVSAEELLLVPPLNFAMVDHGVYRSGFPDASNLPFLETLRLRSVLCLCPEPYPEANLEFLRAHGIKLFQFGIDGSKEPFVNIPEDRIREALEVILDASNHPVLIHCKRGKHRTGCVVGCFRKLQRWCLTSIFDEYQRFAAAKTRVSDLRFMELFDVSSIKHLAFESSV

SEQ ID NO: 23687 - protein, 200 aa, Haemophilus influenzae Rd KW20
MLDYEIFNPYEGLIFDMDGTLIDTMPVHAQAWTMVGKKFGYEFDFQIMYNFGGATVRTIAGEMMKAANMPLDRIEDVLAAKRELSYQLIPTQSKLLPTFEIVKSFHQKKPIALGSGSHRKIIDMLMDKLAIAPYFNAIVSADDVKEHKPHPETFLRCAELIQANPSRCIVFEDADLGVQAGLSAGMDVFDVRTREIISPR

SEQ ID NO: 23688 - protein, 358 aa, Oryza sativa
MPAFADIAIDPPLADSYRALALLRRDRDGGIAPPAVQMVGSGGAVLERDLPMVDLERLTRGGAGERKACAGAMARAASEWGFFQLTNHGVGRELMEEMRREQARLFRLPFETKEKAGLLNGSYRWGNPTATSLRHLSWSEAFHVPLASISGADCDFGDLTSLRGVMQEVAEAMSRVANTVAAALAEELTGRGGGGASAAPWFPAGCDETTCFLRLNRYPACPFAADTFGLVPHTDSDFLTVLCQDQVGGLHLMKDSRWVAVRPRPDALVVNIGDLFQAWSNNRYKSVEHKVVANAKTGRLSVAYFLCPSYDSLVGTCGEPSPYRAFTFGEYRKKVQEDVRTTGKKIGLPNFFKHSSVQ

SEQ ID NO: 23689 - protein, 47 aa, Fragaria x ananassa
LSGLLNFIDGLWSACRGERLIVFTTNHVEKLDAALIRKGRMDKHIDV

SEQ ID NO: 23690 - protein, 162 aa, Glycine max
MAKEQMKPIATLLLGLNFCMYAIVLGIGGWAMNRAIDHGFIIGPELKLPAHFSPLFFPMGNASTGFFVTFALLAGVVGAASAISGINHIQSWTAESLPSAASVATMAWTLTLLAMGFAWKEIELRIRNARLKTMEAFIIILSATQLFYIVAIHSAAAYRRKT

SEQ ID NO: 23691 - protein, 513 aa, Photobacterium sp. SKA34
MSAKKPLALVILDGWGYREDNADNAIANAQTPVMDELLAQNPNTLISASGIDVGLPDGQMGNSEVGHTNIGAGRVVYQDLTRITKAISDGEFFENEALVTAIDKAVNAGKAVHIMGLLSPGGVHSHEDHIASAIEMAAKRGAEKIYLHAFLDGRDTPPRSAKNSLVRFNELFAQLGKGRTASLIGRYYAMDRDNNWDRVEKAYDLISAAKAEFTVANAVDGLAAAYERNENDEFVKATEVRAEGQEAAIMEDGDSVIFMNYRADRAREITRAFEPGFTGFERTQRPQLSDFVMLTQYAADIALTTAFKPASLDNTLGEWLSKKGKKQLRISETEKYAHVTFFFNGGKEDEFDGESRQLVASPKVATYDLQPEMSAPELTDKLVAAIKGGEFDMIICNYPNGDMVGHTGVYDAAVKACEALDTCLGKVVAAIKEMDGQLLITADHGNAEMMVDPSTGGIHTAHTNLPVPLIYVGSKDLDLKSGGKLSDLAPTMLSLTDMEIPAEMSGQVLYNLK

SEQ ID NO: 23692 - protein, 550 aa, Vibrio vulnificus
MLKTINPTQTQAWNALTAHFESAQDMDLKDLFAQDAARFDKFSARFGSDILVDYSKNLINEETLKHLFALAKETELSAAIKAMFSGEAINQTEGRAVLHTALRNRSNQPVLVDGEDVMPAVNAVLEKMKSFTDRVIGGEWKGYTGKAITDIVNIGIGGSDLGPYMVTEALAPYKNHLNLHFVSNVDGTHIVETLKKVDPETTLFLIASKTFTTQETMTNAHTARDWFLATAGDQAHVAKHFAALSTNAPAVSEFGIDTDNMFEFWDWVGGRYSLWSAIGLSIALAVGYDNFVELLEGAHEMDNHFVSTELESNIPVILALIGIWYNNFHGAESEAILPYDQYMHRFAAYFQQGNMESNGKYVDRNGNPVTYQTGPIIWGEPGTNGQHAFYQLIHQGTKLIPCDFIAPAVSHNPAGDHHQKLMSNFFAQTEALAFGKNEETVKAELVKVGKNAEEVAAIAPFKVFEGNRPTNSILVKQITPRTLGNLIAMYEHKIFVQGVIWNIFSFDQWGVELGKQLANQILPELADGSEISSHDSSTNGLINAFKAFKA

SEQ ID NO: 23693 - protein, 378 aa, Neisseria meningitidis MC58
MEMKQADSTIKSRAAVAFAPNQPLQIVEIDVEMPRKGEVLIRNTHTGVCHTDAFTLSGSDPEGVFPVVLGHEGAGVVVAVGEGVSSVKPGDHVIPLYTAECGECEFCCSGKTNLCVSVRDTQGKGLMPDGTTRFSYQGQPIYHYMGCSTFSEYSVVAEVSLAKINPEANHEQVCLLGCGVTTGIGAVHNTAKVQEGDSVAVFGLGAIGLAVVQGARQAKAGRIIAIDTNPSKFELAKQFGATDCLNPNDYDKPIKDVLLDINKWGIDHTFECIGNVNVMRQALESAHRGWGQSIIIGVAGAGQEISTRPFQLVTGRVWKGSAFGGVKGRSELPKMVEDSMKGDIELEPFVTHTMTLDQINKAFDLMHEGKSIRAVIHY

SEQ ID NO: 23694 - protein, 472 aa, Mesoplasma florum L1
MEKFKAIINNQEIESNSWLDIMDPTTDEVYAQVSALSAQEIDSAFKAAKAAQKKWEAIGIEKRTEFLIRWRDLLLKNEEDLATTMMHEIAKAYKDCLTEVRRTAEYIDLTISEYNDLQVLTFDKNSKGVTEDIVAEYKRIAKGVGVGISPFNYPINLAVSKLAPGLLTGNTFVFKPATQGSVVGIKIGQLAIEAGIPAGVLNVVTGRGRDIGDVIVTNPLIDFISFTGSVPVGRRLMEISSSKDLVLELGGKDAAILLDEHNLENIAKDIVAGAFSYSGQRCTAIKRVITTDNIADKITPLIKAEVAKLTVGLPNENPIITPMIDKKSADFVTDLINDAVKKGATLVYGGTRDKNLLQPTLLDNVTVEMNVAWEEPFGPVLPIIRINEIEDMISVANKSNFGLQTSIYSKDVDLAYKVAEQLEVGTVNINRRTQRGPDVLPFLGVKDSGFGVQGIKETILSTTRYRGIIIKK

SEQ ID NO: 23695 - protein, 337 aa, Zea mays
MAKIKIGINGFGRIGRLVARVALQSDDVELVAVNDPFISTDYMTYMFKYDTVHGQWKHHEVKVKDSKTLLFGEKEVAVFGCRNPEEIPWGSVGAEYVVESTGVFTDQEKAAAHLKGGAKKVVISAPSKDAPMFVVGVNEKEYKSDINIVSNACCTTNCLAPLAKVINDKFGIVEGLMTTVHAITATQKTVDGPSSKDWRGGRAASFNIIPSSTGAAKAVGKVLPVLNGKLTGMSFRVPTVDVSVVDLTVRLEKSATYDEIKAAVKAEAEGSLKGILGYVEEDLVSTDFQGDSRSSIFDAKAGIALNGNFVKLVSWYDNEWGYSTRVVDLIRHMNSTN

SEQ ID NO: 23696 - protein, 141 aa, Neisseria meningitidis MC58
MAIERTISIIKPDAVGKNVIGKIYSRFEENGLKIVAAKMKQLTLKEAQEFYAVHKDRPFYAGLVEFMTGGPVMIQVLEGENAVLKNRELMGATNPSEAAEGTIRADFATSVSINAVHGSDSVENAALEIAYFFSQTEICPR

SEQ ID NO: 23697 - protein, 181 aa, Mesoplasma florum L1
MKKVAIILHKNFEESEAIVTIDILRRSEIIVDIYNIENKDFQVGSHNIIVKTEYNIQSLNSQNYDGIVIPGGPGVNELFDNEILLNLIKDFNDKNKMVSAICAAPQILGLAGIIDDIKIVKFPTSNKYLEKALVQEKDSIIDKNIVTGSSIGTVVPFALNIIEYLQGKEQKEKIRQQLVII

SEQ ID NO: 23698 - protein, 306 aa, Haemophilus influenzae Rd KW20
MRKTLTVLGSINADHVISVPYFTKPGETLTGQNYQIAYGGKGANQAVAAARLGAKVAFISCIGSDSIGKTMKNAFAQEGIDTTHINTVSQEMTGMAFIQVAKSSENSIVLASGANSHLSEMVVRQSEAQIAQSDCLLMQLETPLSGVELAAQIAKKNGVKVVLNPAPAQILSDELLSLIDIITPNETEAEILTGVEVADEQSAVKAASVFHDKGIETVMITLGAKGVFVSRKGKSRIIKGFCVQAIDTTAAGDTFNGGFVTALLEEKSFDEAIRFGQAAAAISVTKKGAQSSIPTRQETLEFLEHA

SEQ ID NO: 23699 - protein, 180 aa, Oryza sativa
VFLLFLKSVFVRNIPMAYKMKGIFKGLKVISQIFVVKEHEMQIGSPTDVKHVAHIGWDGLTGNASPSWMNDIRASSELLSLGNFAPSAGTSWASQDFDQPRDSSSFATPSENTSLQQQEAAPPPDIPRPPAARKTRRKRRSTSDCPVPSSSSSARPSCDSTMAPASDANASQDQNCNSAT

SEQ ID NO: 23700 - protein, 435 aa, Zea mays
MDPCPFVRVLVGNLALRMPVAPPAAGAGAGVHPSTSPCYCKIRLGKMPVQSVPAPLVVSDGGEQTPASGALAAAFHLSKADLEWFNGKPSLFSSRGEASLKVSVYAGRKGSACGVSSGRLLGKATIALDLKGAEAKPAVLHSGWISIGKRSGKGSTAATELSLTVRAEPDPRFVFEFDGEPECSPQVLQVRGSMKQPMFTCKFGCRSNSDLRRPGMQPERDAASAKERKGWSVTVHDLKGSAVAMASMVTPFVPSPGTDRVSRSNPGAWLILRPAGDGAWEPWARLECWRERGGAGASDSLGYHFALLVPGADHAVALADSSIPSSNGGKFVIDLTAAQPLSRGGTPGCSPRGSGDLSNWPLGNYRGFVMSAAVQGEGRCSKPTVEVGVAHIGCAEDAAAFVALAAAVDLSMDACRLFSHRLRKELSHLQADLLR

SEQ ID NO: 23701 - protein, 437 aa, Burkholderia sp. 383
MNDSSIPSRSSLFVVLLCFMTIAVDGYDLIVYGATVSALFAEPGWGLSAGGAGMIGSWTLAGLMLGLFGAGSLSDRIGRRKLIMAGVLWFSIGSLLCALAHSPTQLGIARFLTGIGLGSVVPSSVALTIEYAPRNRRQLYNALALTGYAVGGVVCALLAIALLQSHGWRVLYGAGALYLIILPVMVFFLPESVSFLVERNRIDEARELAARYSIDFDRVLADHAHQRQLHAASGHAGGFRLAMSVDWRSKVLLFAVLFFCGQIVVYGMNVWLPTLMRKAGYPLGSSLHFLLVMQFGAVAGNLIGAWLADRVGARKILISLFLVCALSLLVMSQKPGYAWLMLAVFGAGLGSIGSTTLGYGFIAAYFPASCRGSAIGTAQGLGRIGSVLGPMIGGWVVGSSLGHQWNFYVFAIPSLIAAIVVTQIPRAARIDASYVKA

SEQ ID NO: 23702 - protein, 979 aa, Bacillus cereus G9241
MNNNMVHITIDGKKYTAEPGSTILGVMNENGIEHPQICYVPEVDPIQTCDTCIVEVDGKLMRSCSTVATEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAISEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQRFIDENVNFFEDFKESLAEYTLEYAEEVTGISQETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDKGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWSYSHPSEIFAEMASLSPLFSQANYEVLEGWNSFHWGSFDGTNTPLLFQDGFNFPDKKARFAIADWVHPAEFPAEFDLHINNGRMLEHFHEGNMTNKSTGIQTKVPGVFVEISPELAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARPGYMHLTDK

SEQ ID NO: 23703 - protein, 343 aa, Vibrio vulnificus CMCP6
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMAELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 23704 - protein, 371 aa, Oryza sativa (japonica cultivar-group)
MPARAAAAAAAVALLLAVCAQAAALPRFAEAPEYRNGEGCPAAATAAAGVCDAGLVHISMTLDAHYLRGSMAAVYSLLKHASCPESLFFHFLAEEEEVGGGGDLRRAVAASFPSLRFEIYAFRAEAVAGLISASVRAALESPLNYARNHLADLLPRCVPRAIYLDSDVLAVDDVRRLWETRLPAAAVVAAPEYCHANFSRYFTPAFWSDPGLGRRVFAGRRRPPCYFNTGVMVIDLRRWRAGNYRHRIERWMEIQKEKRIYELGSLPPFLLVFAGEVEAVDHRWNQHGLGGDNVRGSCRPLHDGPVSLMHWSGKGKPWDRLDAGNPCPLDHTWKSYDLYVAGDDGAAASSPASGPALSSTSTTWPALVFSW

SEQ ID NO: 23705 - protein, 168 aa, Brassica napus
  misc_feature (10)..(10): Xaa can be any naturally occurring amino acid
  misc_feature (20)..(20): Xaa can be any naturally occurring amino acid
  unsure (1)..(168): unsure at all Xaa locations
ETLARISGTXEQTDIHSPQXTVRESLIFSAFLRLPKEVGKEEKMMFVDQVMESVELDSLKDSIVGLPGVTGLSTEQRKRLTIAVELATNPSIIFMDEPTSGLDARAAPIVMMAVRNTVDTGRTVVCTIHHPSVDIFEAFDELMLMKRGRQVIYACPLGINSHKVVEYF

SEQ ID NO: 23706 - protein, 452 aa, Glycine max
  misc_feature (54)..(54): Xaa can be any naturally occurring amino acid
  unsure (1)..(452): unsure at all Xaa locations
MEEEQNGGRFDLIILGASGFTGKYVLREALKFLNTPSSPLKSIAIAGPKPTKTXTRALQWASRPNPPPSLPILTADTADPSSLRSLCARTGLLLNCVGPFRLHGEPVVAACAAAGCDYLDISGEPEFMERVEAAHHERAVETGALVVSACGFDSVPAELGVMFNSRQWMGPAAPNRVEAYVALESEKRIVGNFATYESAVLGVANAHQLQQLRRSRPRKPRPQIPGPPTSKGETIENNKKIGLWAVKLPSADSIVVRRTLGILTENLHGLPGLNESAETVEKREAFWSSVKPAHFGVKIGSKSFLGILRIIMVGVFIGLFGSIGFGRQLLLKFPEIFSLGWFRKNGPSEEEVESASFKMWFVGHGYSDGSIASQGNTKPDMEIVTRVMGPEVGYLTTPIILIQCALVLLCQRDNLPKGGVYPPGIIFGPTDLQERLQQNGISFDVISKSTIS

SEQ ID NO: 23707 - protein, 226 aa, Deinococcus radiodurans R1
MDLEALKKEAALRSVALVQSGQRVGLGTGSTAKYAIEELGRKLAAGELSGIVGVSTSEASEKLAREVGIPTEPLDPRPLDIAIDGADEIAPNLDLVKGLGGALVREKMTEVQAKRLIIIADHTKLVTRLGEKAPLPIEIVPFGFLSTIERLREFLPGGRLRQPGAQPYVTDNGNYIFDAQLPAEFDARELERRIKGTLGVVDTGLFLGMAERAFVAAPDGVQELTR

SEQ ID NO: 23708 - protein, 386 aa, Yarrowia lipolytica CLIB122
MADFIRTQIFGTCFEITSRYVDLNPVGMGAFGLVCSAKDQLTDQNVAIKKIMKPFGTPVLSKRTYRELKLLKHLRHENLICLSDIFISPLEDIYFVTELLGTDLHRLLMTRPLEKQFIQYFLYQILRGLKYVHSAGVVHRDLKPSNILVNENCDLKICDFGLARIQDTQMTGYVSTRYYRAPEIMLTWQKYDVEVDIWSTGCIFAEMLEGKPLFPGKDHVHQFSIITELLGSPPEDVIHTICSENTLRFVRTLPRRERIPLASKFRNADPEAIDLMEKMLVFDPKKRITAAEALAHPYLAPYHDPSDEPVAEERFDWSFNDADLPVDTWKVMMYSEILDFHNVDIDVNGQPPQGQFEQVHAQAQAAVAQNEAARAREQEQQQQEQQ

SEQ ID NO: 23709 - protein, 610 aa, Kluyveromyces lactis NRRL Y-1140
MGDNSDSKVNLYPLALLMDELKHDDISNRVEAMKKLDTIALALGVQRTRDELIPFLTEVAQDDEDEVFAVLAEQLGNFVPFVGGRKYATLLLPALEILASTEETLVREKAVDSLNMVAEQLTEEQLLHDFVPLIENLATNEWFSSKVSACGLFKAVFVRIQDDKFRKDLLSLFLQLIQDDTPMVRRAAGRNLPTLVDQLTEHPELSTDDEWDYISSMFQRLVNDSQDSVKFLAVDVLISILKFFNKKKDFTHTKDLLQSSIQLIGDEAWRVRYMAADRFEELASQFVSNPQYVSELLEPFLALCQDNESDVRKAIAKQIPGYAKLLNDPSVILNRIIPAAQNLSIDETECVRASLALEITNLAPLLPKQDSMDSLVPILLHMLKDEFPDVRLNIIAKLKIVNESVGIEFLSENLLPAITELAKDPNWRVRLAIIEYIPLLAEQLGMEFFDSKLSDLCLSWLWDGVYSIRSAAITNLSKLTEIFGSDWAQEEIISRLLKSDTQLLENFNYRITLLFALTGLVPVVSTDVVVEKILPFVNHLSTDNVPNIRFNVAKFYAVIVEALTKNTNKNHIELINNTIIPTLEKLCQDPDVDVRFFSAQSLEKCKSFLS

SEQ ID NO: 23710 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAASRLQGINVGDPRLPIMAPNEQELEALREDMKKAGVL

SEQ ID NO: 23711 - protein, 1109 aa, Arabidopsis thaliana
MNSQQSTRTKQMLQQSSTHLLCGVVLLQLFAAQVDAQRSTSPWQTLSGDAPLVIARGGFSGLFPDSSLAAYQFAMVVSVADVVLWCDVQLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLISWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 23712 - protein, 407 aa, Zea mays
MGSSSQHDSISASGSSERADGSRSSISMWTKITSTDSWRWCLGLIYIVAVASIWIAASYIVQSVVDAGVSPFLITYICNSLFVVYIPIVEAARYFEDSFGDFWIKLKFKDAESLQQASDLESVNLLQCGRHEINIASDQSQTRLSEDTSVPDTGFPAHTELSVVGCSKGLDAKGRWTRARVAKVSMLISPFWFLAQLTFNLSLRYTTVTSNTILSSTSSLFTFLVALVFLGETFTWLKLISVLLCMGGTIIVSLADSSSSVNAIATNPRLGDFLSIVSAGLYAVYITLIRKKLPDEKGQGQVSMAQFLGFLGLFNMLFFLPVALVLNFAKLEQFHSLTWEQVGLVVGKGLIDNVLSDYLWAKAILLTTTTVATAGLTIQVPIAAIVDTLTGHAPHLLDYIGAAAVLA

SEQ ID NO: 23713 - protein, 379 aa, Arabidopsis thaliana
MLSTLMKLLSACLWPSSSSGKSSDSTGKQDGLLWYKDFGQHLVGEFSMAVVQANNLLEDQSQVESGPLSTLDSGPYGTFIGIYDGHGGPETSRFVNDHLFQHLKRFAAEQASMSVDVIKKAYEATEEGFLGVVTKQWPTKPQIAAVGSCCLVGVICGGMLYIANVGDSRAVLGRAMKATGEVIALQLSAEHNVSIESVRQEMHSLHPDDSHIVMLKHNVWRVKGLIQISRSIGDVYLKKAEFNKEPLYTKYRIREPFKRPILSGEPTITEHEIQPQDKFLIFASDGLWEQMSNQEAVDIVQNHPRNGIARRLVKMALQEAAKKREMRYSDLKKIERGVRRHFHDDITVVIIFLDTNQVSSVKGPPLSIRGGGMTFPKKI

SEQ ID NO: 23714 - protein, 121 aa, Brassica napus
MASSMLSSAAVVTSPAQATMVAPFTGLKSSAAFPVTRKANNDITSIASNGGRVSCMKVNISRIIAGLSFITRNWISNMNPLIPYGIHKPKTIYRDLFPHLKGFFEGGPKKLTPTLPLGKES

SEQ ID NO: 23715 - protein, 339 aa, Ashbya gossypii ATCC 10895
MGYNETEPAIDGDNNEQRINEDMSTLEHTSNNNGNGLEPVEAGPDSGIPAVEGGGSVSGQSPQHEPPAYELSYVVGVAENKNAKFRRTMEDVHTYVENFASRLDWGYFAIFDGHAGNQASKWCGSHLHTIIEERILQGDDRDVRDILNDSFVYVDQQINSTLEGNSGCTAAVGILRWEAPTPIPNMPINLEQHKRMLYTANVGDTRIILFRNGRSVRLTYDHKASDIIEMQRVEKAGGLIMKSRVNGMLAVTRSLGDKFFDSLVVGNPFTTSVEIPTSDQFLIIACDGLWDVVDDQEACEMIKDIEDANEAAKTLVRHALEHGTTDNVTVMVVFFDNNQ

SEQ ID NO: 23716 - protein, 717 aa, Arabidopsis thaliana
MSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSSL

SEQ ID NO: 23717 - protein, 336 aa, Corynebacterium glutamicum
MTIRVGINGFGRIGRNFFRAVLERNGDLEVVAVNDLTDNKTLSTLLKFDSIMGRLGQEVEYDDDSITVGGKRIAVYAERDPKNLDWAAHNVDIVIESTGFFTDANAAKAHIEAGAKKVIISAPASNEDATFVYGVNHESYDPENHNVISGASCTTNCLAPMAKVLNDKFGIENGLMTTVHAYTGDQRLHDAPHRDLRRARAAAVNIVPTSTGAAKAVALVLPELKGKLDGYALRVPVITGSATDLTFNTKSEVTVESINAAIKEAAVGEFGETLAYSEEPLVSTDIVHDSHGSIFDAGLTKVSGNTVKVVSWYDNEWGYTCQLLRLTELVASQALN

SEQ ID NO: 23718 - protein, 403 aa, Corynebacterium glutamicum
MAVKTLKDLLDEGVDGRHVIVRSDFNVPLNDDREITDKGRIIASLPTLKALSEGGAKVIVMAHLGRQGEVNEKYSLAPVAEALSDELGQYVALAADVVGEDAHERANGLTEGDILLLENVRFDPRETSKDEAERNRFAQELAALAADNGAFVSDGFGVVHRAQTSVYDIAKLLPHYAGGLVETEISVLEKIAESPEAPYVVVLGGSKVSDKIGVIEALAAKADKIIVGGGMCYTFLAAQGHNVQQSLLQEEMKATCTDLLASVDKIVLPVDLVAASEFNKDAEKQIVDLDSIPEGWMSLDIGPESVKNFGEVLSTAKTIFWNGPMGVFEFAAFSEGTRASPRPSSMQHAGNDAFSVVGGGDSAASVRVLGLNEDGFSHISTGGGASLEYLEGKELPGVAILAQ

SEQ ID NO: 23719 - protein, 403 aa, Neisseria meningitidis MC58
MNQLKLAVSGAQILFVAFGAMVLVPLLTGLNPALALLGAGLGTLLFQITTKRKVPIFLGSSFAFIAPIIYSVGEWGLPSTMFGLFAAGFMYFVFAALIRWRGLAAVHKLLPPVVIGPVIMVIGLSVAVAASSMAMGQADGKQVIDYTDSLILSGFTFAVTAIVSVFGSRMMKLIPILIGVASGYVLALLMGLVDTASIAHAPWFAVPHFETPQINWQAALFMLPVAVAPAIEHIGGIMAIGNVTGKDYTKDPGLDKTLAGDGLGVCVAGLIGGPPVTTYGEVTGAVMITKNSNPVIMTWAAVFAVCMAFFGKFNAFLASIPMPVMGGIMLLLFGTIASLGVKTLIDAKVDLMLPKNLVIVSSVLTTGIGGMTLKLGSFSFAGVGLCAVLAIMLNSLLPDPKES

SEQ ID NO: 23720 - protein, 317 aa, Solibacter usitatus Ellin6076
MPDYDVVGVGLNATDTVLIVPHFPAYAGKVPFEDEHMSPGGQVASALVACSRLGLRAKYIGSVGDDLRGRIQLESLQGTGINLDHVLLRPGCANQSAYIIIDRSTGERTVLWQRDDCLKILPEEITDEMISCARLLHIDGHDTPAVARAAEIARRHGIPVTVDVDTIYHGFDRVLPNVDYLVASSEFPTAWTGETDPFKALATIQDEYGMKVAAMTLGAHGALARENGRFHYAPAFVVNCVDTTGAGDVFHGAFCYAVLQGMPMSQALEFSNAMAALNCTALGARGGIRGLDEVHALMARAERRSHSDFAARAARPS

SEQ ID NO: 23721 - protein, 327 aa, Mycoplasma pneumoniae M129
MSKTIQANNIEALGNAMDLALERDPNVVLYGQDAGFEGGVFRATKGLQKKYGEERVWDCPIAEAAMAGIGVGAAIGGLKPIVEIQFSGFSFPAMFQIFTHAARIRNRSRGVYTCPIIVRMPMGGGIKALEHHSETLEAIYGQIAGLKTVMPSNPYDTKGLFLAAVESPDPVVFFEPKKLYRAFRQEIPADYYTVPIGQANLISQGNNLTIVSYGPTMFDLINMVYGGELKDKGIELIDLRTISPWDKETVFNSVKKTGRLLVVTEAAKTFTTSGEIIASVTEELFSYLKAAPQRVTGWDIVVPLARGEHYQFNLNARILEAVNQLLK

SEQ ID NO: 23722 - protein, 177 aa, Mycoplasma pneumoniae M129
MKQKLQALDRAIKRFNDFPTPGILFYDITPIFLNSELFEFVLEQMAQFIQEVKADGIVCPEARGFIFGGALASKTKLPLVLVRKPHKLSGELARETYDLEYRQNSILEMRVDALENCKRCVIVDDLLATAGTVAAIDKLIARLGSQTVGYCFLIELQKLHGKAKLQPNVATKILLHY

SEQ ID NO: 23723 - protein, 198 aa, Arabidopsis thaliana
MTLESYAGDVHTVPQSENSMEERGGGELFVPPLNFAMVDNGIFRSGFPEPVSFSFLQSLRLKSIIYLCPEAYPEVNREFAKSNGIQVFQFGIERCKEPFVNIPDEVIREALQVLLDTENHPVLIHCKSGKHRTGCLVGCVRKIQRWCLSSIFDEYQRFAAAKARISDQRFMELFDISNLKHTPLSFSCSKRYTNTIDY

SEQ ID NO: 23724 - protein, 733 aa, Mycoplasma pneumoniae M129
MFYNWLKLYKFSKMATLVEIERDFLQKTAQKFAPEVVALITKALDYSKKWHGEQKRLSGEPFFIHPLRTALRLVEWNMDSNTVCAGLLHDIIEDTQVTEADLTAIFGKEITDLVVKVTKITSESKKQRQLNRKKEDLNLKSLVNIAMSSQQEVNALVLKLADRLDNISSIEFLAVEKQKIIAKETLELYAKIAGRIGMYPVKTQLADLSFKVLDPKNFNNTLSKINQQKVFYDNEWGNFKKQLEEMLEQNQIEYRLESRIKGIYSTYQKLTFHEQNIAKIHDLFAIRLIVKSELDCYHLLGLIHLNFTVLMKHFKDYIASPKQNFYQSIHTTVRLKGLNVEIQIRTQRMDHVSKYGFASHWIYKEKKEGLLASALQVNYLNSKQMHSRDFFKRIFGTDIIKVNVSSDNEPNIVKKLNVESNSKLLDIAYELYPKQFNKLEKIKLDGVEVMSFDVTAENEMVIEFCFGKTNNLKRRWLRYMNNHVFRERVKKDLNKLKKAVKYSELPLYEKALEELHLKLADETQIKQRLNALGIKKLTEFLELIEYPHFPKNEHLYFLASNNQKWRELIKPIKFALSQAVFQNSYFEQIEGIYITKIVIETCCTKIPDMPEQVIGILMKNILRVHLHDCRELANQKQPKIIPLYWNAHQLKMRPRKFRCQINIRGVWSETTVNKIVQTIIEGDSYLERIIPKIDKQKDEFELNITMFIDNYHQLITIMEQITTKNISYVWKYL

SEQ ID NO: 23725 - protein, 170 aa, Sorghum bicolor
MAAADVEYRCFVGGLAWATNNETLEHAFANFGQVLDSKVITDRETGRSRGFGFVTFSSEQSMLDAIENMNGKELDGRNITVNQAQSRGGGGGGGGYGGGGGGYGGRREGGGYGGGGGGYGGRREGGGGYGGGGYGGGGGGYGGRREGGGGYGGGGGYGGNRGDSGGNWRN

SEQ ID NO: 23726 - protein, 180 aa, Triticum aestivum
  misc_feature (26)..(26): Xaa can be any naturally occurring amino acid
  misc_feature (45)..(45): Xaa can be any naturally occurring amino acid
  unsure (1)..(180): unsure at all Xaa locations
YNPLAHRDGLRPATSLAPFQGLKSTXAGLPVSRRSNGASLGSVSXNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 23727 - protein, 432 aa, Arabidopsis thaliana
MVIKGMRVGKYELGRTLGEGNSAKVKFAIDTLTGESFAIKIIEKSCITRLNVSFQIKREIRTLKVLKHPNIVRLHEVLASKTKIYMVLECVTGGDLFDRIVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQLYERLLNELGSSSQVQELLA

SEQ ID NO: 23728 - protein, 146 aa, Podospora anserina
GVPGMVAGMLRHLRSLRKMKRDNGWIETLLEEAFNERMHLLTFLKLAEPGWFMRVMVIGAQGVFFNGFFLSYLISPRICHRFVGYLEEEAVITYTRAIEELEAGNLPEWKDLDAPEIAVKYWQMPEGQRKMKDLLLFIRADEAKHR

SEQ ID NO: 23729 - protein, 459 aa, Aeropyrum pernix K1
MSSGRVEEVVKRLAEIRAMDARGEGGRLFTYLYETGDPGVKEVSLRAFEMFLDTNALDPTVFKSALFFERELVSFASSLAGGVEGVVGTVTYGGTESIILAAMAAREWYRSLGGSRTPGIVAPQTVHPSVRKAARYLGMRLSIAPVDPGSKRVDIDSLVSLVDDRTAMVVVSAPNYPYGTVDDVRSVAEALSSQRVWLHVDACVGGFILPFMRELGLYSGAFAFDVEGVYSVSMDLHKYGYSPKGASVLLFRDGSLKKHSIFADLRWPGYPFINTTVLSSRSVAPLAAAWAVTNYLGRRGYLELARKAVEARDEIMRGLESIGFRSLAPIESTILSVALDDPADTLRFHANMSRRGWILGLQPGVEGLAPPNIHLTISPIHKLVSPQFLGDARASSSEPLPKELEEAWRLLESRGPLELAGMIGRTQYDQVIIAWILSSIPPDLAEDLARELTVEVYRG

SEQ ID NO: 23730 - protein, 239 aa, Burkholderia sp. 383
MAPALADGSERSRCRPPRIRIRRIPVRDIIDGFLRFQREVYPQRVELFKQLATTQNPKALFVTCSDSRVVPELLTQREPGELFVIRNAGNIVPSYGPEPGGVSATVEYAVAVLGVRDIVICGHSDCGAMGAISRCTCLDHMPAVANWLRHSDAAKAINAAHQFDSPRAKLDGLVRENVIAQLANLRTHPSVALALEQGRMNLHGWVYDIEMGRIDALDGATRHFVPLSESPATVAVKSY

SEQ ID NO: 23731 - protein, 138 aa, Zea mays
  misc_feature (63)..(63): Xaa can be any naturally occurring amino acid
  misc_feature (85)..(85): Xaa can be any naturally occurring amino acid
  misc_feature (119)..(119): Xaa can be any naturally occurring amino acid
  unsure (1)..(138): unsure at all Xaa locations
MAAWGGMMLFGRLAGLVGAGLLWAAADIGAGQQAFNVRATNHLYKPRQNGWDLNRVSAYCATXDTYKTLSWRKKHGWTAFCGPAXGTKGRAPVVIAYKGKNRATGACILGRIVYQCSNXAPWDLYYQTVFYKIDTNGQ

SEQ ID NO: 23732 - protein, 369 aa, Oryza sativa
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 23733 - protein, 214 aa, Oryza sativa (japonica cultivar-group)
MADVNCRCSRVVYVGNIAFHATEAELRDACELIGPVRSLRLAALDPATNKRKGYAFVEYADDETARSALRNLHGHLLRGRELRVGLAARPSIRRRGGGGGGEREPVGMEDAVHAASLVVSGRPLASVTRYLAARSRQEVREMVAALEATEQLKIPGLGTAMEQAQRLLEMFAADEEEVARKKLKRASDEEHAKQSKVVGVDGVVKASSRIVPCF

SEQ ID NO: 23734 - protein, 541 aa, Saccharomyces cerevisiae
MYQRPMQVQGQQQAQSFVGKKNTIGSVHGKAPMLMANNDVFTIGPYRARKDRMRVSVLEKYEVIGYIAAGTYGKVYKAKRQINSGTNSANGSSLNGTNAKIPQFDSTQPKSSSSMDMQANTNALRRNLLKDEGVTPGRIRTTREDVSPHYNSQKQTLIKKPLTVFYAIKKFKTEKDGVEQLHYTGISQSACREMALCRELHNKHLTTLVEIFLERKCVHMVYEYAEHDLLQIIHFHSHPEKRMIPPRMVRSIMWQLLDGVSYLHQNWVLHRDLKPANIMVTIDGCVKIGDLGLARKFHNMLQTLYTGDKVVVTIWYRAPELLLGARHYTPAVDLWSVGCIFAELIGLQPIFKGEEAKLDSKKTVPFQVNQLQRILEVLGTPDQKIWPYLEKYPEYDQITKFPKYRDNLATWYHSAGGRDKHALSLLYHLLNYDPIKRIDAFNALEHKYFTESDIPVSENVFEGLTYKYPARRIHTNDNDIMNLGSRTKNNTQASGITAGAAANALGGLGVNRRILAAAAAAAAAVSGNNASDEPSRKKNRR

SEQ ID NO: 23735 - protein, 633 aa, Neisseria gonorrhoeae FA 1090
MTTPKKTAKISGNEARELSDLSEDIGIRFKYQNSERVYLQGSRDDIRVPLREIRQDDTYTAQGTEANPPIPVYDTSGAYGDPAAHIDLKQGLPHIRTAWLDERGDTEILPKLSSEYGIERAHDPKTAHLRFNQITRPRRAKAGRNVTQLHYARQGIITPEMEFAAIRERMKLDELFRRPEYAKLLKQHTGQSFGANIPTRPDQITPEFVRQEIAAGRAIIPANINHPELEPMIIGRNFRVKINGNLGNSAVTSSLTEEVEKMVWSLRWGADTIMDLSTGAHIHETREWIIRNAPVPIGTVPIYQTLEKTGGIAEDLTWDLFRDTLIEQAEQGVDYFTIHAGVLLRYVPMTANRLTGIVSRGGSIMAKWCLAHHRENFLYTHFDEICEIMKAYDVSFSLGDGLRPGCIADANDESQFAELHTLGELTDKAWKHDVQVMIEGPGHVPLQRVKENMTEELQHCFEAPFYTLGPLVTDIAPGYDHITSGIGAANIGWYGTAMLCYVTPKEHLGLPDKEDVRTGIITYKLAAHAADLAKGWPGAQLRDNALSKARFEFRWRDQFRLSLDPERAESFHDETLPAEGAKIAHFCSMCGPKFCSMKITQEVRDYADKQKAQRQGMEEKAVEFVKKGAKIYS

SEQ ID NO: 23736 - protein, 492 aa, Debaryomyces hansenii CBS767
MSKPTLNNPDLIRTKPYINGEWFESKSTKTFKVIDPATETEIVELPDQTPEEIAFAIEKAEEAFKTFKKTNAYDRARWLRKLNDLMLENIEDLAKILTWENGKCLTDATGEIKYAASYFEWFAEEAKRIYGNTIQPSNNNNKVITYKQPIGVVGLLCPFNFPTAMGARKLAPSFAAGCTTILKPDGQTPLSSLALAYLAEKAGFPKGTFNVVLASTENTPKVGLEFCESPRIKKISFTGSTPVGKLLMRQSSSTLKKLSMELGGNAPIIIFDDADLDLAVEQSIASKFRSLGQTCVCANRLYIQSGVYDKFCEKFTEKVKEFKIGNGLEKGITHGCLINDKAITKVEEHIKDAVGKGAKVLVEGGRLPNLGKNFYAPSVVKDVTQEMVVVKEETFGPLAALLKFDTKEQVLDWCNDTPYGLASYVFSENLNTIWFMSEYLESGMVAVNTGLFTDAAMPFGGVKESGFGREGSLYGIDDYTVVKAITLGNMYR

SEQ ID NO: 23737 - protein, 465 aa, Arabidopsis thaliana
MTRVNQLPCDCVSTAEESLTSGTCITPTHVTSLSSPLDRSGDVDPLPVSDESGGSKADESMTDADETKKRKRILSGDCEADENNKSDGEIASLNDGVDAFTAICEDLNCSLCNQLPDRPVTILCGHNFCLKCFDKWIDQGNQICATCRSTIPDKMAANPRVNSSLVSVIRYVKVAKTAGVGTANFFPFTSNQDGPENAFRTKRAKIGEENAARIYVTVPFDHFGPIPAEHDPVRNQGVLVGESWENRVECRQWGVHLPHVSCIAGQEDYGAQSVVISGGYKDDEDHGEWFLYTGRSRGRHFANEDQEFEDLNEALRVSCEMGYPVRVVRSYKDRYSAYAPKEGVRYDGVYRIEKCWRKARFPDSFKVCRYLFVRCDNEPAPWNSDESGDRPRPLPNIPELETASDLFERKESPSWDFDEAEGRWRWMKPPPANHEQRERMKMAMTCLLLFVLIILVGSSSILYQY

SEQ ID NO: 23738 - protein, 495 aa, Coccidioides immitis RS
MASAAVMSRFPSCRLLVSRPASTLRESRNVYRLRDAARPQLPLYASLARYYASKSYPPHTIISMPALSPTMTAGNIGAWQKKVGDTLSPGDVLVEIETDKAQMDFEFQEEGVLAKILKEAGEKDVSVGNPIAVMVEEGTDIAQFGSFSLEDAGGDKKPSADKTPKETPESSKGPEAEAEGQSLAQDEAKPAAEEPDITGERLQPSIDREPLISPAAKALALERGVPIKTLKGTGPGGRITKEDVEKYQPTTAVGAAAGPTYEDIPASSMRKVIASRLTQSMKDNPHYFVSSTLSVTKLLKLRQALNSSADGKYKLSVNDFLIKACALALRKVPAVNSAWIEQNGQVVIRQHNTVDISVAVATPVGLITPIVKGVEGLGLESISRQVKDLGKRARDNRLKPEEFNGGTFTISNMGMNPAVERFTAVINPPQAAILAVGTTRKVAVPLETEEGTEVQWDDQIVVTGSFDHKVVDGAVGAEFMRELKKVVENPLELML

SEQ ID NO: 23739 - protein, 439 aa, Glycine max
MYGIVKFQALVRGGIVRHSNVGSEIQEKCNILNPLDGKLVKPIAISMKITKLSANAFIRKLLTSSTRIMVLQLQYVPGDPNSVLSWLERWSASHFWKPVPQPKKIRDTKSHRKHGNISVGDTHMSKSKRTNRKLPPASFDSVPVQAHPEFEKPKRNMRKIPSQSSDPPVQENPQSELEKIKRNLRKVHNPVVENAVPSEVESETPKDHLEKATVTSCLAVSEQEVISSNEKIKKEATLIVSSVPDIETTPRLSVSKEVLDSPSSYQVTVESKPLTEITTKDKNIHVSDEVKNEPIDLPEPICKDENSHLTNGDLSHKEDQIGSENQKPNGKASIVAKQERAENGIQNSPALPSYMAATESAKAKLKAQGSPRFGQDGSEKNNHTRRHSLPSSTNCKISSHSPRTLRQVQSGGKGGHRSDRTVSSSRDGNGKVIQAEWRR

SEQ ID NO: 23740 - protein, 453 aa, Arabidopsis thaliana
MGKWNHRSRHHRRRSPERWYSGRQSSSSSDDGIPVWEKRFCEVIGSVPWQKVVEAKDFKSWYNGNVITWDDSACEDTFHNEKKRFWSQVNGLHCDVSIPDPDLYISEVDWDTFVDPELIRDLEKAYFAPPDDVNIGFKRGRGDKNWSGCDTVPEARMLETPWKNSDDIIETGKKSSGWNLTEGSSWEAKPCCVNEKANDTASGGCLTTEEWRENQWIAKDRVNDSWEYSGQGKDDGWDKSGHQNKKVKGSEEYKKIDNPWEAQPSCIKETAKDTTWGGCSGEGWEDRGWNNDSWGSGGWDNRDLGNQGMEMKEWRGKGYSRDFREPKGCNPWKGGFVPDNVAFRESGVNAGGWQTCRGSETKQINWDVKRASDGWGRQNDNAALREYGANAGDWQRRRGCEGNQRNWDAKRTGDGWGRQNKERVDSYGYHSNYKNSWPRRDDYQNRKVNFSTK

SEQ ID NO: 23741 - protein, 170 aa, Mesoplasma florum L1
MDLKKHILNVKDFPIDGIDFKDVTPLLNDADAFAYVIDEMAKFVIECGANVVVAPEARGFLFASAVAYKSHTRFVLVRKPGKLPREVIDIEYTLEYGTNHQQMHKGDIKPGDKVVIIDDVLATGGTIEAIVKLVEMQEGKVEGVSFLIDLPALHDENLLQEYKVQKLVKY

SEQ ID NO: 23742 - protein, 72 aa, Arabidopsis thaliana
  misc_feature (4)..(4): Xaa can be any naturally occurring amino acid
  misc_feature (30)..(30): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(49): Xaa can be any naturally occurring amino acid
  misc_feature (54)..(54): Xaa can be any naturally occurring amino acid
  misc_feature (56)..(56): Xaa can be any naturally occurring amino acid
  unsure (1)..(72): unsure at all Xaa locations
MASXMLSSATMVASPAQATMVAPFNGLKSXAVFPATRKANNXITXITXXGGRVXCXQGPEKKGLYFLPVYGE

SEQ ID NO: 23743 - protein, 348 aa, Leptospira interrogans serovar Lai str. 56601
MGIMGMKAAVLESGKKILEIRDVSVPQLRAEQVKVRIKACGICGSDVHLVVHGTLKCKHFPRVPGHESSGIIEEVGENVRRFRKGDRVVIAAGTSCGVCSYCKEGKENLCKDLGVFGFDRDGSFAEFNIVEERYLYSLPDEIPFDQGAILADAVSTPYHAIRYRGNIQESDTVAIFGCGGLGIHAVAIARAMTKGKVIALDVDSGALENATKYGADEVVNLKEVRNSGKVLKEVSKGVDLLADFSGYMSNVEDSIRAMNPGGRIVLVGIGRQPLKFQIPFILIEKMISVSGSYGSDRRAIPELIELYLKGKINLSHSITSHHPLEELNECLEALDQRKGNPIRFIVEP

SEQ ID NO: 23744 - protein, 593 aa, Ralstonia eutropha JMP134
MSVIEVKVPDIGDFDAVELIEVLIKPGDTVEQEQSLIVLESDKASMEVPSPVAGKVVDVRVNVGDKVGQGTVICTVEAEAAAAAPAPAPAPAPAAAPAPAAAPAPAPAAASHAGGADIQCEMLVLGAGPGGYSAAFRAADLGMNTVLVERYATLGGVCLNVGCIPSKALLHNAAVIDEAKALAAHGILFGEAKIDLDGLRHYKNQVVGKLTGGLAGMAKARKVQVVRGIGTFLDPHHLEVDATEGEGKQTTGKKTVIRFEKAIIAAGSQAVKLPFIPEDPRIVDSTGALELPEVPNKMLVVGGGIIGLEMATVYSTLGADIDVVEMLPGLMSGADRDLVKVWEKKNKDRFGKVMLNTKTVAVEAKPDGIYVKFEGEQAPAEPQRYDLVLVSVGRSPNGKRIGAEKAGVAVTDRGFINVDSQMRTNVPNIFAIGDVVGQPMLAHKAVHEAHVAAEAAHGEKAYFDAKQIPSVAFTDPEVAWAGLTEDQCKEQGIKYSKGVFPWAASGRAIANGRDEGFTKLIFDEETHRIIGGGIVGTHAGDLISEVCLAIEMGADAVDIGKTIHPHPTLGESIGMAAEIYEGTCTDVPPPRKR

SEQ ID NO: 23745 - protein, 226 aa, Zea mays
MTTGEGAEAAAVPRVVSILSALLQRVAERNDAAAAAPPPAAAAGPPVLSAFQGLTKPAISIGGYLERIFRFAGCSPSCYVVAYIYLDRFLRRRPALAVDSFNVHRLLITSVLTAVKFVDDICYNNAYFARVGGISLVEMNYLEVDFLFGIAFDLNVTPAAFASYCAVLQSEMAYLDDAPAPVVEAPPRLHYCYGAAGTSDRHDDPAAVAAAAAACHRHSSQPQLTV

SEQ ID NO: 23746 - protein, 557 aa, Aspergillus nidulans FGSC A4
MIEELVSKTTPGQAVVYLLGAFFLACLARKIQVQWQLSRLGSRAPKIPFRLPYGLLIPSISRNSHADRRLSSAMDFIYKSMQANKSDQDLEYFTDVMRNAKGAPLAEDKKTVELDAGISSRIIFTRDPENIKAILTGQFSDYGKGESFHRDWREFLGDSIFVTDGEQWSASRHLIRPMFVRDRLVDTEIFEKHVQHLIPLLAGNNESKIVDVTSLFFRYTLDAATNYLLGQGTDSLQNPETEFAEAFRYVQRRQAQYFRLGVFKFVLSRTEFRRQLKVMDDFIKPYIDRVLAMSPAELDQKLSKSDTFLHALARFTRDRRTLRDQLVAILLAGRDTTAATLSFCLFELARNPEVTAKLREEIASRLGLGASAQKPSYTDLKEMKYLNAVLNESMRLYPVVPFNVRFSLKDTTLPRGGGPDGLAPVAVRAGTRVVYSTMIMQRSPENYDPPSAPNYFDPAQWNPERWLSGWQPKPWQFIPFNGGPRICIGQQFAMIEMGYTVVRILQAFERIQAVPEAGKSVVEDPRLRFEVTLTPASELNCVFVRDGEGREDEKISR

SEQ ID NO: 23747 - protein, 386 aa, Haemophilus influenzae Rd KW20
MSVIKMTDLDLAGKRVFIRADLNVPVKDGKVTSDARIRATIPTLKLALEKGAKVMVTSHLGRPTEGEFKPEDSLQPVVDYLKNAGFNVRLEQDYLNGVDVKDGEIVVLENVRVNKGEKKNDPELGKKYAALCDVFVMDAFGTAHRAQASTYGVAEFAPIACAGPLLAAELDALGKALKEPARPMVAIVGGSKVSTKLEVLNSLSKIADQIIVGGGIANTFIAAAGHNVGKSLYEADLIPVAKELAANTDIPVPVDVRVGLEFSETAAATEKVVNEVKDDESIFDIGDKSAEQLAEIIKNAKTVLWNGPVGVFEFPHFRKGTEIISHAIANSDAFSIAGGGDTLAAIDLFGIADKISYISTGGGAFLEFVEGKVLPAVEILEKRAKN

SEQ ID NO: 23748 - protein, 286 aa, Zea mays
MQRAVQAVRSHGNVLKYAVLQHISAPKPAMLPAAFSRFMSVSSARLEDRGFETATVADVLKSKGKSADGSWLWCTTEDSVYDAVKSVCPHFPMIVLTPSESMVMHQMIRLPFGTLNFLQMTQHNVGALVVVKPGQNKSIAGIVTERGDEQISVLLASNFWPVAVHHSTFGIKESQLFRALYSRYNRNCIKLKYTYYLRKIIVQGRSSKSTKVGDIMTEENKLITVNPDTKVLQAMQLMTENRVRHIPVIDGTGMLGMVSIGDVVRAVVAEHREELNRLNDYIQGGY

SEQ ID NO: 23749 - protein, 544 aa, Oryza sativa (japonica cultivar-group)
MKSPMEEAHAMPVTSFFPVAGIHKLIAIFLVVLSWILVHKWSLRNQKGPRSWPIIGATVEQLKNYHRMHDWLVEYLSKDRTVTVDMPFTSYTYIADPVNVEHVLKTNFTNYPKGEVYRSYMDVLLGDGIFNADGEMWRKQRKTASFEFASKNLRDFSTVVFREYSLKLSSILSQACKAGRVVDMQELFMRMTLDSICKVGFGVEIGTLSPDLPENSFAQAFDAANIIVTLRFIDPLWRLKKFLHVGSEALLEQSMKLVDDFTYSVIRRRKAEILQARASGKQEKIKHDILSRFIELGEAGGDEGGGSFGDDKSLRDVVLNFVIAGRDTTATTLSWFTYMAMTHPAVADKLRRELAAFEDERAREEGVALADAAGEASFAARVAQFASLLSYDAVGKLVYLHACVTETLRLYPAVPQDPKGIVEDDVLPDGTKVRAGGMVTYVPYSMGRMEYNWGPDAASFRPERWLSGDGGAFRNASPFKFTAFQAGPRICLGKDSAYLQMKMALAILFRFYTFDLVEDHPVKYRMMTILSMAHGLKVRVSTSV

SEQ ID NO: 23750 - protein, 279 aa, Oceanobacter sp. RED65
MTDLYAVMGNPINHSKSPQIHSAFAEQTDQPLVYSAILVPTDGFPAAVKDFFKGKGSGKGLNVTVPFKEEAFQLADELTARAQKAQAVNTLILTSEGSILGDNTDGAGLVKDLTRNQSTPLTNKRVLVIGAGGAVRGILQPFLQEQPSELVIVNRTFGKAQQLADEFKDLGPIAAKEFTQLADEAPFDVIVNGTSASLNGDLPPVPGSIISEETVVYDMMYGKEPTAFLVWASEQGAKTLIDGLGMLVEQAAVSFELWRGVAPDSKTVLASLRRQLQAS

SEQ ID NO: 23751 - protein, 550 aa, Aeropyrum pernix K1
MTREFPPISRSRINPSTGSWRRAPRGSQAGLHFYSMGGGSLIGSCWSLLSKFAGYLRSRGVGKGDVVGLFLPNSPQFAIAFYGALIAGAIVSPMNVLYSPREIRHQLSDNKARVLVALDMFKDRVLAGLPSSVEEVLWTGIQDYLPGLKALLYKLFKKPPSPPKGGIHKKFTDALKHEPIDSKPEINPHEDVAALMYTGGTTGTPKGAMLTHRNLLANVLQIDAWFKRGVRGKDVFVGALPWFHIYGLTAVLNSGVQKAATIIVYARPNIEEIMRDIERYKATVFHGVPTLYRMIINHPKVEKFNLRSLEVCISGAEPLPKAVAERFMEITGAKLREGYGLTETSPVTHVNPIMGEARYGSIGIPVPSTVAAVADPESPAILEPGQVGELVVSGPQVMKGYYNRPEENEKVFFECCGLRWLRTGDMARMDEDGYFYIVDRKKDIIKYKGYSVFPREIEEVLYRHECVREAAVIGVPHPEYNEVPKAFVALRDECKGKVKPEDIIEFARKHLAPYKVPKEVEIREDLPKSGVGKILRRVLREEELKKRGQA

SEQ ID NO: 23752 - protein, 426 aa, Escherichia coli
ADTKAKLTLNGDTAVELDVLKGTLGQDVIDIRTLGSKGVFTFDPGFTSTASCESKITFIDGDEGILLHRGFPIDQLATDSNYLEVCYILLNGEKPTQEQYDEFKTTVTRHTMIHEQITRLFHAFRRDSHPMAVMCGITGALAAFYHDSLDVNNPRHREIAAFRLLSKMPTMAAMCYKYSIGQPFVYPRNDLSYAGNFLNMMFSTPCEPYEVNPILERAMDRILILHADHEQNASTSTVRTAGSSGANPFACIAAGIASLWGPAHGGANEAALKMLEEISSVKHIPEFFRRAKDKNDSFRLMGFGHRVYKNYDPRATVMRETCHEVLKELGTKDDLLEVAMELENIALNDPYFIEKKLYPNVDFYSGIILKAMGIPSSMFTVIFAMARTVGWIAHWSEMHSDGMKIARPRQLYTGYEKRDFKSDIKR

SEQ ID NO: 23753 - protein, 1236 aa, Saccharomyces castellii
MSFSTDSTSTRDELPLVENNSLDHPYMGFDKTAQDQIRDLARTLTQLSVAHPSESAIDQGSDVQSIYSTGLPGINPVYTNPDTPGYDEKLDPASDNFSSTAWVKNMANIAKSDPDFYKPYSLGCVWKNLSASGDSADVSYQATILNMPWKIITYVYRKVTPTREIDTFQILKSMDGILNPGELLVVLGRPGSGCTTLLKSISSNTHGFDISKDSIISYNGLTPKDIRRHYRGEVVYNAESDIHLPHLTVYQTLLTVARLKTPSNRIKDVTREDYANHLTQVTMATYGLLHTRDTKVGDDLVKGVSGGERKRVSIAEVSICGSKVQCWDNATRGLDSATALEFIRALKTQATILNTTATVAIYQCSQDTYDLFDKVCVLDDGYQLYYGPSDRAKKYFQDMGYVCPPRQTTADFLTSVTSPTERILNQDMLKNGKKIPQTPREMGEYWLESPDYQQLMQQIDAELSSNQDEQRDVIREAHIAKQSKRARPSSPYVVSYMMQVKYLLIRNYWRIKQRASVTIFQVVGNSVIAFILGSMFYKVQKKADSSTFYFRGAAMFFAILFNAFSSLLEIFTLFEARPITEKHRTYSLYHPSADAFASVLSEVPAKLVTSVCFNIIYYFLVNFKRDAGIFFFYFLISIVSTFALSHLFRCNGSLSKTLPGAMVPASMLLLAISMYTGFAIPETKMLGWSKWIWYINPLAYLFESLMINEFHDRRFPCAQFIPAGPPYQNATGTERVCAAVGSVPGQDFVNGDIFLLESYGYQHKHKWRGFGVGMAFVVFFFFGYLILCEYNEGAKQRGEMLIFPQNIVRKMKKQGKLKGKHPNKDDIEAAASSMECNTTEKSILNSSSINYDDMESEVGLSKSEAIFHWRNLCYEIPIKKEIRHILNNIDGWVKPGTLTALMGASGAGKTTLLDCLAQRVTVGTITGDVFVNGCLRDESFPRSIGYCQQQDLHLKTSTVRESLRFSAYLRQPFDVPVEEKNKYVEEIIKTLEMETYADAVVGVPGEGLNVEQRKRLTIGVELAAKPKLLVFLDEPTSGLDSQTAWATCQLMKKLAQNGQAILCTIHQPSAILMQNFDRLLFLQKGGETVYFGDLGSGCQTMIDYFEKEGAEKCPPEANPAEWMLQIIGAAPGSHAIKDFHKAWRNSEEYKAVQKELDWMEQELPRRASETTPEEHKRFATSVWYQFKLVSVRLFQQYWRSPEYLWSKYLLTVFNETFIGFTFFKADRTMQGLQNQM

SEQ ID NO: 23754 - protein, 391 aa, Kluyveromyces lactis NRRL Y-1140
MGLLPTDKFATKAIHAGTHVDVHGSVIEPISLSTTFKQSAPAQPIGEYEYSRSQNPNRKNLEDAIAALENGKYGLAFSSGSATTAVILQSLPQGSHAVSIGDVYGGTHRYFTKVANAHGVETTFTNNLVAELPSLIKENTKLVWIETPTNPTLKVTDIELVAKTAKSINKDILLVVDNTFLSPYLSNPLNFGADIVVHSATKYINGHSDVVLGVLATNDKVIYEKLQFLQNAIGAIPSPFDSWLVHRGVKTLHLRVRQASLSAHKIAEFLSSNENVIAVNYPGLPTHESYAVVKKQHRDALGGGMISFRIKGGAEAASTFSSSTRLFTLAESLGGIESLLEVPAVMTHGGIPKEQREASGVYDDLVRLSIGIEDTDDLLEDIKQALASASN

SEQ ID NO: 23755 - protein, 333 aa, Glycine max
FRQILVNALFLHLNFFQHETPPPPLSYSPPKTLPSLIPSPSPLTPNHFQKPPKAITARTFAILSALVLLLIQPAFAPAAFATFQNAAKTSGPAAAAVGGKLIRTELLSSAWTGFFAGCLHTLSGPDHLAALAPLSIGRTQMESAAVGALWGCGHDAGQVIFGLIFLLLKDRLHIEIIQTWGTRVVGLTLLVIGAMGIKEASEVPILCVALENGECDVSVYESRDSNPVVGKKKIGFATFATGIVHGLEPDALMMVLPALALPSRLAGAAFLIMFLLGTVVAMGSYTVFIGSCSEALKDRVPRITEKLTWASSLVAIALGFAIITSQFFGFSLY

SEQ ID NO: 23756 - protein, 201 aa, Arabidopsis thaliana
MGGKKTKIEIKKIINKPAKTVAFTKRREGLFRKASQLCLLSPATQIAILAAPMTSKSHASFYSFGHSSVDNVVSSLLYDHPPLTANQDNRSGLGFWWEDKRFDVSENVEELKEAVDAVSRMLNNVRCRLNDAVKSTQRDGGLEILHHQEEEVLQTRNDETKTNQTHEFEGGETSGSASWLENEDDILHFDDDFYTGIDPLF

SEQ ID NO: 23757 - protein, 353 aa, Saccharomyces cerevisiae
  misc_feature (182)..(182): Xaa can be any naturally occurring amino acid
  unsure (1)..(353): unsure at all Xaa locations
MPKRIVYNISSDFQLKSLLGEGAYGVVCSATHKPTGEIVAIKKIEPFDKPLFALRTLREIKILKHFKHENIITIFNIQRPDSFENFNEVYIIQELMQTDLHRVISTQMLSDDHIQYFIYQTLRAVKVLHGSNVIHRDLKPSNLLINSNCDLKVCDFGLARIIDESAADNSEPTGQQSGMTEXVATRWYRAPEVMLTSAKYSRAMDVWSCGCILAELFLRRPIFPGRDYRHQLLLIFGIIGTPHSDNDLRCIESPRAREYIKSLPMYPAAPLEKMFPRVNPKGIDLLQRMLVFDPAKRITAKEALEHPYLQTYHDPNDEPEGEPIPPSFFEFDHYKEALTTKDLKKLIWNEIFS

SEQ ID NO: 23758 - protein, 255 aa, Xanthobacter autotrophicus Py2
MEAFINPGTGRPDTGPVTGLPQRRTGRGNLAGLTRPSRSDFRALSRLDGRARVDDLISGYRRFREVAWPERKQLFERLAARGQKPETLVIACSDSRVDPQMIFDAGPGQMFVVRNVANLVPPFLPDTNYHGTSAAIEFAVRVLKVRDVIVMGHAQCGGVHALLEGAPPGAEDFVAGWMKIAEPARLMAEDASLPIDQRQRFCEQCCVKLSLANLAGFPWVAERISAGELQLHGAYFGVATGQLELLDDDGTFKAV

SEQ ID NO: 23759 - protein, 224 aa, Aspergillus nidulans FGSC A4
MASPNQISNVSQSGITTDAVTGERYIPSSVRADGSKRKEIKVRPGYRPPEDVELYRNRAAAAWKNRGKAGVPGAEGLTQTGSDPSKSVSGSGTAASNKNAKRREAKKKAKAGATLDGTGSTTNGKDISQIDNWRAGSAKQQQQDAPADPVNPEVEREKKARNLRKKLKQARELSDKKNKGEVLLPEQLEKVIKIQELIRQLDALGFDAAGEDKESEFQKEKQEK

SEQ ID NO: 23760 - protein, 125 aa, Bifidobacterium longum DJO10A
MEAVATSEAPAALGAYSQAVKANGFVFVSGQLGIDPATGELAGETAGEQAAQALKNIKHILDTAGTGIEHVCRATIYLKNVEDFKEVDARYAEAFIGSVKPARVAFGNNMIPKGALVEIDAIAVE

SEQ ID NO: 23761 - protein, 510 aa, Zea mays
MATAMGAMAATCMASIPAAATFPGDLGVGRRRAVVPGWRAGGRRLRATPPARRPFLFSPKGVSDSRSSQTCLDPDASTSVLGIILGGGAGTRLYPLTKKRAKPAVPLGANYRLIDIPVSNCLNSNVSKIYVLTQFNSASLNRHLSRAYGNNIAGYKNEGFVEVLAAQQSPENPNWFQGTADAVRQYMWLFEEHNIMEFLILAGDHLYRMDYQKFIQAHRETDADITVAALPMDEQRATAFGLMKIDDEGRIVEFAEKPKGEKLRSMMVDTTILGLDPERAKELPYIASMGIYVFSKDVMLRLLRENFPAANDFGSEVIPGATEIGLRVQAYLYDGYWEDIGTIEAFYNANLGITKKPVPDFSFYDRSAPIYTQPRYLPPSKVLDADVTDSVIGEGCVIKHCTINHSVVGLRSCISEGAVIEDSLLMGADYYETENDKNVLSETGGIPIGIGKNSHIRKAIIDKNARIGENVKIINFDNVQEAVRETEGYFIKSGIVTVIKDALIPSGTII

SEQ ID NO: 23762 - protein, 334 aa, Geobacillus stearothermophilus
AVKVGINGFGRIGRNVFRAALKNPDIEVVAVNDLTNADGLAHLLKYDSVHGRLDAEVVVNDGDVSVNGKEIIVKAERNPENLAWGEIGVDIVVESTGRFTKREDAAKHLEAGAKKVIISAPAKVENITVVMGVNQDKYDPKAHHVISNASCTTNCLAPFAKVLHQEFGIVRGMMTTVHSYTNNQRILDLPHKDLRGARAAAESIIPTTTGAAKAVALVLPELKGKLNGMAMRVPTPNVSVVDLVAELEKEVTVEEVNAALKAAAEGELKGILAYSEEPLVSRNYNGSTVSSTIDALSTMVIDGKMVKVVSWYDNETGYSHRVVDLAAYINAKGL

SEQ ID NO: 23763 - protein, 429 aa, Aeropyrum pernix K1
MASGEKSRMLFERTKELFPGGVNSPVRAAVKPYPFYVKRGEGAYLYTVDGARIVDLVLAYGPLILGHKHPRVLEAVEEALARGWLYGAPGEAEVLLAEKILGYVKRGGMIRFVNSGTEATMTAIRLARGYTGRDLILKFDGCYHGSHDAVLVAAGSAAAHYGVPTSAGVPEAVARLTLVTPYNDVEALERVFAEYGDRIAGVIVEPVIANAGVIPPRREFLAALQRLSRESGALLILDEVVTGFRLGLEGAQGYFNIEGDIIVLGKIIGGGFPVGAVAGSREVMSLLTPQGKVFNAGTFNAHPITMAAGLATLKALEEEPVYSVSREAAKALEEAASEVLDRTGLPYTINRVESMMQLFIGVEEVSNAAQARKADKKFYVKLHEEMLRRGVFIAPSNLEAVFTGLPHQGEALEIAVEGLRSSLKTVLGS

SEQ ID NO: 23764 - protein, 465 aa, Nostoc punctiforme PCC 73102
MVSTHPTGVQHSGSQYLPQRRDTNPNLSPNQELLPLTARVHNHDSLEIGGCDVTTLVKQFGSPLYILDEETLRSACQQYRDAFKQYYKGESQVLYASKAWNCLAVCAIAASEGLGIDVVSGGELYTALQAGVSPEKIYLHGNNKSREELILAIESGVTIVADNWYELRTLVEIAQPGQSIRIMLRLTPGIECHTHEYIRTGHLDSKFGFDPNDLDEVFTFVSQQSTLDCVGVHAHIGSQIFERQPHQDLAAVMVQWLRDAGKYGLNITELNVGGGLGIKYTESDDPPSIEEWVKAICEVVQEACAVENLPLPKLLSEPGRSLIATACVTAYTVGSSKVIPEIRTYVAIDGGMSDNPRPITYQSVYRAVVANKMSSPVTQTVTIAGKHCESGDILIKNALLPKTEPGDILVVMGTGAYNYSMASNYNRLPRPAAVVVANGEANLILQRETYQDLIRQDSLPERLKI

SEQ ID NO: 23765 - protein, 208 aa, Nicotiana tabacum
GKLSTLLLVLILYFIAAGANAQQCGRQRGGALCSGNLCCSQFGWCGSTPEYCSPSQGCQSQCSGGGGGGGGGGGGGAQNVRATYHIYNPQNVGWDLYAVSAYCSTWDGNKPLAWRRKYGWTAFCGPVGPRGRDSCGKCLRVTNTGTGAQTTVRIVDQCSNGGLDLDVNVFRQLDTDGRGNQRGHLIVNYEFVNCGDNMNVLLSPVDKE

SEQ ID NO: 23766 - protein, 694 aa, Zea mays
MGHTSSGNEVPLKYSSGKAFPLGVSQVDDGLNFAIFSQHASSVTLCLNFPERGNQDDVDIVEFALDRQRNKTGDIWHVSVEGLPASGVLYGYRINGPQGWQQGHRFDDSVILLDPYAKLVYGRKHFAVEKEKPSQLFGTYDFDSSPFDWGDNYKLPNLPETDLVIYEMNVRAFTADESSRLAPAIRGSYLGVIDKIPHLLELGVNAVELLPVFEFDELELKRFPNPRDHMVNTWGYSTINFFAPMSRYASAGGGPVAASKELKQMVKAFHNSGIEVILDVVYNHTNEADDVNPYMTSFRGIDNKVYYMLDLNNSAQLLNFSGCGNTLNCNHPVVKELVLDSLRHWVKEYHIDGFRFDLASVLCRGPDGSPLDAPPLIKEIAKDSVLSRCKIIAEPWDCGGLYLVGRFPNWDRWAEWNGKYRDDIRRFIKGDPGMKGVFATRVSGSADLYQVNNRKPYHSVNFVIAHDGFTLCDLVSYNSKHNDANGEGGRDGCNDNYSWNCGIEGETNDLNVLSLRSRQMKNFHVALMISQGTPMMLMGDEYGHTRYGNNNSYGHDTHINNFQWGQLEERKDGHFRFFSEMIKFRHNHPILRRDRFLNKNDVTWHENRWENQDSKFLAFTIHDHSSGGDIYLAFNAHEYFVDAVIPPPPHHKSWSRVVDTNLESPKDIVPEGVPFTGSGYRIAPYSSILLKAKP

SEQ ID NO: 23767 - protein, 480 aa, Bacteroides fragilis YCH46
MEDLNFRKGDAKTEAFGSNRMLQPSPVEKIPDGPTTPEIAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMRQVPLTLDKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVVWKGKEYLPEEMAFSVNYLGANITQVGLNFSRPAAQILGQYYQFIRLGFQGYKEVQYNSLQIAKYIHSQIAKMTPFVNYSEDVVNPLFIWYMKPEYAKNAKWTLYDLQDKLAQHGWMVPAYTLPAKLQDYVVMRVVVRQGFSRDMADMLLGDIKNAIAELEKLEYPTSTRIAQEKNLPVEAKVFNHTGKPQAAKK

SEQ ID NO: 23768 - protein, 321 aa, Bacteroides fragilis YCH46
MDKKISISQIKEVVQQAYEQVKGNTGGKNADYIPYLANIDKNLFGISVCLLNGQTITVGDFDYRFGIESVSKVHTAILILRQYGAQKVLEMIGADATGLPFNSIIAILLENDHPSTPLVNAGAISACSMVTPIGNSDKKWDAIVQNITDLCGSAPQLIEELYKSETATNFNNRSIAWLLKNYNRIYDDPNMSLDLYTRQCSLGVTAQMLSVAAGTVANGGVNPVTKKQVFDSELTPKITSMIATVGFYEHSGDWMYTSGIPAKTGVGGGVMGVLPGVFGVSAFAPPLDGSGNSVKAQLAIKYIMNKLGLNVFNGARVTIVD

SEQ ID NO: 23769 - protein, 1035 aa, Saccharomyces castellii
VAKQSKRARPSSPYTVSYGLQVKYLLERNFWRIRNNASISLFMIFGNSSMAFILGSMFYKVMRKGDTSTFYFRGAAMFFAILFNAFSCLLEIFSLYEARPITEKHRTYSLYHPSADAFASIISEIPTKFCIAVCFNIIFYFLVNFRMNGGVFFFYLLMNVVGVFCMSHMFRCVGSLTKSLSEAMVPASMLLLALSMYTGFAIPKKKMLRWSRWIWYINPLSYLFESLMINEFHDVKYPCAQYIPFGPAYANISGTERVCSAVGAVPGQAYILGDDYIKESYGYKHSEKWRSLGIGLAYAIFFLGVYLFLCEYNEGAKQAGEILVFPRSVIKRLKKEGKLREKNTAEDIEMAADTSVTDKQLLSSDEMAEESGANIGLSKSEAIFHWRNLCYDVQIKDETRRILNNVDGWVKPGTLTALMGASGAGKTTLLDCLAERVTMGVITGDVLVNGRPRDQSFPRSIGYCQQQDLHLKTSTVRESLRFSAYLRQPADVSIEEKNQYVEDVIKILEMEAYADAVVGVAGEGLNVEQRKRLTIGVELTAKPKLLVFLDEPTSGLDSQTAWSICQLMKKLADHGQAILCTIHQPSAILMQEFDRLLFMQRGGRTVYFGDLGKGCQTMIDYFERNGSHPCPADANPAEWMLEVVGAAPGSHANQDYHEVWRNSAEYKAVQEELDWMAQELPKKQVEESAADQREFATSVPYQAKIVSIRLFEQYWRSPEYLWSKFILTIFNQLFIGFTFFKADTSLQGLQNQMLSIFMFVCIFNPILQQYLPSFVQQRDLYEARERPSRTFSWKAFIFSQIVVEVPWNLLAGTLAFFIYYYPIGFYANASAAGQLHERGALFWLFSCAFYVYVGSMGLAAISFNQLAENAANLASLLFTMSLSFCGVMTTPGAMPRFWIFMYRVSPLTYFIDATLAVGVANVDVHCSDYELLRFTPASRMTCGEYMTPYMEMMGTGYLKDSSATDQCEFCTVSHTNEYLSQVNSSYSRRWRNYGIFICYIAINYIFAVLFYYMARVQRIRVRVPVRAFYPSSRNN

SEQ ID NO: 23770 - protein, 241 aa, Brassica napus
  misc_feature (232)..(232): Xaa can be any naturally occurring amino acid
  unsure (1)..(241): unsure at all Xaa locations
GRFEELFTLLTKLPSLNTLSLTSLGISGPLSPKIITKLPPSLQSLNLSSNFISGSIPKEISSLKNLKSLVLTDNLLNGSVFDLRGLSNLQELDLGDNNLGPELPSLPSNLISVSLRNNSFRSKLSEQIKKMNKLQSLDLSSNEFTGSIPEFLLSLPSLQTLSFAQNMFSGSLPNSTCSSSKVRTLDVSHNLLTGKLPSCYSSKSFKNQTVLFSFNCLSLNGTANAKYQRPLXFCQNQASKQ

SEQ ID NO: 23771 - protein, 191 aa, Arabidopsis thaliana
MGGTKRKIEMKRIEDKNVRAVAFTKRKSGLFHKASELCLLSPGTQIAILATPLSSHSHASFYSFGHSSVDHVVSSLLHNQHPSLPTNQDNRSGLGFWWEDQAFDRLENVDELKEAVDAVSRMLNNVRLRLDDAVKSNQRDGSLVIHQEDEEVLQLGYKDTNQITKLEGETSASASLLKNVVDNLHIDDRYY

SEQ ID NO: 23772 - protein, 280 aa, Magnaporthe grisea 70-15
MPSPRRLRLLCIVAVAVLFTLLFTSRLRQASDTDANSIQGLYHKTRTAIDRARADGQAALQRSKNGAAKGHLTLDKDADGDIDQDDEVFAQEMSDRLRAAEQKAKDLANSKSPNKPDAPRHIVGVGSSAGGQTAKKKTTKPALAEAEADEKSMVATSEDKEAKAELDTILRKSPVVIFSKSYCPYSKRAKGILLEKYSIQPAPYVVELDQHPLGPQIQQMLGDMTNRKTVPNILVNGKSIGGGDEITELDASQKLITTVNFYGDKHITMKERFPEKEAAA

SEQ ID NO: 23773 - protein, 225 aa, Haemophilus influenzae Rd KW20
MSNTVATMINKRNIMRNYIKIGVAGPVGAGKTALIEKLTREIASKYSVAVITNDIYTQEDAEFLTKNSLLPPERIMGVETGGCPHTAIREDASMNLEAVDEMVTRFPDVEIVFIESGGDNLSATFSPDLADVTIFVIDVAQGEKIPRKGGPGITRSDLLVINKTDLAPFVGADLSVMERDARRMRNGQPFIFTNLMKKENLDGVIGWIEKYALLKNVEEPASLVR

SEQ ID NO: 23774 - protein, 669 aa, Kluyveromyces lactis NRRL Y-1140
MMRGFKQKLIKKTTGSTSSSSNQKRKDKEKEEKKEKEHSKRSPSTSGSSSARSSLDKTSHRSGSTGSNAGSSRRVDSKSGSNNHNNHGSSNSNASGSGSSANNNQNDGVPRTPSVNITKADSNAVGKPTLIGAAAQVTPPPTSPKAQPASLNTPSSATGSTTVLKDSQRSPTSIEIPRSSHSFERLPTPTKLNADSDLEMIKTPQRHSSSRFEPSRYTQIVKLPRFEEVLPEEQIPLFITKVDQCNTMFDFNDPSFDIQGKEIKRVTLQELIEFIVTNRFTYTEEMYEHVVNMFKINLFRPIPPQVNPVGDVFDPDEDEPVNELAWPHMQYVYEFFLRFVESPDFNHQIAKQYIDQNFILKLLELFSSEDIRERDCLKTTLHRIYGKFLSLRSFIRRSINNIFLQFTYETERFNGIAELLEIMGSIINGFALPLKEEHKVFLVRVLIPLHKVRCLSLYHPQLAYCIVQFLEKEPLLTEEVIMGLLRYWPKINSTKEIMFLNEIEDIFEVIEPLEFIKVEVPLFVQLAKCISSPHFQVAEKVLSYWNNEYFLNLCIENAEVILPIIFPPLYKLTSQLDKNDPLSLEDGDNGEDPYLMVEQAINSGSWNRAIHAMAFKALKIFLETNNVLYENCNALYISSLKENNRRQKEREMNWKQLEDYVSKLKIAES

SEQ ID NO: 23775 - protein, 140 aa, Brucella suis 1330
MAIERTFSMIKPDATRRNLTGAIIAKLEEAGLRVVASKRVWMSRREAEGFYAVHKDRPFFGELVEFMSSGPTVVQVLEGENAIAKNREVMGATNPANADEGTIRKTFALSIGENSVHGSDAPETAAEEIAYWFSGTEIVG

SEQ ID NO: 23776 - protein, 133 aa, Pseudomonas fluorescens PfO-1
MKNWLDEIKWDADGLVPAIAQDHKTGRVLMMAWMNREALELTAAENRAIYWSRSRGKLWRKGEESGHVQTLHEMRLDCDADVIILMVEQIGDIACHTGRQSCFYRVFENGDWKTVDPVLKDPHAIYSAGHKHE

SEQ ID NO: 23777 - protein, 534 aa, Pseudomonas fluorescens PfO-1
MKLLAVRRLLRIQRVVIRYRLDDLLFDLPLPWFLLALRYVLPWRWFPRKPLELSRGARLRLALQDLGPIFIKFGQILSTRRDLLPEDIADELMRLQDRVPPFDSQLSVKLIEEQLGKKISEVFSRFDVEPLASASVAQVHAAQLKTGEEVVVKVIRPGLKPIIAQDLAWLFILARAAEKVSADARLLHPVDVVSDYEKTIYDELDLLREAANASQLKRNFEGSPLLYVPQVYWDWCRPKVLVMERIYGIQVTDLATLADQRTDMKMLAERGVEIFFTQVFRDSFFHADMHPGNIFVSTVNPWSPQYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPDLDLWNTAQPFLERWMRERVSPKALLGNVQSQFEQLPHLANMARDLLERMSQPHANDPPPPWKKRKDDWFLRLLGSAHLAGGTILAAGGPLHELGHWPAGIMVAVGLYLVVRR

SEQ ID NO: 23778 - protein, 415 aa, Coprinopsis cinerea okayama7#130
MGVGLTVLRQATVVGTTALQRRLLVSLEINNKDRAYEWFLTWMAHQSNAPSTMRNRAASWIRSHQLSVETTVEQRKNGSSSAAFRLVAGPGNHYFRYKGAWMQVKRERETKSMQLMSGTPWETVTLTTLSRDRNLFTELLSEARDMAMRTQQGKLVIHTAWGIEWRPFGQPREKRPIQSVVLADGVAEKIESDVKAFLDRRKWYADRGIPYRRGYLLYGPPGSGKTSFIQALAGSLSYDICVLNLSERGLTDDKLFHLLSNVPERSFILMEDVDAAFNKRVQTSEDGYQSSVTFSGFLNALDGVASGEERIIFLTTNHLEKLDPALIRPGRVDLAELIDDAHPNQARTLYERFYGGGEAVTGLPDEKVKSLARKLESIVETEWSAGRKVSMAALQGHFIQSDAQAAVDTCHILFK

SEQ ID NO: 23779 - protein, 457 aa, Oryza sativa (indica cultivar-group)
MAGAAAASAAAAAVASGISARPVAPRPSPSRARAPRSVVRAAISVEKGEKAYTVEKSEEIFNAAKELMPGGVNSPVRAFKSVGGQPIVFDSVKGSRMWDVDGNEYIDYVGSWGPAIIGHADDTVNAALIETLKKGTSFGAPCVLENVLAEMVISAVPSIEMVRFVNSGTEACMGALRLIPSLLKAGSGVATLGLPDSPGVPKGATSETLTAPYNDVEAVKKLFEENKGQIAAVFLEPVVGNAGFIPPQPGFLNALRDLTKQDGALLVFDEVMTGFRLAYGGAQEYFGITPDVSTLGKIIGGGLPVGAYGGRKDIMEMVAPAGPMYQAGTLSGNPLAMTAGIHTLKRLMEPGTYDYLDKITGDLVRGVLDAGAKTGHEMCGGHIRGMFGFFFTAGPVNNFGDAKKSDTAKFGRFYRGMLEEGVYLAPSQFEAGFTSLAHTSQDIEKTVEAAAKVLRRI

SEQ ID NO: 23780 - protein, 516 aa, Triticum aestivum
  misc_feature (297)..(297): Xaa can be any naturally occurring amino acid
  unsure (1)..(516): unsure at all Xaa locations
MADLLQKLLPETLPPAWLFLFLLFLVVSVQYWFTGKLGAKRRQRLPPSPQALPIIGHLHLIGSLPHVSLRSLARKHGPDMMLLRLGAVPTLVVSSPRAAEAVLRTHDHVFASRPHSVVSDTIMYGSADIGFAPYGEYWRQARKLVTTHMLSVKKVQSFRGVAVEEVSMAMAKINQAAAADAAVDMSELLHTFANDMACRIVSGKFFLKDGQSKLFGELIKDTSRLLGGFNLEEYFPAVGRVGVLKKAVCAKAERVRNRWADLLDKVIDDRVSKRNSTSDHKDDDFVDIMLSVQQEYXDLTREHMKALLTDVFFGAIDTSANALEFTLAELMRKPHLMVKLQDEVRGIVPQGQEIISETDMNNMTYLRAVIKESLRLHPLAPLLAPHLAMADCIIDGYIVPAGTRVVINAWAIGRDPSSWEYAEEFIPERFTDEGSSMHVNFKGNDFQFLPFGAGRRMCPGMNLGIANVELMLANLVCHFDWQLPLGVERKDIDMTEVFGLTVHRKEKLLLIPKSRM

SEQ ID NO: 23781 - protein, 430 aa, Acidovorax sp. JS42
MHHLILGAGPAGVIAAETLRKHAPGDRITLVGDEAEPPYSRMAIPYLLVGDIDERGTYLRKRADHFAQQRIDRLSARAAGVDVQARTVALEGGVTLGFDRLLIATGSHPVRPPIPGLDLPGVQTCWTLADARAIAARARPGARVLQMGAGFIGCIIMEALQKRGVQLSVVEMGDRMVPRMMGAVAGGMIRDWCERQGVQVFTGHKVERIDRAQGEGSGDALRVHLSGGRVLDADLVISATGVRPAIGFLAGSGVTCLQGVLTDERMQTNVPGIYAAGDCAEAFDPFTRKTVVSAIQPNAAEQARVAALNMLGLPAALAVVTQINVLDTLGLISTSFGNWQGVPGGEQVALTDAAAGKHLSLQFEGDRLIGCNSVGMTQHVGAMRGLVEGQVRLGPWKEHLRRDPTRLMEAYLACAQGQGHWSGAQDARRR

SEQ ID NO: 23782 - protein, 559 aa, Acidovorax sp. JS42
MTDRPWLGAYPQGVPADIDPTQYTSLVELMEQAFRDYADRTAYSFMGKETSYRETDALSRQLAAYLQSLGLVRGDRVALMMPNVPQYPIAVAAVLRAGFVVVNVNPLYTPRELEHQLKDSGAKAIVIIENFAATLQACIANTPVQHVVLCAMGDRLGLPKGLLVNYVVRNVKKLVPAYQLPGAVRFNDALAKGAGLQLNKPSLKSDDIALLQYTGGTTGVSKGAVLLHRNVIANVLQSEAWNKPATSKIPESEQPTAVCALPLYHIFAFTVNMMLSMRTGGKTILIPNPRDLPAVLKELSKHTFHSFPAVNTLFNGLANHPDFNTVNWKNLKVSVGGGMAVQAAVAKLWLDKTGCPICEGYGLSETSPSASCNPVTATEFSGTIGVPLPSTSMRILDDEGHDISATGQAGEIAIKGPQVMAGYWQRPDETAKVMTEDGYFKTGDIGVMDARGYFKVVDRKKDMVLVSGFNVYPNEVEDVVALMPGVLECAVVGVPDEKTGEAVKLVIVKKDPALTEAQVKDFCRANLTGYKQPKVIEFRTELPKTPVGKILRRELRDKK

SEQ ID NO: 23783 - protein, 409 aa, Mycoplasma pneumoniae M129
MVDFKTVQAFDFQGKTVVLRADLNVPMKDGVITDNERILASLDTIKYLLGHNCKIVLLSHLSRVKSLDDKKGKKSLQPVASALQNLLKNTKVHFCPENTGDKVKVAVNQLPLGEILVLENTRYCDVNEAGEVVKHESKNNAELAQFWASLGDIFVNDAFGTAHRRHASNAGIAKYIKNSCIGLLMERELINLYRLINNPPKPFVVVLGGAKVSDKLQVVNNLFKIADHILIGGGMVNTFLKALGNEVGTSLVEEDLVQTAKQILDSDKDKKIVLGVDQMLHASFKDEPGVECVVAPQWPAELQGFMSLDVGSKTVALFSSYLAKAKTIFWNGPMGVFEFSNYAQGTLAIGKAIAQNQQAFSVIGGGDSAAAAKQLQIADQFSFISTGGGASLALIGGEELVGISDIQKK

SEQ ID NO: 23784 - protein, 337 aa, Mycoplasma pneumoniae M129
MLAKSKTIRVAINGFGRIGRLVFRALLSQKNIEIVAVNDLTHPDTLAHLLKYDSAHGEFKKKVVAKDNTLMIDKKKVLVFSEKDPANLPWAEHNIDIVVESTGRFVSEEGASLHLQAGAKRVIISAPAKQKTIKTVVYNVNHKIINAEDKIISAASCTTNCLAPMVHVLEKNFGILHGTMVTVHAYTADQRLQDAPHSDLRRARAAACNIVPTTTGAAKAIGLVVPEATGKLNGMALRVPVLTGSIVELCVALEKDATVEQINQAMKKAASASFRYCEDEIVSSDIVGSEHGSIFDSKLTNIIEVDGNKLYKVYAWYDNESSYVNQLVRVVNYCAKL

SEQ ID NO: 23785 - protein, 192 aa, Yarrowia lipolytica CLIB122
MQSIKCVVTGDGAVGKTCMLISYTTNAFPGEYIPTVFDNYSANVMVDNKPINLGLWDTAGQEDYDRLRPLSYPQTGVFLICFSLVSPPSFENVKAKWHPEISHHAPNTPIILVGTKLDLRNDSETLARLAEKRQAPITYAEGAKCARDIGAVKYFECSALTQKGLKTVFDEAIHAVLSPPQPKKKKKNCVIL

SEQ ID NO: 23786 - protein, 172 aa, Neisseria gonorrhoeae FA 1090
MTTHFVVTGVCGCGKTTAAPSLQKHLGQCPYAEGDEFHTQANRDKMGAGIPLTDEDRYPWLGNLRDWMTQQAQNGADHTIVTCSALKRGYRDILRGAEGKAAFIHLSPPQDINLERMMSRKGHYMKAGVLDSQLEILEELGEGEYGVKIANPGTPEAVEADILNWVASENLL

SEQ ID NO: 23787 - protein, 366 aa, Burkholderia xenovorans LB400
MTAMMKAAVFIEPGRIELADKPVPDVGANDALVRITTTTICGTDVHILKGEYPVAKGLTVGHEPVGVIEKLGSAVLGYQEGQRVVAGAICPNFNSYAAQDGVPSQDGSYLIARGLCGCHGYKATAGWRFGNMIDGTQAEYVLVPDAQANLAPVPDGLTDEQVLMCPDIMSTGFKGAENANIRIGDTVAVFAQGPIGLCATAGARLLGASTIIAVDGNDHRLEIARKMGADVTLNFKNCDVVDEILKLTGGRGVDSSIEALGTQSTFESALRILKPGGTLSSLGVYSSDLTIPLGAFAAGLGDHKINTALCPGGKERMRRLLNVVESGRVDLGALVTHHYKLDDIVAAYDLFANQRDGVLKVAIKPH

SEQ ID NO: 23788 - protein, 265 aa, Ralstonia eutropha JMP134
MRPLKVFLTGASSGLGQALAREYAQQGAILGLVARREDALRDLAQSLPNPGAVHVYAADVRDADAMQRAAQDFLDRYGVPDVVIANAGVSVGTVASEREDLEAFRMVMDTNWFGVLTTFQPFLQPMRDRDPGVGGWRGTLVGIASVAGVRGLPGGGAYSASKSAVIKLLESLRLEERRHGIRVVTIAPGYIRTPMTAHNPYRMPFLTDADVFARKAVKAIGAGSRFKVIPWQMGMVASLMHLMPRWLYDALAASAPRKPRNGEGD

SEQ ID NO: 23789 - protein, 410 aa, Candida glabrata CBS 138
MLTKLPHSVQTNIHIITLCLCWYFISSLASQVTKQILTICPLPLFLGEFQFLFTALLAAISCALAFNYRWIYDLFPEGTFPRYYVTIHEHENERDQERIYAITRPSKHIITTVLPLSFFQFVGKYFGHTATALVPVSTVASVKTLSPVFIVIFQKMLKMPTVNLNVRILTSLAALIFGVWLIVNEDNKQKLASKKKTQLIDTESGRSSNYGIVCAIISMFIFVMQNIYGKKVFTYKRNHEKTMIPKKKSIYNLGDNPSELPIYSESKTLSPKTTKYDKLTLMIYISLVGFSLSFFWFMTIEFSTVWRYLCGYTTQSDGQPLIISTIPWTLFLLNGVFHFMQAMITFHLLGEVSTLTYSIANLMKRIAIISVSWLFAGIHVTLLQIVGLSLNAIGLFLYERYSSTQKHANK

SEQ ID NO: 23790 - protein, 163 aa, Zea mays
  misc_feature (150)..(150): Xaa can be any naturally occurring amino acid
  unsure (1)..(163): unsure at all Xaa locations
MKKLTGRTIPVPRSRGFTRRTGDLLTDRFLSPFRNRQEARPPRVYISAQHRPKAGQDGGSSESTGESKLQMASVGGAVAGGVGAPTPHVLAVDDSSVDRAIIAAILRSSRFRVTAVESGKRALELLGTEPNVSMIITDYCMPEMTGYELXQKGQESSKLKQIP

SEQ ID NO: 23791 - protein, 286 aa, Triticum aestivum
  misc_feature (137)..(137): Xaa can be any naturally occurring amino acid
  unsure (1)..(286): unsure at all Xaa locations
MAAAPAGPQNRCVFVGNIPYDATEEQLVQICEEVGPVVSFRLVVDKETGKPKGYGFCEYKDEETALSARRNLQGHDVNGRQLRVDFAENGRNTDRNREKLGRGGPGMSSTFMYAQKQLTTTPAVGDTSLHQLIGLHXAIHAASVMAGVLGGAQTANVQNGLPVQFGLGNDPLTHYLARMSRHQLYQIMSELKTLTTQNNDLAKKLLQGIPQLPKALFQAQIMLGLVTPQMMQMAKSQQPSSSLAQSSHLNESFPQPDAVLPIVHRPPPNPNVFKHNKVGTGGGKGV

SEQ ID NO: 23792 - protein, 202 aa, Prunus dulcis
  misc_feature (50)..(50): Xaa can be any naturally occurring amino acid
  unsure (1)..(202): unsure at all Xaa locations
MASYEKQYGATPTDEYGNPIRRTDEYGNPLGHHTTTTGTTAATTGAGGYXPHDFAATTAAGQGQGVHGHDYDRKEHHGVTGAVLHRSGSSSSSSSEDDGLGGSRKKKGLKEKIKKKLPGGTKTDTTYGGTGTTGQHHQEKGTMDKIKEKLPGTGGHRADDPYPSQTHTTATTTPYGGTAYTEEHQEKKGIMDKIKEKLPGQH

SEQ ID NO: 23793 - protein, 685 aa, Oryza sativa (japonica cultivar-group)
MSPESTGGPVHPPSHKHHRRPYHPHSPSPSPLPQGCTDNCSDPMTTTPIGSPCGCVLPICVIVDLDVAPYLLFMRIAELEVEVAAGTFLKQSQVKIMAAIPSIQDDQKTRVTIYLVPLREQFDGYTASLISDRFWNNKIQINSSIFGDYEVINVTYPGLRSPPPSLPETSHGSDPTGTGEDPITADVHHGKNKKLDSWIIVVVAGSSITLIAACIGLGVLLLKWYKLRQLQEAVSPATTPAVNRRYGGRSTLSVSRVSSASASMLSTVATCTTSVKTFSLSQLEKATDGFDSKRVLGQGGFGRVYHGTMDGGDEIAVKLLTREDRSGDREFIAEVEMLSRLHHRNLVKLIGICIEHNKRCLVYELIRNGSVESHLHGADKAKGMLNWDVRMKIALGAARGLAYLHEDSNPHVIHRDFKGSNILLEEDFTPKVTDFGLAREATNGIQPISTRVMGTFGYVAPEYAMTGHLLVKSDVYSYGVVLLELLSGRKPVCMSDTNGPQNLVTWARPLLCHKEGLERLIDPSLNGNFNFDDVAKVASIASMCVHNDPSQRPFMGEVVQALKLIYNDAEAACDDSYSHRDSSCDQYDDYHGALALDSGSGSWWNRSSNPSGFFDNRNPLPVITMEYSSGRIEGARDPRFALSTGGHAQSPALQNRSGPIRMKKKLASFYRSRGSFSEHGQLPRH

SEQ ID NO: 23794 - protein, 466 aa, Pseudomonas putida GB-1
MKSYDVVIIGGGPGGYNAAIRAGQLGLSVACVEGRSTLGGTCLNVGCMPSKALLHASELYEAASGDEFAHLGIEVKPTLNLAQMMKQKDESVTGLTKGIEYLFRKNKVDWIKGWGRLDGVGKVVVKAEDGSETALQAKDIVIATGSEPTPLPGVTIDNQRIIDSTGALSLPQVPKHLVVIGAGVIGLELGSVWRRLGSQVTVIEYLDRICPGTDTETAKTLQKALAKQGMVFKLGSKVTQATASADGVSLTLEPAAGGTAESLQADYVLVAIGRRPYTKGLNLESVGLETDKRGMLGNEHHRTSVPGVWVIGDVTSGPMLAHKAEDEAVACIERIAGKPHEVNYNLIPGVIYTRPELATVGKTEEQLKAEGRAYKVGKFPFTANSRAKINHETEGFAKVIADAQTDEVLGVHLVGPSVSEMIGEFCVAMEFSASAEDIALTCHPHPTRSEALRQAAMNVDGMAMQI

SEQ ID NO: 23795 - protein, 342 aa, Coprinopsis cinerea okayama7#130
MGGRETRKMNTYQAVRDAMAIALAKDSTAVVFGEDVAFGGVFRCTMGLAEEFGRERVFNTPLTEQGIAGFGIGLAAMGQTAIAEIQFADYIYPAFDQIVNEAAKIRYRSGGTFNCGKLTIRTPTMAVGHGGLYHSQSPEGFFMGATGLKVVIPRSPSQAKGLLLGSIRDPNPVIFMEPKILYRSAVEQVPVDDYELPLGKAEVLVQGSDLTLLTWGTPVYHCETALHMLNSPSPELEPYVPASFRSAKIELIDLRSILPWDMETVVESVKRTGRLVIVHEAGMTAGAGAEIAAEVQKRCFLKLNAPVRRVTGWDLPVALQYEKFHIPDAIRILDAMVETLAY

SEQ ID NO: 23796 - protein, 678 aa, Acidovorax sp. JS42
MANSQQMANAIRALAMDAVQQANSGHPGAPMGMADMAVALWGRHLKHNPTNPQWMDRDRFVLSNGHASMLLYSLLHLTGYDLPLQELKNFRQLHSKTPGHPEHGITPGVETTTGPLGQGVTNAVGFALAEKLLAAEFNREGHAVVDHHTYVFLGDGCLMEGISHEAVALAGAWKLNKLIALYDDNGISIDGQVAPWFIDNTPQRFMACGWNVIDAVDGHDVEAVAAAIGQAKASADKPTLIVCKTVIGKGSPNRANTAKAHGEPLGAEEINLTRAALGWTHEPFAIPESVYADWDAKAAGQAAEAEWTLRFAAYEAAYPELAFELSRRMAGDLPKHFAQVAVDTVVAAHTKAETVASRKASQIALEAFTAALPELLGGSADLTGSNLTNTKSTPALRIEPNGAVAKTEAGQVGRHINYGVREFGMAAIMNGLALHGGFIPYGGTFLTFSDYSRNAIRMAALMKQRVIHVFTHDSIGLGEDGPTHQSIEHAASLRLIPGLDVWRPADTAETAVAWSVALSNRDKPTALLLSRQNLPYAPKSDLGDISRGAYILSEPAAVGLKKKAQAVIIATGSEVQLALAAQQLLAAKKIAVRVVSMPSTTTFDREDTKYKQLVLPAGTPRIAVEMGVSDFWWKYGCAAVVGIDTYGESAPAGVLFKHFGFTAENVADTVLAALQRAR

SEQ ID NO: 23797 - protein, 80 aa, Anaplasma marginale str. St. Maries
MREVLIYTKVPCPYCTRAKALFNKKNVPFKEIDITDNPEAMREMVERSGRRTVPQIFIDGKSIGGCDDLYALYESGELEL

SEQ ID NO: 23798 - protein, 333 aa, Acidovorax sp. JS42
MTIKIGINGFGRIGRNVLRSAVQNFSDIEVVGINDLLEPDYLAYMLRYDSVHGRFKGEVSVEGNTLIVNGKKIRLTQERDPANLKWNEVGADIVIESTGLFLDKASAEKHIAAGAKKVLMSAPSKDDTPMFVFGVNHATYAGQAIISNASCTTNCLAPVAKVLHDKWGIKRGLMTTVHAATATQKTVDGPSNKDWRGGRGILENIIPSSTGAAKAVGVVIPSLNKKLTGMSFRVPTSDVSVVDLTVELEKEASYDEIKAEMKAQSEGALKGVLAYTEDKVVATDFVGETHTSVFDADAGIALDKTFVKVVAWYDNEWGYSNKCLEMVRVMAGK

SEQ ID NO: 23799 - protein, 165 aa, Lavatera thuringiaca
MAEEHNKKIAECTVETQDRGTFDLSGNKKEDEKPQVQADVIANYVDKVKDEETKADKEHKEDEKSSSDKEEVESGEMKKEGDCEKKGVMEKIKEKLPGQHKKDEEVVTAPPPPAAVSSESIVVEHHEEESKEKKGIMEKIKEKLPGYHSKTEDEKEKETSTAANH

SEQ ID NO: 23800 - protein, 219 aa, Chromobacterium violaceum ATCC 12472
MNRSFDALLFDMDGLMLDTETLSCAATRRAGAELGIRIDEAMLMGMVGLSEARCTRYIAEYLADEEQAALLQRTSRACYRRMLEQEEIPLKPGIVELLDWAQSQDIPRAVATSTRRAIADVKLARSGLARYFRHTIAGDEVARTKPEPDIYLAAAALLGAAPERCIVLEDSPYGMQAGVAAGARVILVPDLIAPSQQQREQALATCPDLLQALALLREL

SEQ ID NO: 23801 - protein, 499 aa, Aeropyrum pernix K1
MVLCPGVRMASPEDAISTEDMRAFEINAENLGVSIELLMENAGNAVAGVLECLLGGLQGAKVAVLAGKGGNGGDGIAAARRLAARGARVEIHLTHPRGEVKHPAARTMLKGVEASRVEVLEPGAPGWLDLGGVDAVVDALLGIGVKGGLRGSVKAAAEAYNKAGGLKISVDVPTGVDPDTGDAVEGAVRSDYTVSMHKPKKGLFKGAAPLYAGEVLTAEIGVPWAAEYYAGPGDVAARIPRRPRDAHKGVGGRVLVVGGSSEYVGAPILAALAAYAAGVDLVYLASPFSREAALARPEIVPRRMEEASRVVERVHAVVAGPGMGGEGEDLLWEVLDAARKRGVPAVVDADGLKALARRGDRLWGGAVLTPHRGEAKLLLGGEDLPPLRAAREIAARYGATTIVKAPVDAVCSPEGRCRESPWGAPEMSVGGTGDVLAGVLAGFLARRRALGLDPDPLNTAAAALYTVGKAGEDLATEEGLVSPLRLVEAVKRVVAGSRT

SEQ ID NO: 23802 - protein, 523 aa, Yarrowia lipolytica CLIB122
MSNALNLSLALGVFLLAYYGFSVIQYHIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 23803 - protein, 163 aa, Oryza sativa
  misc_feature (25)..(25): Xaa can be any naturally occurring amino acid
  misc_feature (44)..(44): Xaa can be any naturally occurring amino acid
  misc_feature (64)..(64): Xaa can be any naturally occurring amino acid
  unsure (1)..(163): unsure at all Xaa locations
NEFEDRGPTKDRPSVMVKPDGVPPXGLGGTITQRFEDKGLKLVXAMKMVWPTEAHLKERSADLXSRPFFPGLVKYMSSGPVVPMVWEGLNAVKTGRVMLGETNPKDSAPGTIRGDFCVQVGRNIIHGSDSVESATKEIKLWFGDEKKKEVIAWASWAEKWIYE

SEQ ID NO: 23804 - protein, 223 aa, Ralstonia eutropha JMP134
MSDAIAQLFRNNREWVDRVNAEDPTFFMRLANQQAPEYLWIGCSDSRVPANQILGLAPGEVFVHRNIANVIAHSDLNALSVIQFAVEVLKVRHITVVGHYGCGGVKVALKRERIGLADNWLRHVRDVADKHEAYLGTILREEDAHTRLCELNVIEQVSNICQTTVLQDAWSRGQAVTVHGWIYGVSDGLLRDLGMAASNNDELHEQLAAAYRQFGDPPQASIR

SEQ ID NO: 23805 - protein, 783 aa, Candida albicans
MDKIRAVISGGEKPPVDTDNDHNTDFEADRKMPDLDIVVSKSQEFDPVTSHLVNDIMEDEYAAVHVEDDSPYPEVRAAVPSTDDPTLPQNTIRAWVIGLILTTVGCGMNMLFSFHSPSFAITTFVTSILAWPIGNFWAWIVPDWKIFGASLNPGPFNVKEHTIITIMANVSFGTGAAYATDILLAQNMFYKSNFGWGYNLLLIWSTQCIGFAFGGVMRRFVVDSPGAIWPSNLVTATFLTNMHINENHTANGWKISRLAFFVIVFVASFVWYWFPGYIFQALSYFSWITWIKPNNVIINQVFGSSSGLGMIPNNIALDWNQIAGYIGSPLIPPASVIATIFGSIVLIFWIVVPAIHYSNTWYSQYLPISSTGSFDRFQQTYNVSKIIDHKTLSFNEAEYKKYSPLFLSTTFAISYGLSFASILATITHTICFHGRDLIASLKAKEKPDVHNRLMKAYKPVPEWWYLVVFLVFFGMSIATVRAWPTEMPVWGLVFALIIAIIFLLPVAIIYAKTNIAVGLNVVTEFIVGYVLGGRPLCMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 23806 - protein, 494 aa, Magnaporthe grisea 70-15
MSGLAMQSTQLRMGEGAGAGAGAGPGLAPASSGAPGLGIEALYNNPMFAGGLGLAGIGAAAAVARRGVIRGAQLLRKNLLVNVEISRRDPSYPWVLAWLSQPRPAHGFLMSKLTRIRDLSVATATESSRTDPLGASDDATRASFFLQPGYGRHIIRHSDGTYIAVHREKQSTANHQTGEPHETVTLTTLWSHRHVFEHVFSEAHALAKSAQAGKTPVYNIQGMSWAQLGLPRRKRPLASVVFEKGLKEAIVEDVQDFLSRHQWYADRGIPYRRTYLLHGPPGSGKSSFIHALAGELDYNLAIVNLVERGLTDDKLANMLMRLPPRSILLLEDVDVAFGNRQEMSPDGYSGATVTYSGLLNVLDGMAAGEDRIAFLTTNYVERLDPALIRPGRVDVKVRVGEATPEQAAELWSRFYGDVDTSGSGRERFIAKLYKLGFFAEPAEGRMTLRVSAAAIQGLFLTNKEDMEGAISHMEAHLIPGHSHHGSELHRTTAQ

SEQ ID NO: 23807 - protein, 450 aa, Pseudomonas fluorescens PfO-1
MTGQSCGDFARRVSSLTSLSNSKKRNAKMSDLKTAALEYHANPRPGKLSVELTKATATARDLSLAYSPGVAEPVREIARDPELAYKYTGKGNLVAVISDGTAILGLGNLGPLASKPVMEGKGVLFKRFAGIDVFDIEVDSESPQAFIDTVKRISITFGGINLEDIKAPECFEIERALIEQCDIPVFHDDQHGTAIVTAAGMINALEIAGKTLADAKIVCLGAGAAAISCMKLLVSMGAKVENIFMVDRTGVIHAGRDDLNQYKAVFAHPTEKRTLDDAIEGADVFVGLSGPNLLSAEQLKRMAANPIVFACSNPDPEISPELAHATRNDVIMATGRSDYPNQVNNVLGFPFIFRGALDVRAKRINEEMKIAAANALRELAKLPVPQEVCDAYGGISLEFGREYIIPKPMDKRLITVISDAVAKAAIETGVATLPYPKNYPLKSVDDVFNG

SEQ ID NO: 23808 - protein, 153 aa, Coprinopsis cinerea okayama7#130
MYLEDRTVRLQLWDTAGQERFRSLIPSYIRDSSVAIVVFDITNRQSFLSTTKWIDDVRSERGNDVIIVLVGNKADLSDKRQVTVEEATTKATQLNIMFMETSAKAGHNVKSLFKKIAMSLPGMEKDATAEANTKIDVSTPTAAEVPEASQCNC

SEQ ID NO: 23809 - protein, 420 aa, Idiomarina loihiensis L2TR
MSELIDYKNGQFHIENCDVESLIERFSSPLYVYSKGQILKNWREFQQYWPAPHKLCYAVKANSNLAILQLLAEHGAGFDIVSGGELQRVLMAGGKAGDVVFSGVAKSKDEIIMALEAGIGCFNVESEAELERIQDIAAAMDKQAPVSLRVNPDVDAKTHPYIATGMKANKFGISMSLAKPVFLKAHSLPNINLIGADCHIGSQIMTAEPFLDAAQRMFNLVSELEKDGVQLTHLDLGGGFGVAYQPEEPLDKSFYLKELVKLAENYPQITLVLEPGRAITADAGVLLTTVEYIKPSEDKNFVLVDAGMNDLIRPSLYQAWHDILPAHENKRGGDQLNDIVGPVCETGDFFGHARHLNVQQGDVLAIKHAGAYGFTMASNYNSRGRPPEVLVSGDNATLIRERESFNDLVRGEHLLHQEGQ

SEQ ID NO: 23810 - protein, 371 aa, Oryza sativa (indica cultivar-group)
MQALRPAAAAAAARTYSAAAKEMTVREALNSALDEEMSADPSVFLMGEEVGEYQGAYKISKGLLDKYGPDRVLDTPITEAGFTGIGVGAAYQGLRPVVEFMTFNFSMQAIDHIINSAAKSNYMSAGQINVPIVFRGPNGAAAGVGAQHSQCYAAWYAHVPGLKVLTPYSAEDARGLLKAAIRDPDPVVFLENELLYGESFPVSAEVLDSSFCLPIGKAKIEQEGKDVTITAFSKMVGYALQDVREPQMKEKDVKFQAAEILSKEGISAEVINLRSIRPLDRATINASVRKTNRLVTLEEGFPQHGVGAEICMSVVEDSFEYLDAPVERIAGADVPMPYAANLERMAVPQVEDIVRAAKRACYRAVPMAATA

SEQ ID NO: 23811 - protein, 334 aa, Acidovorax sp. JS42
MTTALPASPSSVFASSPNPVVVITGASSGIGHATALAFARRGARLVLAARNPDTLAPVALACRAEGGQALGIPTDVTDADAVQALADKAVRHFGRIDVWINGVGVGAVGRFDDVPLAAHRRVIESNLLGHVHGAHAALTRFRAQGHGLLVNLISLGGWVPAPYAAAYTASKFGLRGLSESLRAEVVDLPQVHVCDVAPTFVDSPGLSHGANYTGRRIRPPLPMVDPRAVAQAIVDLAGAAHPRAVTWLGLGAMPGRVAHALAPQGTARAMRWFSDLGLRRAAPAPLTQGNLFAPSHQTSIDGGHRQRMAGSATVVTVLGVVGLAVGWWWGRGRR

SEQ ID NO: 23812 - protein, 535 aa, Glycine max
MGSISHVITTTLPHLPSTRSLGFPISHSNSRLLSLPPTRVAKQVGVFAELVSRSSTASFASVDFSVHDWKIQFHEDCQLRRPPPHLTDIFPNAPPIPSTFCLKMRTPIDRDFPGHYSLDEEWHGYINNNDRVLLKTIYYSSPTSAGAECIDPDCTWVEQWVHRAGPREKIYYKPEEVKAAIVTCGGLCPGLNDVIRQQIVITLEIYGVKNIVGIPFGYRGFSDKELTEVPLSRKVVQNIHLSGGSLLGVSRGGPGVSDIVDSLEKRGINMLFVLGGNGTHAGANAIHHECRKRRLKVSVIGVPKTIDNDILLMDKTFGFDTAVEEAQRAINSAYIEAHSAYHGIGVVKLMGRSSGFIAMQASLFSGQVDICLIPEVPFNLHGPHGVLSHLKYLLETKGSAVVCVAEGAGQNLLQKTNATDASGNVVFGDIGVYIQQETKKYFKEIGVHADVKYIDPTYMIRAIRANASDGILCTVLGQNAVHGAFAGYSGITVGLCNTHYVYFPIPEVISHPRLVDPNSRMWHRCLTSTGQPDFI

SEQ ID NO: 23813 - protein, 266 aa, Myxococcus xanthus DK 1622
MCTIIILRHIHPEWPLVLAANRDEFYARPATGPQVLLESPLAVGGRDEERGGTWMGVTHGGLFVGLTNQRGERGQGPAPRSRGEVVLKALQAGSVDAVDRYLDSLPGDEFMPFNLLYGDAQRLRVAYARRTDRQLRREDVPPGVHVLPNDVLNAPELPKVERARLLTTEVAKKPWPELAEGLKAVLADPTLPTEELIPPPGAGEDLPRDFLQRLQALCIHTPLYGTRSSAVVALAPGRVGHYLASDTPPCQGPWKDVTGLLTGPTE

SEQ ID NO: 23814 - protein, 406 aa, Neisseria gonorrhoeae FA 1090
MTLFCEQVPYPRLAEEFGTPLYVYSQSALTGAFENYQTAFAALNPLVCYAVKANGNLSIIKHFASLGSGFDIVSGGELARVLAAGGDAAKTIFSGVGKSEAEIEFALNAGVKCFNMESIPEIDRIQKIAARLGKTAPVSLRVNPDVDAKTHPYISTGLKANKFGIAYADALEAYRHAAQQPNLKIIGIDCHIGSQLTDLSPLVEACERILILVDALAAEGIVLEHLDLGGGVGIVYKDEGVPDLGAYARAVQKLMGTRRLKLILEPGRSLVGNAGALLTRVEFVKHGEEKNFVMVDAAMNDLMRPALYDAYHHIEAVETKNIEPLTANIVGPICETGDFLGKDRTIACEEGDLLLIRSAGAYGASMASNYNTRNRAAEVLVDGGGYKLIRRRETLEQQMANELACL

SEQ ID NO: 23815 - protein, 566 aa, Arabidopsis thaliana
MAPALAVTRDLTAVGSPENAPAKGRASVYSEVQSSRINNTLPLPSVLKGAFKIVEGPASSAAGNPDEIAKLFPGLYGQPSVAVVPDQDAPSSAPKLKIGVVLSGGQAPGGHNVISGLFDYLQERAKGSTFYGFKGGPAGIMKCKYVELNAEYIQPYRNQGGFDMICSGRDKIETPDQFKQAEETAKKLDLDGLVVIGGDDSNTNACLLAENFRSKNLKTRVIGCPKTIDGDLKCKEVPTSFGFDTACKIYSEMIGNVMIDARSTGKYYHFVRLMGRAASHITLECALQTHPNITIIGEEVSAQKQTLKNVTDYMVDVICKRAELGYNYGVILIPEGLIDFIPEVQELIAELNEILANEVVDENGLWKKKLTEQSLKLFDLLPEAIQEQLMLERDPHGNVQVAKIETEKMLIQMVETELEKRKQAGAYKGQFMGQSHFFGYEGRCGLPTNFDATYCYALGYGAGVLLNSGKTGLISSVGNLAAPVEEWTVGGTALTALMDVERRHGKFKPVIKKAMVELEGAPFKKFASLREEWALKNRYISPGPIQFTGPGSDSLSHTLLLELGAQ

SEQ ID NO: 23816 - protein, 103 aa, Candida glabrata CBS 138
MVKQITSVSEFDSAIAVDKLVVVDFFATWCGPCKMIAPMIEKFAAEYSTADFYKLDVDELPEVAQKNEVSAMPTLVLFKNGKEVAKVVGANPAAIKQAIANNV

SEQ ID NO: 23817 - protein, 492 aa, Mycobacterium tuberculosis H37Rv
MMPDYHALIVGAGFSGIGAAIKLDRAGFSDYLVVEAGDGVGGTWHWNTYPGIAVDIPSFSYQFSFEQSRHWSRTYAPGHELKAYAEHCVDKYGIRSRIRLNTKVLAAEFDDEHSLWRVQTDPGGEITARFLISACGILTVPKLPDIDGVDSFEGVTMHTARWDHTQDLTGKRVGIIGTGASAVQVIPEMAPIVSHLTVFQRTPIWCFPKFDVPLPTAVRWAMRIPGGKAVHRLLSQAFVEATFPIAAHYFAVFPLAKHMESAGRRYLRQQVHDPVVREQLTPRYAVGCKRPGFHNTYLSTFNRDNVRLVTEPIDKITPTAVATTDGASHEIDVLVLATGFKVLDTDSIPTYAVTGTGGASLSRFWDEHRLQAYEGVSVPGYPNFFTVFGPYGYVGSSYFALIETQAHHIIRCLKRARRTGATRIEVTEEANARYFAEVMRRRHRQVFWQDSCRLANSYYFDKNGDVPLRPTTTVEAYWRSRRFDLGDYRISS

SEQ ID NO: 23818 - protein, 542 aa, Emericella nidulans
MGILFKKPEGTEGKAWPAILISGFVAFGGILFGYDTGTISGILAMPYWAQTFSTGYRDSTGQLNVTSSQSSAIVSILSAGTFFGALGAAPVGDIIGRRWGLIASNGVFVLGVVLQTIATSIPPFLAGRFFAGLGVGLISALVPLYQSETAPKWIRGFIVGSYQFSITIGLLLASVLNNATHHRNDSGSYRIPIAVQFAWSIILVGGMLILPETPRYLIKRDDTKAAALSLSKLRRLPQDHESIRQELSEIQANHQFEVSLGKSGYAECFRGSLLKRLLTGCGLQALQQLTGINFIFYYGTQFFKNSGFKNEFVITLITNCVNVGSTIPGLYAIDKWGRRPVLLTGAIGMAVSQLLVAVLGTTTTGQDAQGNIIVHNAAAQKAAIAFICLYIFFFAASWGPIAWVVTGEIFPLKTRAKSLSMTTATNWLLNWALSFATPYLVNYGDGNANLQSKIFFIWFGCCFLCIGFVYFMIYETKGLTLEEVDELYLEVKSARESVSWSPKGTFARVAEKGNGSAGILERTEKGDVGGHREIGAPDGVSV

SEQ ID NO: 23819 - protein, 319 aa, Mycobacterium tuberculosis H37Rv
MTEPTVARPDIDPVLKMLLDTFPVTFTAADGVEVARARLRQLKTPPELLPELRIEERTVGYDGLTDIPVRVYWPPVVRDNLPVVVYYHGGGWSLGGLDTHDPVARAHAVGAQAIVVSVDYRLAPEHPYPAGIDDSWAALRWVGENAAELGGDPSRIAVAGDSAGGNISAVMAQLARDVGGPPLVFQLLWYPTTMADLSLPSFTENADAPILDRDVIDAFLAWYVPGLDISDHTMLPTTLAPGNADLSGLPPAFIGTAEHDPLRDDGACYAELLTAAGVSVELSNEPTMVHGYVNFALVVPAAAEATGRGLAALKRALHA

SEQ ID NO: 23820 - protein, 320 aa, Mycobacterium tuberculosis H37Rv
MPSLDNTADEKPAIDPILLKVLDAVPFRLSIDDGIEAVRQRLRDLPRQPVHPELRVVDLAIDGPAGPIGTRIYWPPTCPDQAEAPVVLYFHGGGFVMGDLDTHDGTCRQHAVGADAIVVSVDYRLAPEHPYPAAIEDAWAATRWVAEHGRQVGADLGRIAVAGDSAGGTIAAVIAQRARDMGGPPIVFQLLWYPSTLWDQSLPSLAENADAPILDVKAIAAFSRWYAGEIDLHNPPAPMAPGRAENLADLPPAYIAVAGYDPLRDDGIRYGELLAAAGVPVEVHNAQTLVHGYVGYAGVVPAATEATNRGLVALRVVLHG

SEQ ID NO: 23821 - protein, 505 aa, Triticum aestivum
MEIELWLIWATLAVVSLLYYLANPTRRAGTRGGRMPPGPTPLPLVGNLLCLRRGNLHHTLARLARAHGPVMTLRLGLTTAVVVSSRDAAREAFTRHDRRLAARAVPDAARGLGFADRSMLWLPSSDPLWKSLRGIVAAHAFSPRALAAARGVRERKVRDMVSYFRGCAGTEVDVGQAMYAGVLNLVSSALCSVDVVDMGAAESGQGVRELVEDLVAVIAKPNVSDLVPFLRRLDLQGWRRWSAIRIGKIFRILDGIIDSRMAFNTSTEEKHGDFLDVLLELFSTGKIARDSLTTILFDLFTAGSDTMAITVEWAMAELLRNPGVMAKVRAEIDDTLGGKETIVETDVAGLPYLQAVLKEAMRLHPVAPILLPHRAEEEGVEIGGYAVPKGSTVIFNVWAIMRDPAAWERPDEFVPERFLGRAEADQVLDFRGKAFEFIPFGSGRRLCPGVPMAERVVPFILASLLRAFEWRLPDGMSAEELDVSERFTTANVMAVPLKAVPVVVT

SEQ ID NO: 23822 - protein, 227 aa, Zea mays
MDIRLLVSADANLAAALSRSRSSKSAFQRQVVPGSRASSCRSVRARSAAAAAPAAGGISGHSNYTVGDFMTTRDNLHVVQPTTPVDQALELLVQHRISGFPVVDDDWNLVGVVSDYDLLALDSMSGNELADTSTNMFPDVDSTWKTFHELQRILSKTNGKVIGDVMTSSPLAVRINTNLDAATRLLLETKYRRLPVVDSMGKLVGMITRGNVVSAALKIKKKTEEGA

SEQ ID NO: 23823 - protein, 353 aa, Arabidopsis thaliana
MARKRSKSSSSLSIPLDIATDIFLRLPAKSVVRFSCVAKHWSSITTAPYFTNSFETRPNLLFFFKEADRFFVVTVPKPNRRPNESVSHTSSQILDSYQTPYPKHSCFTIKTESVHGLICFQRGTKPIVWNPTMRKFKPLRKPDKSWESLTVFLGYDPLERTHKVVAMPCDKASDECRILTLGSADQESWRTVKTNYKHHPSRGNRKNNYGPCRCINGVLYYLAEIDRHRLIGKFAFLGHSNVKNSLPMWVLEGEKKGEWSTYNFLPLSHYDRRLEFHFKLIGITNDGELIYVPNTVFKTFEVIYIDPIRKTFSLVKYEGVADKGFRQRNGLGEDKPLRGIQYSPNHVETLLSL

SEQ ID NO: 23824 - protein, 1020 aa, Lactobacillus plantarum
MPKNNAIHSIAVIGSGPIKIGQAAEFDYAGTQACLSLKAAGYHVILINSNPATIMTDTATADEVYLEPLTLTSVTKILRATHPDALLPTLGGQTGLNLAMALDQAGVLNELKIQLLGTSLATINQAEDRAAFKALMKRLHQPIPASTTVHHVTSALSFAEKIGYPVIVRPAFTLGGSGGGIANNADELTQTLQRGLTMSPVTECLIEQSIAGFKEIEFEVMRDNQGTKIIVCSMENFDPVGIHTGDSIVYAPVQTLTDTEYQQLRTAALTIVEALDIRGGCNVQLAQDPNSRQYYVIEVNPRVSRSSALASKATGYPIAKIAADIAIGLNLSEIKNPVTQTTYAAFEPALDYVVAKIPRFAFDKFPTADAHLGTQMKATGEVMAIGSTLEEATLKAIASLEIDPKTQASLTPDHHVTTTEYIDQLTHPTDQRLFYLLAALQAGWPLAKLATLTQITPFFLSKLQHIAQLIRNIKQVPTSQHLLSAKKYGVSLATMAHYAQTSVATIAAMTADLPFVYKMVDTCAGEFASVTPYFYSTAFGQTNESHPLGHSILVLGSGPIRIGQGIEFDYTTVHCVKAIQQAGYHAIVVNNNPETVSTDFSTSDKLYFEPLTIERLMPIIALEQPAGVIVQFGGQTAINLAHQLTKLGVTVLGTSVSATDLTEDRQSFADCLRLLKIAQATGTTVTELSGARQAAHAIGYPLLVRPSFVFGGRAMAIVHNDHELTPVIKSAVAAGHGAPTLMDQYLAGTECEVDVLSDGTSCFIPGIMEHIEGAGVHSGDSITVYPPQHLSPAVQDKIVTIATKLAQHLHCVGMMNIQFVVTDDVYVIDVNPRASRTVPYMSKVTHLPLAQLATRLILGQSLATLGLVPGLLTPAPQQIAIKAPVFSFNKLPQSPVVLSPEMKSTGETLGIGPTFTTAWHAAMADSYHLETWHTVDGLITDIATVAQPAVQELFAANHLTVTTIANTTDWPAKTKAVGFTLNDQTDNPVAIAALNHGQPLITAIDTLKTLLASTTTMVSK

SEQ ID NO: 23825 - protein, 462 aa, Phaseolus lunatus
MAFNGDNLPHQNQVVVVLTPFPAQGHLNQFMHLSLLISSHDIPVHYVSTVTHIRQATLRHHKSISTIHFHAFEVPPFVSPPPNPNNPETDFPSHLIPSFEASTHLREPVGKLLQSLSSQAKRVIVIHDSLMASVAQDATNMPNVENYTFHCTCAFTTFAFFWEEMGKPPLEAFRVPEFPLLEGCFPTQFIDFIVAQYELQKFNDGNIYNTSRVIEDPYLELLDLFSAGKKVWALGPFNPLTVEKKDSIGFRHSCMEWLDKQEPSSVIYISFGTTTALRDEQIQQIATGLEQSKQKFIWVLRDADKGDIFDGSEAKRYELPKGFEERVEGMGLVLRDWAPQLEILSHSSTGGFMSHCGWNSCLESISMGVPIATWPMHSDQPRNAVLVTEVLKVGLVVKDWDQRNALVTASDVEKAVRRLMETKEGDEIRERAVGLKNVIHRSMDESGVSHMEMGSFIAHITK

SEQ ID NO: 23826 - protein, 462 aa, Phaseolus lunatus
MAFNGDNLADKNQVVVVLIPFPAQGHLNQLMHLSHLISSHNIPVHYVSTVTHIRQATLRHHKSIISNIHFHGFEVPPFVSPPPNPNNPETDFPTHLIPSLEASMHLREPVRKLLQSLSFQAKRVIVIHDSPMASVAQDATNMPNVENYTFHCTCAFSVYVSFWDKMGRPSVEAMHALKIPSLEGCFPTQFLDFLIAKRDFLKLSDGIVYNTSRVIDADYIDLMEVIPGGKKVWALGPFNPLAVEKKGSKERHSCMEWLDKQEPNSVIYVSFGTTTPLKVEQIEQVATGLEQSKQKFIWVLRDADKGDIFDENEAKRLELPNGFEERVKDMGLVVRDWAPQLEILSHSSTGGFMSHCGWNSCLESISMGVPIATWPFHSDQPRNAALITEVLKVGLVVKDWSQRNSLVSGSVVEDAVRRLMQTEEGDEMRERAGRLKNAIHKSTEEGGVSHTEMDSFIAHITK

SEQ ID NO: 23827 - protein, 141 aa, Physcomitrella patens
TAYPDEDGMPLRGRFSSTPFGQHIGRKLLNINFCVDVIRPRGSFPDYDCDRKLRFAKTPRCCVTNLNNRLCFDVSNLEDRCGSCTNKCRFGEKCCDGVCANLLTNNRHCGGCDKRCSNNQPCRFGMCGYGSQGHTKPPKHD

SEQ ID NO: 23828 - protein, 299 aa, Candida glabrata CBS 138
MADKLNSLEHCMKFVDEYVPAWFETGKRDPLFIFISGPQGSGKSYVGKRIYEHLKDYYKDQKSVAYASMDDFYLTHEAQQKLNKEYPNNKLLQGRGLPGTHDMALLYKCINAILQRHGNDNDSIDGDHLQDSSKLVLPKYDKSAFNGEGDRSTVTVSEKIPVDIFILEGWFLGFEPILQNFESEETVKGDMVDVNSKLFIYSDLLWDNPEIKSLGIVFAADQLENVYDWRLQQEKELIAKTGNGMNDEELKKFVDRYMPCYDLYYNHLIHTESLGSVATLTLGLDKERKVFSFKTRYIE

SEQ ID NO: 23829 - protein, 515 aa, Oryza sativa (japonica cultivar-group)
MGNCCPGSGDAEPASSDASTGNGSSSFKAGASPSSAPAQNKPPAPIGPVLGRPMEDVRSIYTIGKELGRGQFGVTSLCTHKATGQKFACKTIAKRKLSTKEDVEDVRREVQIMYHLAGQPNVVELKGAYEDKQSVHLVMELCAGGELFDRIIAKGHYTERAAASLLRTIVEIIHTCHSLGVIHRDLKPENFLLLSKDEDAPLKATDFGLSVFFKQGEVFKDIVGSAYYIAPEVLKRSYGPEADIWSVGVILYILLCGVPPFWAESEHGIFNSILRGQVDFTSDPWPRISASAKDLVRKMLNSDPKKRISAYEVLNHPWIKEDGEAPDTPLDNAVMNRLKQFRAMNQFKKAALRVIAGCLSEEEIRGLKEMFKSMDSDNSGTITVDELRKGLSKQGTKLTEAEVQQLMEAADADGNGTIDYDEFITATMHMNRMDREEHLYTAFQYFDKDNSGCISKEELEQALREKGLLDGRDIKDIISEVDADNDGRIDYSEFAAMMRKGNPEANPKKRRDVVI

SEQ ID NO: 23830 - protein, 387 aa, Oryza sativa
MEAVEEVVVLIVGAGPAGLATAACLAQRHVPYVIVERESCTASLWRHRAYDRLKLHLAKEFCELPHMAYPVGTPTYIPRDMFVEYLDSYTDQFGIRPRYHTAIESAIYDGGKNRWAVLARDTDTSVVTRLTAQFLVVATGENSAASIPPVPGLTRFEGEAIHSSAYKSGRAYTGKNVLVVGAGNSGMEIAYDLATHGAHTSIVVRSPIHIMTKELIRFGMTVVQNLGLTVTTADSLLVMAANFYFGDLSKHGITRPKIGPLLLKSQTGRSAVIDVGTARLIKGGVIKVFQGISKIKTNSIEFHGGKQIPFDAIVFATGYKSTVNTWLKNGESMFKDDGFPKKFFPNHWKGENGLYCAGFARRGLAGIAMDAKNIADHIVATMDQVSC

SEQ ID NO: 23831 - protein, 946 aa, Candida glabrata CBS 138
MAELIDGKACAQGIRASIKEEIEAIKQQNPSFVPTLTIVQVGDRPDSATYVRMKRKAAEEAGIRADFLHLAEDVSENELYEEVTKLNENPDIHGVIVQLPLPGHINEDKITSAVVAEKDVDGFGPINIGELNKKNGKPFFLPCTPKGIIELLKQAGVQIAGSKSVVIGRSDIVGSPVAELLKSLDSTVTITHSKTPDIPSYLNDADIVVVAIGKPEFVKGEWFANNKKGAVVIDVGTNYVDDSTKKSGYRCCGDVEFKEACKYVRKITPVPGGVGPMTVAMLMQNTLIAAKRQLETGGKLSEFEPLPLQLKRPVPSDFEISRAQKPKQITKVALEAGILPSELEPYGSTKAKVSLNILDRLKDRENGKYILVTGITPTPLGEGKSTTTVGLTQALGAHLNKTVFANVRQPSMGPTFGIKGGAAGGGYSQVIPMDEFNLHVTGDIHAISMANNLLAAAIDTRMFHESTQKDGPLYKRLVPAKKGERKFTPTMLRRLKKLGIDKTNPDDLTDEEITRFARLDIDPETITWRRVVDCNDRFLRGITVGEAPTEKGFTRKTGFDISVASECMAILALCNSLSDMRERLGKIVVAASKSGEPITCEDIGCAGAMTALLKDAVKPNIMQTLEGTPVFVHAGPFANISIGANSVLADKIALKLAGVDPKLPEEKKKEQVGYVVTEAGFDFTMGGERFLNIKCRSSGLVPDVVVIVATVRALKVHGGGPEVKAGAPLPSEYLNEDVELLRKGCANLAKHIENAKQYNLPVVVAINKMSSDTDKEHEVIREESLKAGAYDAIVSDHWAEGGAGAVDLAKGIIKAADETDNSKFSFLYESQGKVEDKIQKIANAMYGAKDVEFLPEAQKKIDLYTKQGFGDLPICIAKTQYSLSHDANLKGVPKDFTFPIRDIRASIGAGYLYALAAEIQTIPGLPTHCGFMNIEVNEDGEIEGMF

SEQ ID NO: 23832 - protein, 338 aa, Streptomyces avermitilis MA-4680
MTLRRVLSGLSAAATLGAAAAISTRRRALAAVPHELRHPVLFLPLNFGNPVTLAIARRLVPLVGAATRPGVRVERRTLPATTDDLPVGVLTYQASGQAPRAALLWIHGGGTVMGAARQENTWCSRVADELGALVVSVDYRLAPENPYPAALDDCFRTLRWLHANAAALGVDPARIAVGGESAGGGLAAAVVQRAHDSGVPVRFQLLLYPMLDDRTALRVDPPNSAIYTWTPDSNRFAWTSYLGRPPQDRDDRPYIAAARRRNLDGLPPAWIGVGDIDLFHDEDVDYARRLSEAGVACELRLESGMYHGADALLDGKAPSMTAFRTAALDALRTALAKP

SEQ ID NO: 23833 - protein, 346 aa, Bifidobacterium longum DJO10A
MKAVVLEEQGVINVREVPDVKDPGPGELRIAPHTVGVCGSDLHYYTHGRVGKYVVEQPMILGHEAAGTVLEVGPGVTDFKPGDRVALEPGIPDMTSRASRLGMYNVDPAVRFFATPPIDGCLCEEVIHPAAFTYHLPDSMSFGEGALLEPTAVGMWAATKARIKPGDVCVVTGSGTVGMLTASAALAGGASKVLVSDVSSIKLGIIGQIPGVIPVDLTTEDLVERVREETAGWGADVAFECSGAPKAYETFWKLIAPGGCAVLVGIPVNPVPIDVTELQATEVRIENIFRYANVYQKAIDLVDSGRLNLKPFITDTFAMKDAKAAFDRMDEGRPGDIKLQITVNRD

SEQ ID NO: 23834 - protein, 446 aa, Triticum aestivum
  misc_feature (331)..(331): Xaa can be any naturally occurring amino acid
  misc_feature (384)..(384): Xaa can be any naturally occurring amino acid
  misc_feature (393)..(393): Xaa can be any naturally occurring amino acid
  unsure (1)..(446): unsure at all Xaa locations
MDDDDAGGGGDASPQHEGGGGAVVIERGAGATAPARDAAAASPTSSRSVTETVNGSHRFVIQGYSLAKGMGVGKHIASETFAVGGYQWAIYFYPDGKNPEDNSAYVSVFIALASEGTDVRALFELTLQDQSGRGKHKVHSHFDRALDAGPYTLKYRGSMWGYKRFFRRTALETSDFLKDDCLKINCTVGVVTSTMEYSRPHSLEVPDSDIGYHFGTLLESQEGADVIFSVAGERFHAHKLVLAARSSFFRSEFLDPESDEENSEVDTSNEIKEIVIDDMEPKVFQAVLHFMYRDNLVGDDELSASSSDCPIFDTLAGKLLAVADKYELPRXLRVLCESYLCKQISVKSVATTLALADRHHATELKSVCLKFAAENLSDALMYLXAVIRTDGFXDYLKDNCPALQSEILRTVAGCEEECSSGGKSQSVWGQISDGGDTSGRRVRPRV

SEQ ID NO: 23835 - protein, 445 aa, Zea mays
  misc_feature (36)..(36): Xaa can be any naturally occurring amino acid
  misc_feature (70)..(70): Xaa can be any naturally occurring amino acid
  unsure (1)..(445): unsure at all Xaa locations
MYGGDEVSAIVIDVGSYSCKAGYAGDDTPKAVFPSXVVGSIEQTEDTDDPKPEKEADSASDSKNGAKPMXDVDKAKTKRRLYVGQELEFRRDHMEVISSMKDGTVTDWDIVDNIWNHAFRRRLLINPEEHPMLIAEPSTNTAQQREKAAELMFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 23836 - protein, 1042 aa, Thermus thermophilus HB27
MAWLNPFWSSPKAYVRPPKRGLAPELWASRIPFTHLENFYEVFRALWENRDNLPYAWRILKDGVCDGCALGTSGLEDWTLHGVHLCNVRLRLLRLNTLPPLDPKVLEDVEALKGRKSRELRRLGRLPYPMLRRKGERGFRRVSWDEALGLAAEYLRRHLPEGAFFYLTSRGVPNETYYVVQKAVRALGCNHVDNAARICHSPSTVVLKEALGVAATTCSYTDLIGTDLVVFLGSNVANNQPVMMKYLYHAKKAGTKVAVVNPYREPGMERYFVPSDLESALFGTRIADRFFQILPGGDIAFLHGAAKWMLEEGWVDPGFIRAHTAGFEAYKALLEAIPFAELEKAAGVSREEMRAFAEMVGRAERAVFVWGMGITQHTHGEDNVRAIVNLALLKGFVGREGCGLMPIRGHSGVQGGAEMGAYATAFPGGLPVNPENARRLAELWGFPVPDRPGLTTPEALDRALEGRLGVLWAIGGDFREVMPDPEAVEEALRRVPLRVHQDIVLSSQMLLEPGECVLLLPATTRYEVPGGVTETSTERRVIFSPEIPGPRPPEARPEWEVFQELVHRLRPELKDRFRFASTAEVREEIARVIPLYEGIQRLKAKGDQFQYGGRHLCEGWRFPTPDGKAHFRPVPPAPKGGPRGGLPRGHPPGEAVQLHRPRGPGPPHRGLPGRGLHEPQGRRPPGPEAWGSGGAGKRLRPLRRPGLPGGGQRGHPGGPLARGERPGRPQGPLPPGPHPGLQGGPRPPAAGGGGGPFPAPAMRGKARVRVARLEGGRWREVRDEVAAEAPLEIRLRYRDEVASLGVVLRTPGQDAELAAGLLYTEGLLQDPKEVLAIAPCADGSLPPEAREGVIQVFLRHPLPPPPKRHLALTAACGACGREALPDLGKLGLSPPPPLAVDPDLLLALPERLGEAQRLFRATGGLHAAALFDREGRLVALREDVGRHNALDKLIGWAFLQGKLPLHDHILLVSGRAGYELLVKAVAAGIPVFCAVSAPTSLAVALAQAYGLTLVGFLRPGRMNVYAGRERVGPPRGLPNPCG

SEQ ID NO: 23837 - protein, 255 aa, Oryza sativa
GTCTHDAAGYGGSGQPAYGATGTGVHDAGGLMPGHTAGHGTTGTGVHHGAGAGLPAGQGGGYGTTGVTGAQHGAGGLGTGHTAGYGTTGAHHGAGGLGTRHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 23838 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVGMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCVGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 23839 - protein, 955 aa, Coprinopsis cinerea okayama7#130
MYGSTSEESESEDSGMEIDLPSAPWHDDSEPADEADEDEHLSDEQHELNSTDDHLLHWATFHQLNKVKKDDLVRLYRAANLPEDPELLTKAEIITVIMDARQDELASLPPSSPPGRTDAASSDYSSDEGNVAGDEETDAGPHYDAPGRSLSMGNVMAPQSNGHQGLKRKASLRIQTEALSRPRTSKDSSPSTSALASSSTQSPPGHRLRSRKVSASTPVDVPTPTSAASKGRGKGKNKQVEFSTEIVQVKSTSRRSSQKEKDRQREQAEALAEESDLTDLDDALPVPTSRPQPSPRRLRSKDRGRTHIDSKSRESDDADHTPTSKSRSAKAMPQSHSKPQPKRVTPMRKAKGKIKSLKESETEASHEEDGSENSEEDEEGQEVEMEMEEDDGEGEMEEDQDADVQGGDTGEEDEVDELVSSASITPPPSNTYARKTPLRQRLRRRPCATTAELDAEENEGDDEHEEDADGDDDDTETVDGHDGDEGEDDESTIAVEPRRLRNGKIVGDEEAHMDEDDGGSAEGGEEEAEESEETEGEPITVDETEEEAEEDTMEDEVDLSVATAKTLVRLRRDDLVKLCETRNLEPIGTKPQLAEALLQWRDRHANGSSCPSSTGTVRPPSTATTSRRRRKKQSSSSSVPVLLRSQKVHDDEPRTPVPGKEAKDKENDELELDLESLGLEDREIPPEKIQKLEKIGSGGFKDVFIGKFRGRRIAISEFRGQLSAMDIKELKLLGGFDHPNIVRFLGVSIPENTKETPVMIVSELCSNGDLFDYIRNVSAPSLHKVLTMMLDIARGLEYLHMRKPSVIHRDCKSSNILITAKGVAKIADFGLAKVKQSTRSMVRSLVGTVNWQAPELWTAHPKYNHKVDVFSCAMVFWEMLQWHLPNKKFPWEGMNEHAIYEQVGAKKQRPSITGLRKQWCPEIVTLIEEMWAQDPSDRPTMSKVVETLEDLVRQY

SEQ ID NO: 23840 - protein, 490 aa, Escherichia coli O6
MSRMAEQQLYIHGGYTSATSGRTFETINPANGNVLATVQAAGREDVDRAVKSAQQGQKIWAAMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTDHPGIAKVSFTGGVASGKKVMANSAASSLKEVTMELGGKSPLIVFDDADLDLAADIAMMANFFSSGQVCTNGTRVFVPTKCKAAFEQKVLARVERIRAGDVFDPQTNFGPLVSFPHRDNVLRYIAKGKEEGARVLCGGNVLKGDSFDNGAWVAPTVFTDCSDDMTIVREEIFGPVMSILTYESEDEVIRRANDTDYGLAAGIVTADLNRAHRVIHQLEAGICWINTWGESPAEIPVGGYKHSGIGRENGVMTLQSYTQVKSIQVEMAKFQSIF

SEQ ID NO: 23841 - protein, 213 aa, Acidovorax sp. JS42
MPRTASTAAPMPAAGRRIQTRRSGVHGKGVFAVQDIAEGEVLVEYTGEVISWQEAQDRHPHDPAQPNHTFYFHVDEDRVIDAKFGGNSSRWINHSCDPNCFADERDGRIFITALRNIRAGEELNYDYGLIIEERYTPKLKAEYPCWCGSKNCRGTLLAPKRGWAPPGLAPQPPTEKAGKAPKTRKAEEAKGSGKAGKPAKSAKPRQGRRSAQR

SEQ ID NO: 23842 - protein, 349 aa, Pseudomonas putida GB-1
MAQGHRSGIRLRRHRRQWPHPLRASSLSHAGGKLIACARVQGPLAINEMNAMATFQVVTEQHGELNCWRISSDRAELLIAQQGAQILSYQRVGEPPLLWLSDQDIFRQGKSVRAGVPVCWPWFGNLQRNPEAVQAMYHAEQAPAHGLARSRDWQLLGIEEVGGGLRIEFELPEAQGDLPGWPHDVELKLVVELGEALKLNLTSRNMGNTSVTISQALHSYFAVSDVRQARVEGVEGLGYIETLADWEQRQQLGALAFTGETDRIYLDTPSRLSIVDPHWNRRVTLTSNGSRSAVIWNPWTERARELADMADDGWQRMLCIETANVWDDLVELKPGASHSLGLQIGCEMI

SEQ ID NO: 23843 - protein, 287 aa, Oryza sativa
  misc_feature (231)..(231): Xaa can be any naturally occurring amino acid
  unsure (1)..(287): unsure at all Xaa locations
MAYYARRGGDRVSGGGRVQGGGGGGGGGGRGGYVLRGTSGMPPRGPLGLGVNSRPSARTIAKSFSRTKDMTWRPDLFSDSMAASGIETGTKLYISNLDYGVSNEDIKELFSEVGHLKRFAVHFDGYGRPNGTAEVVFTRRSDAIAALKRYNNVLLDGKAMKIEVIGSDLGLPMTPRINVVGASNGRPTRTVVMTPEIGQRGSGSSSRPTGPTVNRYNRGAFQAGRGRGRGXRGRAPFQSQFQGRGTGSVRRRGQFQGRGRGRRQAGKTADELDKDLETYHAEAMKTD

SEQ ID NO: 23844 - protein, 56 aa, Glycine max
PRVREAVRAHMAFCNMFKLNPAVRVADGMRQMLRRRSGDMSKPESAKKYESSVTLY

SEQ ID NO: 23845 - protein, 1184 aa, Arabidopsis thaliana
MLSSIGCNMFVPSTFCSVSKFVSIDCGCSSNYTDPRTGLGWVSDSEIIKQGKPVTLANTNWNSMQYRRRRDFPTDNKKYCYRLSTKERRRYIVRTTFLYGGLGSEEAYPKFQLYLDATKWATVTIQEVSRVYVEELIVRATSSYVDVCVCCAITGSPFMSTLELRPLNLSMYATDYEDNFFLKVAARVNFGAPNMDALRYPDDPYDRIWESDINKRPNYLVGVAPGTTRINTSKTINTLTREYPPMKVMQTAVVGTQGLISYRLNLEDFPANARAYAYFAEIEELGANETRKFKLVQPYFPDYSNAVVNIAENANGSYTLYEPSYMNVTLDFVLTFSFGKTKDSTQGPLLNAIEISKYLPISVKTDRSDVSVLDAIRSMSPDSDWASEGGDPCIPVLWSWVNCSSTSPPRVTKMWLDDNELTGTLPDMSKLVNLKIMHLENNQLSGSLPPYLAHLPNLQELSIENNSFKGKIPSALLKGKVLFKYNNNPELQNEAQRKHFWQILGISIAAVAILLLLVGGSLVLLCALRKTKRADKGDSTETKKKGLVAYSAVRGGHLLDEGVAYFISLPVLEEATDNFSKKVGRGSFGSVYYGRMKDGKEVAVKITADPSSHLNRQFVTEVALLSRIHHRNLVPLIGYCEEADRRILVYEYMHNGSLGDHLHGSSDYKPLDWLTRLQIAQDAAKGLEYLHTGCNPSIIHRDVKSSNILLDINMRAKVSDFGLSRQTEEDLTHVSSVAKGTVGYLDPEYYASQQLTEKSDVYSFGVVLFELLSGKKPVSAEDFGPELNIVHWARSLIRKGDVCGIIDPCIASNVKIESVWRVAEVANQCVEQRGHNRPRMQEVIVAIQDAIRIERGNENGLKSSSSSSSKAQSSRKTLLTSFLELESPDISRNSLAPAARSFYIYFLRPSKNLRRYGSWAIITGPTDGIGKAFAFQLAQKGLNLILVARNPDKLKDVSDSIRSKYSQTQILTVVMDFSGDIDEGVKRIKESIEGLDVGILINNAGMSYPYAKYFHEVDEELINNLIKINVEGTTKVTQAVLPNMLKRKKGAIINMGSGAAALIPSYPFYSVYAGAKTYVDQFTKCLHVEYKKSGIDVQCQVPLYVATKMTKIRRASFLVASPEGYAKAALRFVGYEAQCTPYWPHALMGAVVSALPESVFESFNIKRCLQIRKKGLQKDSMKKE

SEQ ID NO: 23846 - protein, 437 aa, Glycine max
MALRHLRFFPHTLPLTLTPTPNPNNSNRFSFFTPSLSLSSTTLMATAHKVLVPIADGTEPMEAVIIIDVLRRSGADVTVASSSANLAVQALHGVKIIADASVSDVAATAFDLVALPGGLQGDENLRDCKVLEGFVKKHVEDGRLYAAVCAAPAVVLGPWGLLNGKKATCYPALMEKLAAYVAATSESRVQVDGTVVTSRAPGTTMEFAIALIEQLIGKEKAYEVAGPLVMRSNHDDEHTFKEFNSVQWTSDNPPKILVPIANGSEEMEAVIIIDILRRAKAKVVVASVEDKLEIVASRKVKLEADMLLDEATKLSYDLIVLPGGLGGAQTFANSETLVSLLKKQRESNKYYGAICASPALVLEPHGLLKGKKATAFPVMCDKLSDQSEVENRVVVDGNLITSRGPGTSIEFALAIVEKLFGRKLALELANAVVFARP

SEQ ID NO: 23847 - protein, 575 aa, Lactobacillus brevis
MLKGIAASDGVVCGHVFRYSEPDLSITKRSITNLDHELNRFHQALEAAVSEVEMIKTRATKNLGADSAQVFSAHIAMLQDPEFIKSVEDEIARQRCNAEAALATVVTDYGASLAKLTDNPYMQERITDLHDISKRVTAHLLGIKLPDLALLDRPVIVVTHDLIPSDTVSVDAKYILGFVTDLGGRTSHSSILARSLNIPAVVGTQTATADLATDEMVIINGTTGSVISEPTAAEIATAKQAMADRQANRVRLAKLRHHQTVTKDGIGVTLAANMGTANDIPSVLDNGAEAVGLMRTEFLYMDAERVPTEDEQFAIYRQVVSALAPRPVVIRTLDIGGDKPLPYLHQAPEANPFMGERAIRQSLAHQPLFRSQLRALIRASAYGHLRIMFPMIATLDEFRQAKAIYDDERSKLTTAQVPMGKIDVGMMVEVPAAAMLADRFAQEVDFMSIGTNDLIGYAMADDRTNQDVAYLYQPYHPAVLRLVDRIVRAGHAAGIPVAMCGEMAGDPIAVPILLGIGLDEFSMGAGSILKTRQLMGTLNVHELQSLADTVLNSTSTSQEVITMVQAAVPGILDVR

SEQ ID NO: 23848 - protein, 1188 aa, Methanocaldococcus jannaschii DSM 2661
MLIIQNTKGDSMKFIAWLDELSNKDVDIAGGKGASLGEMWNAGLPVPPAFVVTADAYRHFIKETGLMDKIREILSGLDVNDTDALTNASKKIRKLIEEAEMPEDLRLAIIEAYNKLCEMCGEDEVTVAVRSSATAEDLPEASFAGQQDTYLNIKGAENVVKYVQKCFSSLFTPRAIFYREQQGFDHFKVALAAVVQKLVNAEKAGVMFTVNPISENYDELVIEAAWGLGEGVVSGSVSPDTYIVNKKTLEIVDKHIARKETMFVKDEKGETKVVEVPDDMKEKQVLSDDEIKELAKIGLNIEKHYGKPMDVEWAYEKGKFYMLQARPITTLKKGKKEKKAKEEDIEAKILLKGIGASPGIATGVVKIIHDVSEIDKVKEGDILVTEMTTPDMVPAMKKAAAIVTDEGGLTCIEGDAKILTDRGFLKMKEVYKLVKNGEKLKVLGLNAETLKTEWKEIIDAQKREARRYEIGVYRKNKNTKDTIKITPDHKFPVFVNGELSKVQLCDIIDNNLSVLSIDYIPMIEEKYESLAEVMYLGGAVLSDGHIVRRNGKPIRVRFTQKDTEEKKDFIEKVKGDVKLIGGNFIEISNRNNVIEYQTSRKIPSEILGFIEVNINTIPLYATKDEIADLIAGFVDGDGCLSGKRRVEIYQNSSHIKKIEGLIVGLYRLGIIPRLRYKRSSTATIYFNNNLETILQRTRRIKLDKLKEFKKPVEDKKLIDISQILPELKEFDYKGYLYKTYKEKLFIGINKLEEYLSKIDKDGIERIKQKIKLLKESDIYSIRIKKVGEDYGEVYNITVKAENEFNHNYVVWTKHYTPIVVFNCHAAIVSRELGTPCVVGTKKATKVLKDGMIVTVDGEKGIVYEGEIKKVEEKEKKQEVVVQQAPIITATEVKVNVSMPEVAERAAATGADGVGLLRAEHMILGLGKHPRKILEEEGEEALIEALMEGIRKVADAFYPRPVTYRTLDAPTDEFRGLEGGENEPIEHNPMLGWRGIRRDLDEVDILKCELKAIKRLREEGYKNIEIMIPLVTHPDEVRRVKEIMREVGLEPCKDIPFGIMVETPAAALIIEDFIKEGINFVSLGTNDLTQYTIAIDRNNELVSKYYKEDHPAVLKLVEHVIKTCKKHGIKTSICGQAGSRPHIVEKLVEWGIDSVSANIDAVETIRRVVARTEQKVILNYIRKSYVERE

SEQ ID NO: 23849 - protein, 236 aa, Arabidopsis thaliana
MGSHEQSPENNGSSTVSKKVADIWQRMNEGVPNKRVNFVSTALPAKNSANSNWKSYLGVNVKKKDTCVSDVQKSVLNHSCSEEAKSIAAAALAAVRNATVTAAAASSRGKIEITEVKDFAGQEIEVKRLVEADSKEALERGNKGSSSSSAAPSAVDAVLEQIKKKQKLSVLDKTKKDWGEYKEEHKGVEDELDKYKKSSDQYLDKVGFLERADYRQFEKERDARLALQSKRRHDDV

SEQ ID NO: 23850 - protein, 386 aa, Arabidopsis thaliana
MDKASITEGKPIRCKAAILRKAGEPLVIEEIQVDPPQAYEVRIKILCTSLCHTDVTFWKLDSGPLARFPRILGHEAVGVVESIGEKVDGFKQGDVVLPVFHPQCEECKECISPKSNWCTKYTNDYLSNTRRYGMTSRFKDSRGEDIHHFIFVSSFTEYTVVDIAHLVKISPEIPVDIAALLSCSVATGLGAAWKVADVEEGSTVVIFGLGAVGLAVAEGVRLRGAAKIIGVDLNPAKFEIGKRFGITDFVNPALCGEKTISEVIREMTDVGADYSFECIGLASLMEEAFKSTRPGSGKTIVLGMEQKALPISLGSYDLLRGRTVCGTLFGGLKPKLDIPILVDRYLKKELNLEDLITHELSFEEINKAFHLLAEGNSIRCIIWMDK

SEQ ID NO: 23851 - protein, 258 aa, Triticum aestivum
  misc_feature (131)..(131): Xaa can be any naturally occurring amino acid
  misc_feature (227)..(227): Xaa can be any naturally occurring amino acid
  misc_feature (236)..(236): Xaa can be any naturally occurring amino acid
  misc_feature (242)..(243): Xaa can be any naturally occurring amino acid
  unsure (1)..(258): unsure at all Xaa locations
MSTDVVKWCYATVAPRARSSTIVASLGTPAPSNSSSFRPKLIRNTPVQAEPVAPVLMDAAVERLKTGFEKFKTEVYYVKPDIFEPLKAGQAPRYMVSECADSRVCPSVTLGLEPGEAFTIRDIVNMDPSYXKNKYAGVGSGIEYAVWALKVEVIVVIGHSRCGGIKALLSLKDGAYDSFHFDEDWVRIGFPVNKKVQTECASMPYDDQCSVLEKEAVNVCLQKLLTXPFVKEGVSXGTLRLXXAQYDFVSGQFETWEQ

SEQ ID NO: 23852 - protein, 338 aa, Alteromonadales bacterium TW-7
MAIKLAINGFGRIGRNIVRALYESGLSDEIKIVAINELADPEAIAHLLKYDTSHGRFSFPVKLGEDTISVAGDTIALFCEENPVELPWQTLDVDVVLECTGVYHSREHAQLHITAGAKKVLFSHPADNDVDATIVYGINDDELKSEHTIVSNGSCTTNCVVPVIKVLDDAFGIESGAITTIHASMNDQQVIDAYHHDLRRTRAASQSIIPVDTKLARGIDRILPKFEGRFEAIAVRVPTINVTAMDLSVTVNADVDLKAVNNALKAQAKDRLEGILSYTEEPLVSVDFNHDPHSCIIDGTQTRVSHKRLIKLLVWCDNEWGFANRMLDTARAMVAVTQ

SEQ ID NO: 23853 - protein, 391 aa, Alteromonadales bacterium TW-7
MSVIKMADLDLNGKRVLIREDLNVPVKAGKVTSDARIRAALPTIKLALEKGAKVMVMSHLGRPTEGEYNEEYSLAPVADYLNDALAQTVRLEKDYLNGVDVADNEVVVFENVRFNKGEKKNDEALSKQLAALCDVYVMDAFGTAHRAQASTHGVGLFADVACAGPLLSAELEALGKALDNPARPLVAIVGGSKVSTKLTVLDSLSKIVDQLVTGGGIANTFIAAAGNPVGKSLFEADLMDEANRLCAAAKANDGEIPVPTDVVVGNEFSESAVATLKDVSEVTSDDMIFDIGPDTASQLAKIIANAGTVVWNGPVGVFEFDQFGNGTRAIAQAIANSNAFSIAGGGDTLAAIDKYGIADKVSYISTGGGAFLEFLEGKKLPAVEMLESRAK

SEQ ID NO: 23854 - protein, 128 aa, Xanthobacter autotrophicus Py2
MKHAGPHSADQNGFETMGIREDIDAIVKSGDVVLFMKGTPQFPQCGFSGQVVQILDHVGVPFKGVNVLENDAVRQGIKDYANWPTIPQLYIKGEFVGGCDIVREMFQAGELTTFLEEKGVAIRDRAIG

SEQ ID NO: 23855 - protein, 594 aa, Neisseria meningitidis
MALVELKVPDIGGHENVDIIAVEVNVGDTIAVDDTLITLETDKATMDVPAEVAGVVKEVKVKVGDKISEGGLIVVVEAEGTAASPKAEAPVAPAQEAPKAAAPAPQAAQFGGSADAEYDVVVLGGGPGGYSAAFAAADEGLKVAIVERYKTLGGVCLNVGCIPSKALLHNAGVIDEVRHLAANGIKYPEPELDIDMLRAYKDGVVSRLTGGLAGMAKSRKVDVIQGDGQFLDPHHLEVSLTAGDAYEQAAPTGEKKIVAVKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 23856 - protein, 405 aa, Brassica napus
  misc_feature (207)..(207): Xaa can be any naturally occurring amino acid
  misc_feature (331)..(331): Xaa can be any naturally occurring amino acid
  misc_feature (365)..(365): Xaa can be any naturally occurring amino acid
  unsure (1)..(405): unsure at all Xaa locations
MGTGNSKEKWRQRSSSSCRSSSSPWASHQSYPQYPPPPSYAPPPEFAQPPSPSYTTQPYSQPPPSQSYGNDKKRLERKYSKISDDYSSLDQVTKALAHAGLESSNLIVGIDFTKSNEWTGARSFNRKSLHFIGNTPNPYEQAIAIIGRTLAAFDEDNLIPCYGFGDASTHDQDVFSFNPEDRFCNGFEEVLGRYKEIVPQLKLAGPXSFAPIIDMAMTIVEQSGGQYHVLVIIADGQVTRSVDTENGQLGPQEQKTVDAIVEASKLPLSIVLVGVGDGPWDMMREFDDNIPSRAFDNFQFVNFTEIMSKNKAQSFKETEFALSALMEIPQXYKATLELNLLGRRNGNIPERFPLPPPMHGGSASXQQTKAPRVPSFKPSVPPYPTESYPVRSSPAQPATTTSAFD

SEQ ID NO: 23857 - protein, 593 aa, Neisseria meningitidis
MALVELKVPDIGGHENVDIIAVEVNVGDTIPVDDTLITLETDKATMDVPAEVAGVVKEVKVKVGDKISEGGLIVVVEAERAASPKAAPVAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTGGLAGMAKGRKVDVIQGDGQFLDSHHLEVSLTAGDAYELAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 23858 - protein, 1478 aa, Aspergillus nidulans FGSC A4
MEKDPSTGGPLTNSPAEQYLRSPAESRSTSDTASIPSSNPDSEKFAPIQTNQSTRSRNQTLTRRGTAGSRPLTDDEITRALSHRTSSTYQGGSEDNEEVARLVSRMFGRERKANSDEEQTRHQGVVWKNLTVKGVGLGAAIQPTNADIFLGLPRLIKGLLTRGRKGTSAGSAPLRTILDDFTVCSYSMMSRAELIVKGLRAASVEGEIHYGGTDADIMADKYRSEVLYNPEDDLHYATLSVRETLMFALKTRTPDKDSRLPGESRKEYQETFLSTIAKLFWIEHCLGTKVGGEIVRGVSGGEKKRVSIGEALVTKASVQCWDNSTKGLDASTASEYVQSLRSLTNMAHASTLVALYQASENLYKQFDKVLLIEDGRCAYFGPAGRAKAYFEDLGFKCPPRWTTPDFLTSVSDPNARRVKKGWEDRIPRSAEDFQRAYRSSEDYRENLLDIEDFEREVKEHEDEQEEARRRAPKKNYTVPFHHQVMILTERQFKIMYGDKGTLIGKWAILTFQALIIGSLFYNLPNTRGGVMFFVLLFNALLALAELTDVFTHRPVMLKHKSFSFYRPSAYAVAQVVVDVPIIFIQVTLFELIVYFSMANLQRTASQFFINFLFIFILTMTMYSFFRTIGAFSASLDVATRLTGVAIQALVVYTGYLIPPWKMHPWLKWLIWINPVQYAFEGIMTNEFYNMDIKCIPPNIVPDGPDAQPGHQACAVQGSEPDQLVVQGSNYVSAAFTYSRSHLWRNFGIIIGFFVFFVATAMIGMELQKPNKGGSSVTIFKRGEAPKEIEKAVEQKEKPNDIESGSRNDTTDTVGSDDGQAVEGIARSESVFTFQNVNYTIPVSGGKRQLLKDVQGYVRPGRLTALVGASGAGKTTLLNALAQRLDFGVVTGDFLVDGKPLPRSFQRATGFAEQQDIHEPTATVRESLRFSALLRQPQEVPIEEKYDYCEKIIDLLEMRQIAGATVGAGGTGLNQEQRKRLTIAVELASKPSLLLFLDEPTSGLDSLAAFNIVRFLRRLADAGQAILCTIHQPSAVLFEMFDDLILLQSGGRTVYNGELGQDSSRLIEYFEQNGGKKCPPDANPAEYMLEVIGAGDPNYKGQDWGDVWANSENCKKLSDEINKVVEMRRNNEKERNKDDDREYAMPIWVQILAVTKRSFTAYWRTPQYNIGKFALHIFTGLFNTFTFWHLGNSYIDMQSRLFSIFMTLTICPPLIQQLQPRYLHFRALYESREANSKIYNWTAFVTSAILPELPYSIIAGSIYFNCWYWGIWFPRDSFSSGFTWMLLMLFELFYVSFGQFIAAISPNELLASLLVPCFFTFIVAFCGVVVPYMAMPHFWQSWMYWLTPFHYLLEGFLGVLVHDVPMECVEREETLFSLPPGQDSCQRYAGSFLSQATGYVRDVGNGMCAYCMFSDGDQFAANNFNVYYNHKWRDYGIFWAFVMFNFAAVFVLSWLYLHGVNDMKKWLSRRKAKKSGLQS

SEQ ID NO: 23859 - protein, 594 aa, Neisseria meningitidis
MALVELKVPDIGGHENVDIIAVEVNVGGTIAVDDTLITLETDKATMDVPAEVAGVVKEVKVKVGDKISEAGLIVVVEAEGTAAAPKAEAAAASAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKNGVVSRLTTGLAGMAKGRKVDVIQGDGQFLDPHHLEVSLTAGDAYEQATPTGEKKIVAFKNCIIAAGSCVTKLPFILEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 23860 - protein, 323 aa, Arabidopsis thaliana; identical to SEQ ID NO: 959

SEQ ID NO: 23861 - protein, 146 aa, Anaplasma marginale str. St. Maries
MMFEKTLSILKPDVVERGIIGRVLSYIEAAGLRIVAQRMCALSHEQAEAFYAVHKARPFFPSLVGFMTSGPVVVQVLVGESAVKTYRDVMGATNPSEAAPGTIRGDLAESIDANCVHGSDSLENAEWEIKFFFKEHEIMSSMPNGK

SEQ ID NO: 23862 - protein, 186 aa, Medicago truncatula
MVKPNEIENVTVQQPESTTIESLKRTLYNVEQLQSQLPEFLALSDPDHLSTLPLLQRAHSLFSLAKLTSTLFELKLKCRGINPNDHAFKSELDRLSVCQKRLERLPDLSEEQWQDMVEQKFYEEQTGQKRKYPSSEEQFDLIDSKEYVEKLPGEDVVGGSSSGSSIKEAIIIDLSDDDDDDDDEYM

SEQ ID NO: 23863 - protein, 244 aa, Trichodesmium erythraeum IMS101
MYILLLLNAILFSFLIVSIISTFPNIWLQVFLVGGWLGIILIFAEALNRFAKVDPEISRKVVHIGTGNVILFAWWLEIPPWIGITAGIISAAIALISYRLPILPSVNSVGRKSLGTFFYAVSIGILIGWFWSIQQPQYAAIGILTMAWGDGFAAIIGQNFGKHPYQVWGMNKSWEGSLGMCLVSYTVCSLILLAVQGNIWQTWIVAIPVALAATALETLSKVGLDNLTVPLGSAALCFFLNQFF

SEQ ID NO: 23864 - protein, 143 aa, Brassica napus
  misc_feature (34)..(34): Xaa can be any naturally occurring amino acid
  misc_feature (93)..(93): Xaa can be any naturally occurring amino acid
  misc_feature (120)..(120): Xaa can be any naturally occurring amino acid
  unsure (1)..(143): unsure at all Xaa locations
PAQDQLAAPLTGSKRSAGFPDTRKSNTDSYFHVXASRDARSSCMNEWAPHGKKKIETLSYVPDLTDHQSTKQDDYLLHLTGGTPCVEYEMQHXFVGPERGNTPGYYDARYWTMGKLSLIXCTDSAQMLKEVLECKTEYPNAFI

SEQ ID NO: 23865 - protein, 190 aa, Candida glabrata CBS 138
MDTLFNSTEKNPRGIPSAPFLEDIGAFMAKEKEFELVFSKFQERLSKYKFMLESKQATVRQLHVRIPDIENTLQVCRQLKQSKEDGEESALKFNYKLNETLFTKAQVDLTKDLNVGLWLGADVMLEYPIDEAIALLEKKLEDSQDSLRIAKEDVEFLRENITTMEVNCARLYNWDVELRKATKATEKLAI

SEQ ID NO: 23866 - protein, 420 aa, Mycobacterium tuberculosis H37Rv
MRFRRMARPRPLTRAAVELLNAANGLRPLSGSGYSTVLAFWLGWPTSEVPGVYLGASVLDALRRGRRGDFGGLKGKAALALTAAAWVILAVIRYRGATTPGPVLEAGLTEQLGPDYAKELATLPTEPMRSRGRNLPLRTAMARRRYVETTNVVCYGPYGRANLADIWRRRDLPRDAKAPVLVQVPGGAWVLGWRRPQAYPLMSHLAARGWVCVSLNYRVSPRHTWPDHIVDVKRALAWVKENIAAYGGDPNFVAISGGSAGGHLCALAALTPNDPRFQPGFEQVDTSVAAAVPVYGRYDWFTTDAPGRREFVGLLETFVVKRKFSTHRDIFVDASPIHHVRADAPPFFVLHGRHDSLIPVAEAHAFVEELRAVSKSPVAYADLPHAQHAFDVFGSPRAHHTAEAVARFLSWVYATNPPAT

SEQ ID NO: 23867 - protein, 350 aa, Caulobacter crescentus CB15
MATLLLLPGDGIGPEVCAQVRRVAAALTPDLKVDEALYGGASYDTHGTPLTDEVREQALASDAVLMGAVGGPKWADAPRHLRPEAGLLNLRKAMDVFANLRPAYCFEALAGASSLKPELVSGLDIMFVRELVGGVYFGQPRGIEDLADGQKKGFDTQVYTTSEIERVGRVAFELARGRTNKVHSAEKSNVMESGLLWKQVITELHAREYPDVQLEHILADNCAMQLVRAPKQFDVIVTDNLFGDILSDAAAMLTGSLGMLPSAALGAPGKPGLYEPIHGSAPDIAGKGLANPLAAILSFEMALRWSLKQTEAADALLAAVKAALDNGARTRDLGGSLTTTQMGDAVLAAL

SEQ ID NO: 23868 - protein, 545 aa, Ralstonia eutropha JMP134
MPTNLHAWNALQQHHDAIRDHQMADWFAENGADRVRQFSLEAAGLYLDYSKNRITPQTMQLLLQLADEAGVPARRDAMFAGEHINATEDRAALHVALRATAGAGFKVDGVPVVPAIQNVLVRMRAFSEAVRSGAWTGTTGERITDVVNIGIGGSDLGPKMVCRALSHLAHDDGHSGPRMHFVSNVDGTELAEALERLDPRRTLMIVCSKTFTTLETMANAHSARQWYLDNGVAEDQLARHFVAVSTNVDAVRAFGIDPANMFEFWDWIGGRFSLWSSVGLSTALAVGFNAFADLLAGGRAMDEHFRTAPLERNMPVVLGMLGIWYRNFFNLPTSCMAPYSTSLELFPAFLQQLEMESNGKTVQLNGRRVRTHTSPVVWGTAGTNGQHAYFQMIHQGSQIVPVDFVAPLVPPRELPGHHAKLLANCFAQAEALMRGRSAEELRAAGMTDELRIAHMVFEGNRPSNTLLMEDLTPHVLGALIALYEHRTFVQGVVWNINSFDQWGVELGKILARPIESELNGAQAGSHDASTAALIARARGVLARNG

SEQ ID NO: 23869 - protein, 526 aa, Ralstonia eutropha JMP134
MNTTRPHPSLAADDWTALTADSAEAIPLYDVDTIRRIENEAFARLPSFELMSRAGSAAAEWLAGHAPEGMLLFLAGPGNNGGDAMVAATRLHQAGRKVEVWLAGDPARMPGDATRAWQEATAAGVPMQAMPATAAWPEGMAAIVDGLLGIGLNRAASGSMATWIERLAQAPAAVFALDIPSGLFADTGAGEPAVRACRTLTFLGAKPGLLTLDGRDCAGVVDIAPLGLDYPPAQGPRALVNGPALFRHALPARRHATNKGTFGSLAIIGGSSGMTGAPLLGARAAQFLGAGKVHIGFLAPSTPAVDPIHPELMLHPLAGLALDAMSALVIGPGMGTDPAACKALAQILQDAARAPSPPSLVLDADALNLLAAEAGLAGTLTASVLPRIMTPHPLEAARLLGSTVAAVQCDRLAAAEALAARWQAIVVLKGSGSVIASPGISASTINPTGNAALASAGTGDVLAGMAGALLAQGMPPAEAAQAAVWIHGRAADVLVAQGMGPAGLTASELAIPARNVFNALLAGKAE

SEQ ID NO: 23870 - protein, 330 aa, Mycobacterium sp. JLS
MKRSAAAVIGGATAAVAAGRYLLAREALSAVARDLRSPVLPYVAAPSSRRSMLVTRAFTRLPTPAGDGVTVTESRVGETAVRVVITAPAGGGTSRPAVMWIHSGGFVVGSPQLERFITGQIARELGATVVSPDYRLAPEHAVPAALDDCMATLRWMRTNADRLGIDADRIVVGGASAGGGLAATVAQRSLDEGCPLRGQALAYPMLDDRSVLRADHGGRGRFVWTPASNRFGWTAYLGHPPDTSEAPAYAAAARRSELSGLAPAWIGVGQLDLLHDDCVSYAERLESSGVPCELITVPGMYHAADAIAARALSMQTFRASMLNFMRARLS

SEQ ID NO: 23871 - protein, 115 aa, Mycobacterium sp. JLS
MALDPEIASRLKRNADGLFTAVAQERGTGQVLMVAWMDDIALDRTMRTRNATYWSRSRGEHWVKGETSGHTQHVHSVRLDCDGDTVLLEVEQTGPACHTGTHTCFDADVLLAPEA

SEQ ID NO: 23872 - protein, 276 aa, Oryza sativa (japonica cultivar-group)
MTGSSCPADSSQLLYPRRGAPTTTTTSRPPLHPLIAHAPYDVVLHRSVVLSISSARDQAELASFWCYIRLGGGASAKRAAGEDDRSRSSLTAARGGGGETMSGRGRGDPLVLGRVVGDVVDPFVRRVALRVAYGAREVANGCELRPSAVADQPRVAVGGPDMRTFYTLVMVDPDAPSPSDPNLREYLHWLVTDIPATTGVSFGTEVVCYESPRPVLGIHRLVFLLFEQLGRQTVYAPGWRQNFSTRDFAELYNLGLPVAAVYFNCQRESGTGGRRM

SEQ ID NO: 23873 - protein, 347 aa, Psophocarpus tetragonolobus
GGELFDRIVQKGHYSERQAATLIKTIVEVVEACHSLGVMHRDLKPENFLFDTLHEDAKLKATDFGLSVFYKPGESFCDVVGSPYYVAPEVLRKLYGPESDVWSAGVILYILLSGVPPFWAETEPGIFRQILLGKIDFQSEPWHSISDSAKDLIRRMLDQNPKTRLTAHEVLRHPWIVDDNLAPDKPLDSAVLSRLKQFSAMNKLKKMALRVIAERLSEEEIGGLKELFKMIDTDNSGTITFDELKDGLKRVGSELMESEIKDLMDAADIDKSGTIDYGEFIAATVHLNKLEREENLVSAFSYFDKDGSGYITLDEIQQACKDFGLDDVHIDDMIKEIDQDNDGQIDY

SEQ ID NO: 23874 - protein, 339 aa, Synechocystis sp. PCC 6803
MLKIGINGFGRIGRLVARIAMANPQVTLVGINDLVPASNLAYLFKYDSTHGSYGGTVVAKEEGIVIDDQFIPCFSQRNPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 23875 - protein, 341 aa, Chlamydomonas reinhardtii
MSGKIKIGINGFGRIGRLVMRATMLRPDIEVVAINDPFIDAEYMAYMFKYDSVHKTWPGHVNGSKDGFLVEGRKIHTFTESDPSKINWGAAGADIVIESTGVFTDIAKATAHLTGGAKKVIITAPSNDAPMYVMGVNHEKYNPATDHIISNASCTTNCLAPLAKVVNSKFGIKEGLMTTVHATTATQKTVDGPSKKDWRGGRAVNGNIIPSSTGAAKAVGKVLPELKGKLTGMAFRVPTNDVSVVDLTVTLEKATTYEDIMKALKEASEGEMKGVLAYTDEDVVSSDFVTDPASCTVDAKAGIMLSPTFVKLVAWYDNEWGYSNRVVDLALHVAKKAAVKV

SEQ ID NO: 23876 - protein, 111 aa, Trichodesmium erythraeum IMS101
MTLTPELKAKIDDLVTKNKIMVFMKGNKLMPQCGFSNNVVQILNILGVTYETCDVLENQDIRTGIKEYSNWPTIPQVYVDGEFLGGSDVMIEMYNNKKEELEQKLAVASAS

SEQ ID NO: 23877 - protein, 543 aa, Arabidopsis thaliana
MTMSIFNPDSINNELSKPTSIFGLKLWVVIGILLGSLIVIALFFLSLCLTSRRRNRKPRHADFASAAVATPPISKEIQEIVRPPAQDHCHPTQPVAAEIQVDIGKTEHRVVFSDRVSSGESRGTVSETASYSGSGCVGPEVSHLGWGRWYTLRELEAATNGLCEENVIGEGGYGIVYSGILTDGTKVAVKNLLNNRGQAEKEFRVEVEAIGRVRHKNLVRLLGYCVEGAYRMLVYDYVDNGNLEQWIHGDVGDKSPLTWDIRMNIILCMAKGLAYLHEGLEPKVVHRDIKSSNILLDRQWNAKVSDFGLAKLLFSESSYVTTRVMGTFGYVAPEYACTGMLTEKSDIYSFGILIMEIITGRNPVDYSRPQGEVNLVEWLKTMVGNRRSEEVVDPKIPEPPTSKALKRVLLVALRCVDPDANKRPKMGHIIHMLEAEDLFYRDVRLRIVCSYFWHGENDIFAGLEEASADDTYTDNLWNSYMKDEGFERFGIPSKRGRDWEDNDLSLNQLFMKPCSSRSRKNCDEPSLEAVASPDNHDHGENMH

SEQ ID NO: 23878 - protein, 233 aa, Trichodesmium erythraeum IMS101
MLFNKYIRFIYFTLGFTLPIVAAFTLLQKPLNAQSSESVNSEKFSPVPVQPIQLTQLELNPEKSSPIPVQPIQPTQPENARPLDPQNSLLSLQGGQSLMKEADNAITSENYDLANQKLQEARQIFNQLSNFHSQLAASFSGIDNRLADGQRTKALETAQMRDQATYQLALVHRAQNQPELAVPLLVQIISSQQPTRDLGKKAYQQLLELGFVDIPYPRTSGDGQPPTSSQSLN

SEQ ID NO: 23879 - protein, 131 aa, Caulobacter crescentus CB15
MAINIIAQLEQEESARLLAARAIPDFRPGDTLRVNVKIKEGERERVQAYEGVCIARAGTGVHESFTVRKISFGEGVERLFPLLSPSIESIEVKRRGVVRRAKLYYLRDRRGKSARIAERAGGPKASASTEA

SEQ ID NO: 23880 - protein, 311 aa, Caulobacter crescentus CB15
MSTSAIDPVSFSLYAKDFTRFAQELGASFERYGFAVLSDYDLDQARIDAAVDSAKAFFALPVETKKQYAGVKGGARGYIPFGVETAKGADHYDLKEFWHMGRDLPPGHRFRAHMADNVWPAEIPAFKHDVSWLYNSLDGMGGKVLEAIATYLKLERDFFKPTVQDGNSVLRLLHYPPIPKDATGVRAGAHGDINTITLLLGAEEGGLEVLDRDGQWLPINPPPGCLVINIGDMLERLTNNVLPSTVHRVVNPPPERRGVPRYSTPFFLHFASDYEIKTLQNCVTAENPDRYPESITADEFLQQRLREIKLA

SEQ ID NO: 23881 - protein, 383 aa, Oryza sativa (japonica cultivar-group)
MGFQSAHDTYSTNGLRGRGSDTMFKRDAPSTDMISGLPEGVLHRIMSFLTLREAVQTCVLSRRWRNLWLSMPLINADYKQFFEMTDTKAGYDEALAVAVPMFKRFVNRLLELRDPVASIDKFCLWYSISDDNEDDTESQDAAANRWISQALQKKARVVEVYGDLVFADLYPLVIDHSVFTSSYLTKVVFSSVLLEDGFFKQLESGCPALEDLSLDDCVISGDEISSQTLKVLTIKDTKFSMEHKTSINTPSVTSLTLWRPAHGIVVLKDMASVVTASVKPSEFIDEFDARGLRQYLWALSGVKNLEFYYLGENTPRLEKLTLKLHPFRYQQQRIIGELTERSFTCGHLKIVEVICSENDPLINHLVDFFVSSGMTTAQIHIKH

SEQ ID NO: 23882 - protein, 339 aa, Mycobacterium tuberculosis H37Rv
MTVRVGINGFGRIGRNFYRALLAQQEQGTADVEVVAANDITDNSTLAHLLKFDSILGRLPCDVGLEGDDTIVVGRAKIKALAVREGPAALPWGDLGVDVVVESTGLFTNAAKAKGHLDAGAKKVIISAPATDEDITIVLGVNDDKYDGSQNIISNASCTTNCLAPLAKVLDDEFGIVKGLMTTIHAYTQDQNLQDGPHKDLRRARAAALNIVPTSTGAAKAIGLVMPQLKGKLDGYALRVPIPTGSVTDLTVDLSTRASVDEINAAFKAAAEGRLKGILKYYDAPIVSSDIVTDPHSSIFDSGLTKVIDDQAKVVSWYDNEWGYSNRLVDLVTLVGKSL

SEQ ID NO: 23883 - protein, 412 aa, Mycobacterium tuberculosis H37Rv
MSVANLKDLLAEGVSGRGVLVRSDLNVPLDEDGTITDAGRIIASAPTLKALLDADAKVVVAAHLGRPKDGPDPTLSLAPVAVALGEQLGRHVQLAGDVVGADALARAEGLTGGDILLLENIRFDKRETSKNDDDRRALAKQLVELVGTGGVFVSDGFGVVHRKQASVYDIATLLPHYAGTLVADEMRVLEQLTSSTQRPYAVVLGGSKVSDKLGVIESLATKADSIVIGGGMCFTFLAAQGFSVGTSLLEDDMIEVCRGLLETYHDVLRLPVDLVVTEKFAADSPPQTVDVGAVPNGLMGLDIGPGSIKRFSTLLSNAGTIFWNGPMGVFEFPAYAAGTRGVAEAIVAATGKGAFSVVGGGDSAAAVRAMNIPEGAFSHISTGGGASLEYLEGKTLPGIEVLSREQPTGGVL

SEQ ID NO: 23884 - protein, 261 aa, Mycobacterium tuberculosis H37Rv
MSRKPLIAGNWKMNLNHYEAIALVQKIAFSLPDKYYDRVDVAVIPPFTDLRSVQTLVDGDKLRLTYGAQDLSPHDSGAYTGDVSGAFLAKLGCSYVVVGHSERRTYHNEDDALVAAKAATALKHGLTPIVCIGEHLDVREAGNHVAHNIEQLRGSLAGLLAEQIGSVVIAYEPVWAIGTGRVASAADAQEVCAAIRKELASLASPRIADTVRVLYGGSVNAKNVGDIVAQDDVDGGLVGGASLDGEHFATLAAIAAGGPLP

SEQ ID NO: 23885 - protein, 484 aa, Arabidopsis thaliana
MKLVEKTTTTEQDNGEDFCRTIIEVSEVNRNVFQAPGGEADPFRVVSGEELHLIPPLNFSMVDNGIFRSGFPDSANFSFLQTLGLRSIIYLCPEPYPESNLQFLKSNGIRLFQFGIEGNKEPFVNIPDHKIRMALKVLLDEKNHPVLIHCKRGKHRTGCLVGCLRKLQKWCLTSIFDEYQRFAAAKARVSDQRFMEIFDVSSFSHIPMSFSCSISMTPILQQHAKRILACGYKSSLFRSYATLWSPEASQTLLIRASRYMGKEKVCTLFQKDYAARLYLIETLLGLEEADKFFKSIPSNMIDYSTLLTSYARSDDVKPDNVTANTVLKADVKAIKMFMRMWVDEEGIKLERDRIVEMAKVYVRVCLEIYGNVVWNARELLQTLWDDFKKCEEVYRTAVISLSKLDDVEGAEDIYGEGEKKEQNVREQVTKKAMMLLHVLNLLLILITLSLPFFVCPPNLSIPLVVLSVILTHISITRLLRFVFF

SEQ ID NO: 23886 - protein, 1317 aa, Pseudomonas fluorescens PfO-1
MATTTLGVKLDDPTRERLKAAATSIDRTPHWLIKQAIFNYLEKLEGGATLTELNGLTAKDADDAGEVHTDHAHQCFLEFAESILPQSVLRASITAAYRRPEPEVVPMLIEQARLPAPMAEATNKLAATIAEKLRNQKSAGGRAGIVQGLLQEFSLSSQEGVALMCLAEALLRIPDKGTRDALIRDKISTGNWQPHLGNSPSLFVNAATWGLLLTGKLVSTHNEAGLTSSLSRIIGKSGEPMIRKGVDMAMRLMGEQFVTGETIAEALANASKFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLSVPEVIYPQFATHNAHTLSAIYHIAGQNYYPGQYEFQCLHGMGEPLYEQVVGKVSEGKLNRPCRVYAPVGTHETLLAYLVRRLLENGANTSFVNRIADQSVSIQELVADPVAQIEQMATVEGGFGLPHPRIPLPRDLYGSERANSAGIDMANEHRLASLSCALLATAHNNWKAAPMLGCASSNEAPAPVLNPSDLRDVVGHVQEATVEDVDNAIQCALNAAPIWQATPPAERAAILERAADLMEGEIQPLMGLLAREAGKTFANAIAEVREAVDFLRYYAVQARNDFSNDAHRPLGPVVCISPWNFPLAIFSGQVAAALAAGNPVLAKPAEQTPLVAAQAVRLLLEAGIPEGVLQLLPGRGETVGAGLVGDERVKGVMFTGSTEVARLLQRNIAGRLDNQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQGMRDKGRNVYQVAIADTEEVKRGTFVMPTLIELESFDELQREIFGPVLHVVRYKRKEIDQLIAQINASGYGLTLGVHTRIDETIAKVIDNVNAGNVYVNRNIVGAVVGVQPFGGEGLSGTGPKAGGPLYLYRLLSTRPTDAIEQSFARADAAVAPDVRLRDAMSKPLTALKAWADSNKFADLSTLCVQYAAQSQSGITRVLAGPTGEKNSYAILPREHVLCLADIEGDLLTQLAAVLAVGGSAVWPESDTSKALFARLPKEIQARIKLVSDWNKDDVVFDAVLHHGHSDQLRAVCQQIAKRAGAIVGVQGLSQGETNIALERLVIERALSVNTAAAGGNASLMTIG

SEQ ID NO: 23887 - protein, 541 aa, Ralstonia eutropha JMP134
MALMGQMMSAPLLISSIIRHAARYYGSTEIVSRRTEGDLHRYTYRDCELRARKMAQALAALGVQQGDRVGTLAWNGYRHLEIYYGVSGMGAVCHTINPRLFPEQIAYIVNHADDGYVFFDLTFLPLVEGVAPHCPNVKGWVLMSDRAHMPAESKGKLLCYEELIDAQDGNYDWPDLDENQASSLCYTSGTTGNPKGALYSHRSTVLHSYASALPDALGCSARDVILPVVPMFHVNAWGLPYSVPLVGAKLVLPGPKLDGASVYELFEQEKVTFSAGVPTVWLGLLQHVQANNLKFSTFRRTVIGGSAVPPAMIRALRALDVEVIHGWGMTEMSPLGTTCKLLAKHEELSEEASQKVLEKQGRVLFGVDMKIVDGDGKELPWDGKAFGDLLVRGPWIIERYFRNDTNPLVDGWFPTGDVATIDPDGYMQITDRSKDVIKSGGEWISSIDIENVAAAHPAVHMAACISVHHPKWDERPLLVVVKKPSAEVTREELLKFFEGKVAKWWIPDDVAFVSEIPLTATGKMQKLKLRDQFKDYRLPTA

SEQ ID NO: 23888 - protein, 292 aa, Symbiobacterium thermophilum IAM 14863
MPAPPEEIRIRQGRPLHLVYPGGDAFVTPDGRLTADPARAVRPDGDDLQRTFQLMAKGSVYAWEEEVRGGFLTLEGGHRVGLCGRAVTEACRIRTLKQVASLNVRIAREVPGAADGLLPHLVRGGRFLSTLLVSPPQAGKTTLLRDLVRQLSTGVPRLGLRGLKVGLVDERSEVAGCVCGVPQRDVGPRTDVLDGCPKAEGLMLMIRALSPQVVAADEIGRPEDAVAVMEALHAGVAVLATAHGAGLSDVRRRPALAELLRAGAFERAVVLGRSRGPGTVEAVLDLAREVVA

SEQ ID NO: 23889 - protein, 506 aa, Ralstonia eutropha JMP134
MSSHSHPHPHQHPVVEHDDLQRKLKARHLTMIAIGGAVGTGLFVASGASIAQAGPGGALLMYALLGFMVYCLMTSLGELAVHMPVAGSFVTYSALYVEEGFGFALGWNYWFSLAVTIAVELTAAQLVMQFWFPGMPGMVWSAGFLLLMFALNAFSVRGFGEAEYWFALIKVITVIVFLGVGLLMIFGIMKGGPQSGWHNFTTGDAPFVGGIPAMIGVAMIAGFSFQGTETVGVAAGEAQDPARTIPRAIRQTFWRILLFYVIAILIIGVLIPYTDPNLLRNDVTDVGVSPFALVFRQAGLAFAAGLMNAVVLTALLSAGTSSMYVSTRILYGLAVSGRAPRWLGKLTVNGVPFNALLVTTAVGALCFFSSLFGDKAVYLWLLNTSAMTGFFAWFGIALSHYRFRRGLVYQGYDINALAYRSPLYPFGPIFAGVLCLVIVAGQNYQAFADIPNRWPEIIATYIGVPVFLALWLGYRIVRKTRLIDYEDMPFELPKTAKVIAGQAAQV

SEQ ID NO: 23890 - protein, 126 aa, Pseudomonas putida GB-1
MSKTVITSDKAPAAIGTYSQAIKAGNTVYMSGQIPLDPKTMELVEGFEAQTVQVFENLKAVAEAAGGSFKDIVKLNIFLTDLSHFAKVNEVMGRYFEQPYPARAAIGVAALPKGSQVEMDAILVIE

SEQ ID NO: 23891 - protein, 496 aa, Thermobifida fusca YX
MKACVVGPEWMRKTTLRSSSVTNMSQRPFWLAGSATTGDNELTVTNPYTGQTVATVAVPSPEQVDQAVAAAHGALDATAALPAHVRATALAHVARRLQERSEEIAQLITAESGKPILWARAEVGRAVSVFTWAAEEVRRDSGRVQRLDTDSAGEGRIALIRRVPKGAVLAISPFNFPLNLVAHKVAPAIAVGAPIVVKPAPATPLSALVLGEILAETDLPAGAFSVLPMPNELAQPLITDERLPVISFTGGQFGWELRKMAPNKHVTLELGGNAAAVVLADADLDWAARRIALFGNNQAGQVCIGVQRVIVEDAVYDEFAAKLVQRVEELVTGDPADEATQVGPLINEAAAARVEQWVNEAVAGGATVLTGGTRDGVTMAPTVLADVPDDAKVVCEEVFGPVMVLRRVSGVDEAFAEVNNSKYGLQAGVFTRDLATAFRAHRELKVGGVIIGDVPTYRADQMPYGGVKKSGVGKEGVRSAMDDLTDERVMVLTGVL

SEQ ID NO: 23892 - protein, 75 aa, Glycine max
HALSDNLCISARNHSHGFSASECQANQASATSEECTVAWGVCNHAFHFHCISRWLKTRQVCPLYNSEWEFQKYGH

SEQ ID NO: 23893 - protein, 354 aa, Trichodesmium erythraeum IMS101
MVNTQAREDLHIRLEETQLLDRDCTTLSRHVLQQLHFSPDAQDISSLMNRIGLAGKLIARRLTRAGLLEDTLGFTGTVNVQGESVKKMDIYANDVFISVFKQSGLVCRLASEEMEKPYYIPENCPIGRYTLLYDPLDGSSNLDTNLNVGSIFSVRQQEGNDENGLAQDLLQNGHKQIAAGYILYGPSTMLVYSIGQGVHAFTLDPSLGEFILVNENIKIPEHGPVYSVNEGNFWQWDDSMRDYIRYVHRHEGYTARYGGALVGDFHRILYQGGVFLYPGTVKKPEGKLRLLYESAPMGYLVEQAGGRASTGTEEILDVVADQLHQRTPLIIGSKEDVALVESFIKEQKRISNQG

SEQ ID NO: 23894 - protein, 203 aa, Brassica napus
MAGGGNRAEADRWLVTSEKLLASSDLHGAKSFAIRACESDPTRAQAADYILAICDILIAGEIRVTVSNLPDWYSVLRLGRLTQSPEHVATQYRRLALLLNPSVNRLPFADKAFELVSDAWRVLSDPIRKSSYDRALQPSQLGQLGGASQLRWTACPYCFVFFEYPRDYEECVMKCRDCKRAFQAVRIQKPPVVVEGEEDVYFC

SEQ ID NO: 23895 - protein, 663 aa, Triticum aestivum
  misc_feature (51)..(51): Xaa can be any naturally occurring amino acid
  misc_feature (131)..(131): Xaa can be any naturally occurring amino acid
  unsure (1)..(663): unsure at all Xaa locations
MPAWWKGKGRSKSKAPAPAGDAGTIPAVRDGEKDRKNKKATSFDEALIGRXGRGKQLQQPAPAVGHPLPRPAFMPSASAPASASASASSGGSSSLGSSAASDEPLDLGIYRISDANRTPAIDSRKQSLVLXEGRFVVHNLASENNRSCEPSVSPRKEFQSNILDLPSDRTTYCHGRKSTEIVFATRMPSSPPSSRGKNCPTSPVHSRAFGQCPGSPTAWQEDARSSSSPHPLPLPPGSPCTSSRSLHSQWKKGKLLGSGTFGQVYLGFNSEGGQMCAIKEVKVIADDSNSKECLRQLNQEMLLLNQLSHPNIVQYYGSELSSETLSVYLEFVSGGSIHKLLQEYGPFGETILRNYTAQILSGLAYLHGRNTVHRDIKGANILVDPNGDIKLADFGMAKHISAYTSIKSFKGSPYWMAPEVIMNTNGYSLSVDIWSLGCTILEMATARPPWSQYEGVAAIFKIGNSKDIPDIPDHLSSEAKSFLKLCLQRDPAARPTAAQLIEHPWVKDQASVRSSRSGSGITRDMFSTSTDGSKATVKTSIELSSYRSLSPLRDTNLRMRNLVVPASSIPSISTHRASAISASNVRMNMSLPVSPCTSPLRQYRQSNRSCLPSPPHPAYSAGAANYSPINNVLYPTRPSNYLTDPWLETPRQKTQTFDSPRRL

SEQ ID NO: 23896 - protein, 575 aa, Oryza sativa (japonica cultivar-group)
MEQGHRQFIGSDCLRAYIAFSSLSVLLLLGGHVALLLLSRCLRLPLDAVSFALLLPNTAAALALVALVAIAAFWFTLLPEWITGRYSSPWRWSSTSPLVLAERGDPSAARRHGVAGFHARHLFDERRLSGCSAAMEEPPGKKGPAMDPAQDSGRDWLSGLPEGVLHRIMSFLDSRQAVRTCVLSRRWRDLWRSIPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKLTIENNLQWCPKFFNLVGLTLGKWCLNANFYALIVFLQNSPRLEKLTLILAEDNCKTSEVFIGELEEKSFTCEHLTSVEMKCWEDDPLVINVVDFFVGSGMSSSQIHIEYEDDDEDQFHIESDDMFGFEFEYEDEDEDEDEDEDE

SEQ ID NO: 23897 - protein, 949 aa, Oryza sativa (japonica cultivar-group)
MKRSGDIASLFGNHEAKTMEIPESSSSSNVFIGDEAPVPEEEPRQVPTDAFPRAPPVRRNASSVSATMDRRPGRHKLRRVKAHVRAARMDRISGLPDKILHHIMSFLNTRQAVQTCVLSRRWRNLWRTMPCINADFDEFDFIAYQGDDEDYNDEVAFKRFVNQMLELRDPTAMIDTFWLSYIIWDGYNEYKDSNVDANRWISHALQKQARVIEVVVFAFPLELDHSVFTSCYLRKIGFSCVSLHQGFFKQLDTGCPALEELFLHDCIIADEEILSQSLKVLTIDGTEFSMANKASISIPSVTSLTLSIEDSTPMLKDMELLTTASVSVKFNTFIFSYGFDANDLRQCLWSLSGVTNLEFNYEGTELTFENNLQWCPEFIDVVNLTLGQWCLDANFYALIVFLQNSPRLEKLTLNLAKCIADKSPRIVGELMERSFTCEHLKIVEVKCLEDDPQVISVEDFFASNGMASVQFDIKHWGQYKDELPAFIRHHKSYIPEIKRHPVIFHMAIKVPHAHHLFDETPLRAWPPWRGVLAVARRKVKTPAHAAGMDWISDLPDEILHRIMSFLNARQAVQTCVLSRRWRNLWRTVPCINADCKEFDFFGFRRSEVEFKRFVNRLLELRDPIAMMDAFWFRYHKLDTDTTSSADTNRWISHALQKQARVLEAVMYPCHLLDLDHSSFTSRYLRRIGFSGVRLDQGFFKQLEAGCPALEDLFLHHCTIEDDKISSQTLKVLTIDRTYFLIAINATDVQKKSISAPSVTSLTMYSPEGSLHILKDMTSLVTASVSFSEFRVHFDANDFYQYLWSLSGVTNLEFNYQGPKLKIENNLQWCPEFVNVVNLTLGKWCLDANFYALTVFLQNSPKLQKLTLKLAKCTSEIHQRIIGELTERSFTCEHLKIIEVICLENDPQVIRVKDFFASSGITSVQFHIKHWSQLKEDKLPAFTRIPIPSH

SEQ ID NO: 23898 - protein, 203 aa, Salmonella typhimurium
MLTEQQRRELDWEKTDGLMPAIVQHAVSGEVLMLGYMNPQALDKTIESGHVTFFSRTKQRLWTKGETSGLVLNVVSIAPDCDNDTLLVLAKPVGPTCHKGTSSCFGDASHQWLFLYQLEQLLAERKTADPTSSYTAKLYASGTKRIAQKVGEEGVETALAATVNDRFELTNEASDLMYHLLVLLQDQDLNLTTVIDNLRKRHQ

SEQ ID NO: 23899 - protein, 700 aa, Mycobacterium tuberculosis H37Rv
MTTLEEISALTRPRHPDYWTEIDSAAVDTIRVLAADAVQKVGNGHPGTAMSLAPLAYTLFQRTMRHDPSDTHWLGRDRFVLSAGHSSLTLYIQLYLGGFGLELSDIESLRTWGSKTPGHPEFRHTPGVEITTGPLGQGLASAVGMAMASRYERGLFDPDAEPGASPFDHYIYVIASDGDIEEGVTSEASSLAAVQQLGNLIVFYDRNQISIEDDTNIALCEDTAARYRAYGWHVQEVEGGENVVGIEEAIANAQAVTDRPSFIALRTVIGYPAPNLMDTGKAHGAALGDDEVAAVKKIVGFDPDKTFQVREDVLTHTRGLVARGKQAHERWQLEFDAWARREPERKALLDRLLAQKLPDGWDADLPHWEPGSKALATRAASGAVLSALGPKLPELWGGSADLAGSNNTTIKGADSFGPPSISTKEYTAHWYGRTLHFGVREHAMGAILSGIVLHGPTRAYGGTFLQFSDYMRPAVRLAALMDIDTIYVWTHDSIGLGEDGPTHQPIEHLSALRAIPRLSVVRPADANETAYAWRTILARRNGSGPVGLILTRQGVPVLDGTDAEGVARGGYVLSDAGGLQPGEEPDVILIATGSEVQLAVAAQTLLADNDILARVVSMPCLEWFEAQPYEYRDAVLPPTVSARVAVEAGVAQCWHQLVGDTGEIVSIEHYGESADHKTLFREYGFTAEAVAAAAERALDN

SEQ ID NO: 23900 - protein, 651 aa, Pseudomonas fluorescens PfO-1
MSELIRVPDIGSGEGEVIELFVKVGDRIEADQSILTLESDKASMEVPAPKAGVIKSLKVKLGDRLKEGDELLELEVEGAAQAAPAPAAAPAAKAEAAPAAAPAPAAPAAAPAAASVQQVHVPDIGSSGKAQIIEIQVKVGDTVEADQSLITLESDKASMEIPSPAAGVVKAISVKLNDEVGTGDLILDLEVAGAAAPAAAAPAQAAAPAAAPAPAAAPAAPVADSVQDIHVPDIGSAGKAKIIEVLVKAGDSVEADQSLITLESDKASMEIPSPAAGVVESISIKLDDEVGTGDLILKLKVKGAAPAAAPAPAAAAAPSAPAPAAAPAAAAPAAAAPVAAPAKPGAKVHAGPAVRQLAREFGVELSAVGASGPHGRILKEDVQTYVKAMMQKAKEAPAAAAGATGGAGIPPIPVVDFSRFGEIEEVPMTRLMQVGAANLHRSWLNVPHVTQFDSADITELEAFRTAQKSVAEKAGVKLTILPLLLKSCAHLLKELPDFNSSLAPSGKAIIRKKYVNIGFAVDTPDGLLVPVIKNVDQKSLLQLAAEAASLAEKARTKKLSSDEMQGACFTISSLGHIGGTGFTPIVNAPEVAILGVSKATIQPVWDGKAFQPKLMLPLSLSYDHRVINGAAAARFTKRLSDLLADIRTILL

SEQ ID NO: 23901 - protein, 881 aa, Pseudomonas fluorescens PfO-1
MQDLDPVETQEWLDALESVLDKEGEDRAHYLMTRMGELATRSGSQLPYAITTPYRNTIPVTHEARMPGDLFMERRIRSLVRWNAMAMVMRTNLKDSDLGGHISSFASSATLYDIGFNYFFQAPTDEHGGDLIYFQGHTSPGVYARAFMEGRITEDQMNNFRQEVDGQGLSSYPHPWLMPDFWQFPTVSMGLGPIQAIYQARFMKYLEHRGFIQPGKQKVWCFLGDGECDEPESLGAISLAGREKLDNLIFVINCNLQRLDGPVRGNGKIIQELEGVFRGAQWNVTKVIWGRFWDPLLAKDVDGILQRRMDEVIDGEYQNYKAKDGAFVREHFFNTPELKAMVADLSDDEIWKLNRGGHDPYKVYAAYHEAVNHKEQPTVILAKTIKGYGTGAGEAKNTAHNTKKVDVDSLKLFRDRFDIPVKDEELENLPFFKPEPNSAEARYLAERRAALGGFVPQRRAQSFSVPTPDLDTLKAILDGSGDREISTTMAFVRILAQLVKDKEIGPRIVPIIPDEARTFGMEGMFRQLGIYSSVGQLYEPVDKDQVMFYKEDQKGQILEEGINEAGAMSSFIAAGTSYSSHNQPMLPFYIFYSMFGFQRIGDLAWAAGDSRTRGFLIGGTAGRTTLNGEGLQHEDGHSHLLAATIPNCRTYDPTYGYELAVIIQDGMKKMTEEQQDIFYYITVMNESYQQPAMPAGAEEGIKKGMYLLEEDTRDAAHHVQLMGSGTILREVREAAKILREEFNIGADVWSVTSFNELRRDGLAVERSNRLKPGQKPKRSYVEECLSGRKGPVIASTDYMKLFAEQIRQWVPSKEFKVLGTDGFGRSDSRKKLRHFFEVDRHFVVLAALEALADRGDIEPKVVAEAITKFGIDPEKRNPLDC

SEQ ID NO: 23902 - protein, 351 aa, Symbiobacterium thermophilum IAM 14863
MAETMRALRKLEAGPGATLQEVPIPTIGPRDVLVKVRAASICGTDYHIYTWDPWSAGRVKPPLTIGHELAGEVVAVGREVTACKVGDYVSAETHIVCNRCPRCHMGEYHLCENTKILGVDTDGAFAEYVAVPEQNIWVNDKDIPFELQSIQEPLGNAVHTALNGDLTARSVLITGCGPIGIMSVPVAKMAGAEIVMAMDINEYRLQLAGQLGADVLINPTKQDPVEVVRSYTRGYGADVVLEMSGNPTAIRQGLKAARNGARISLLGLPGRPLELDLAADVIMRGLVLQGITGRRMWQTWYQVRSLYRAGLAERLRPLVTHRMPLEQIDAAMELMGSGQSGKIVLVPDLKA

SEQ ID NO: 23903 - protein, 343 aa, Cercospora nicotianae
MASNGTSVSPFRSQKNAAMAVNDTPANGHAEPSTITAASKTNTTKITSQNDPQSSFAVKVGLAQMLKGGVIMDVVNAEQARIAEEAGACAVMALERVPADIRKDGGVARMSDPQMIKDIMNAVTIPVMAKSRIGHFVECQILQAIGVDYIDESEVLTPADPVNHIDKSVYNVPFVCGCKNLGEALRRISEGAAMIRTKGEAGTGDVVEAVRHMQTVNAEIAKASSASDADLRMMARELQCDYNLLKQTAQLKRLPVVNFAAGGIATPADAALMMQMGCDGVFVGSGIFKSGDAAKRAKAIVQATTHYNDPKVLAEVSSGLGEAMVGINCDKLPETQKLATRGW

SEQ ID NO: 23904 - protein, 206 aa, Escherichia coli
KHFAALSTNAKAVGEFGIDTANMFEFWDWVGGRYSLWSAIGLSIVLSIGFDNFVELLSGAHAMDKHFSTTPAEKNLPVLLALVGIWYNNFFGAETEAILPYDQYMHRFAAYFQQGNMESNGKYVDRNGNVVDYQTGPIIWGEPGTNGQHAFYQLIHQGTKMVPCDFIAPAITHNPLSDHHQKLLSNFFAQTEALAFGKSREVVEQE

SEQ ID NO: 23905 - protein, 400 aa, Coprinopsis cinerea okayama7#130
MALPPSTANWHWKNKNVTPWAKDWLSTELTTVTVTGDNGESASISEVTSVEGDVELGQRKSKLLTIFDVDVRLKWKGKTSSGTDVEGTLQIPEVSHEILCDNLSEFEFKWSLRTASSPEVDAVFKLAKTRLASALETKLAVLPSTMIEVHGKDIYISGSGAATPANGTATPPAPSTSAAAAAPARAPVAPVKKAASKPANTSTVTVEATFQAAADDLFSLLTDEKRIPAWTRNAAVSQAKADTEYSLFGGGVKGKYVSLAPGKEIVQTWALQSPTWPQGHEATLTTTFDQSTDSTKVTFSLAGVPTGMEDELRRNIEGYYVHGFKSIGYVAFVSAEPVYSSDYVRERQKQKQSRSVKAKAEEAEEPPPNFMMQTAIIGVLVLAAAFAIPYLSSSSLPRSS

SEQ ID NO: 23906 - protein, 436 aa, Mycobacterium sp. JLS
MSIPVPALTPEQIRALDAAHVWHPYSTIGAGALPPVVALAAKGVWITIDHPAGGGPVDVIDAMSSWWTAIHGHGHPVLDAAITRQLATMNHVMFGGLTHEPAVRLAQLLVQITPPGLDTVFFSDSGSVSVEVAVKMALQYWRAAGRPGKTRLMTWRGGYHGDTFTPMSVCDPDGGMHSLWTDVLTRQVFAPPVPRDYDPEYVAAFERRLAEHADELAAVIVEPVVQGAGGMRFHDPRYLSDLRTLCDRHGVLLVFDEIATGFGRTGELFAADHVGVSPDIMCVGKGLTGGYLTLAATLCSTEIARVISTGEAGALMHGPTFMANALACAVGVAAVELLLAGDWRTTIATIERGLTEGLAPAREVSGVADVRVLGAIGVVELDRPVDMATATAAALSHRVWLRPFRNLVYVMPPYICTPEEIAQITSAVVGVARALA

SEQ ID NO: 23907 - protein, 125 aa, Oryza sativa (japonica cultivar-group)
MAAEQRQQQQMMQEGFEDYLPVMAERLGEEGLMQELASGFRLLMDPASGLITFDSLRRNAPLLGLGGMSDDDLRGMLAEGDFDGDGALSEMEFCVLMVRLSPDLMDEPRRWLDDAVAQASQFLFH

SEQ ID NO: 23908 - protein, 417 aa, Anaplasma marginale str. St. Maries
MVEKAILECGDCKISLPVMHGSDGTLAVDTTSLYKDSKILTYDPGFMSTAACKSEITFIDGDEGILRYRGYDIADLTMADGGFCSIAYLLLYGTMPQGRELADFVATVSRECNVRTQVLDVIRALPRDAHPMAILIASFAALAAHYHGANSLDPLRSAIVAISQVPGIVASIYRHTSGAPLIEADPSLGYVQNFVHMMFGDLHETRKSIICKALEAIFIMHADHEQNASTATVRATGSAGANLFACLSAGAATLWGPAHGGANEAVVKMLEEIGRPERVGEFIEKVKEKESGVRLMGFGHRVYKNYDPRARIIRDICKETLSGLGADDPLLDVATALEKAALEDEYFVKRSLYPNVDFYSGIVLKAAGVPVNMFTAFFALARTTGWSAQWYEMLDKQHEGSKICRPRQLYTGKMNAE

SEQ ID NO: 23909 - protein, 529 aa, Anaplasma marginale str. St. Maries
MSTVAIVDFGSQVTQLIARRVRELGVYSEVFPPSTDFQAMASRGIKIDAFILSGGPNSVQQLHGVPNAVSDVLNLNLQKGVPVLGICYGFQMLAHYFGADVAQSVAREFGRAWLDVIEPSSITEGVWSLGSKVDVWMSHSDSIVGEVPQGFRVVARSADTGAVAFMCNDERKIYGVQFHPEVAHTPGGREMLDNFLKIAGCTRDWTMGSFLHTQIGAIKSATDGGRVVAAISGGVDSSVASVLVHKAIGERLVCVFVDTGLLRKGEAGVVRDLFVGKLNMHVNVLDKSALFMQRLAGVQDPEVKRKIIGETFIEVFEQEAKSLGDIKFLMQGTIYPDVIESGVGESGTKIKSHHNVGGLPEIMNLSLVEPLRHLFKDEVRLLGKELGLPSAILDRHPFPGPGLAVRIMGEVTAERVELLREIDNIYIDMMRDSGLYDHIWQAFAVLVPVRTVGVMGDGRTYGYVCALRAVTSSDGMTADCFPFGETDERKLEFLAFLQKVSRAIVSNLQGVNRVVYDMTSKPPATIEWE

SEQ ID NO: 23910 - protein, 433 aa, Anaplasma marginale str. St. Maries
MPVRVLMPALSPTMKSGIVARWHKKEGDSVKPGDVIADIETDKAVMEFEYVDEPGVLYKILTQEGTRDVPVNQVIAVVRVGDEDVASVEALCNVAHDADAKGSAADSQGTAAVAAPASPSVVTNTEKPSQPQPERQRPERGVAYPIPDFAEERKIKATPLAKKLASRLSVDITKVAGTGPYGRVVKADVLDAAAGGGFPSTTGAAGGDVVEVSSMRRVIADRLLESKLTVPHFYLAVDCMVGELLKLRVEINDSCADRGTKITVNDFVLKAVALAMREFPEINSSWEGDRIRYHRDINISFAVSIDGGLITPVVENVDAKSLSEISDITKSLATRAKERKLQPHEFQGGGFTVSNLGMFGVREFYAIINPPQSCIMAVGQSEKRAVVVDGCVVPADVMTVTLSVDHRSVDGVLAAKFLNRFKFYIENPLLMLV

SEQ ID NO: 23911 - protein, 126 aa, Zea mays
  misc_feature (31)..(31): Xaa can be any naturally occurring amino acid
  misc_feature (34)..(38): Xaa can be any naturally occurring amino acid
  misc_feature (40)..(40): Xaa can be any naturally occurring amino acid
  misc_feature (42)..(42): Xaa can be any naturally occurring amino acid
  misc_feature (48)..(49): Xaa can be any naturally occurring amino acid
  misc_feature (54)..(54): Xaa can be any naturally occurring amino acid
  misc_feature (56)..(56): Xaa can be any naturally occurring amino acid
  misc_feature (61)..(62): Xaa can be any naturally occurring amino acid
  misc_feature (71)..(71): Xaa can be any naturally occurring amino acid
  misc_feature (74)..(75): Xaa can be any naturally occurring amino acid
  misc_feature (78)..(78): Xaa can be any naturally occurring amino acid
  misc_feature (84)..(84): Xaa can be any naturally occurring amino acid
  misc_feature (88)..(88): Xaa can be any naturally occurring amino acid
  misc_feature (97)..(97): Xaa can be any naturally occurring amino acid
  misc_feature (99)..(100): Xaa can be any naturally occurring amino acid
  misc_feature (107)..(107): Xaa can be any naturally occurring amino acid
  misc_feature (112)..(112): Xaa can be any naturally occurring amino acid
  unsure (1)..(126): unsure at all Xaa locations
MAVKYSRSVTLRGLLSRGRSFHAARSNTYVXVRXXXXXGXDXYKEQVXXYLTKXWXGGFEXXINTLFLTEXCRXXMLXLKYFFXRNVXINYPFEKVXLXXRFRVEHXLRRYXLGEERCIAGRLCEA

SEQ ID NO: 23912 - protein, 454 aa, Oryza sativa (japonica cultivar-group)
MDSSSSFVLVVLILQAVVIGCSSLDELPVQLSNRRLLHDRNHAALLYKDHFPTVGNMTFPTSHQLQNDPNYKPLDSSSHPAEASANKGSSKGFKKWLYIVVIPVAGLIMLAGMAWMFLPCRKKSVATIGPWRTGLSGQLQKAFVSGVPQLQRPELERACEDFSNIVASHPYYTVYKGTLSSGVEIAVVSTTIKSSKDWSKHCEDCFRKKIESLSRINHKNFINLLGFCEEEEPFTRVMVFEYAPNGTLYENLHDEAFDHIDWRSRMRIIMGIAYCIQHMHELNPANVHPDLHSSAVFLSEDCAAKIADLSVWQEVVSDGKKSTANNDHHEPISARLAGNVYSFGILLLEIISGKPPYSENEGSLANLALGCIIKGRSIASMLDSVLESHKENELDVICQIIMECIQSDPTKRPGMREITTRLRETIAISPDAATPRLSPLWWAEVEVLSPVEPR

SEQ ID NO: 23913 - protein, 539 aa, Caulobacter crescentus CB15
MADLDAAWTRLEAAAKAAGDKRIVEFFDAEPGRLDALTLDVAGLHLDLSKQAWDEAGLEAALDLAHAADVEGARARMFDGEAINSSEGRAVLHTALRAPAGADVKALGQPVMAEVDAVRQRMKAFAQAVRSGAIKGATGKPFKAILHIGIGGSDLGPRLLWDALRPVKPSIDLRFVANVDGAEFALTTADMDPEETLVMVVSKTFTTQETMANAGAARAWLVAALGEQGANQHLAAISTALDKTAAFGVPDDRVFGFWDWVGGRYSLWSSVSLSVAVAAGWDAFQGFLDGGAAMDEHFRTAPLEQNAPVLVALAQIFNRNGLDRRARSVVPYSHRLRRLAAFLQQLEMESNGKSVGPDGQPAKRGTATVVFGDEGTNVQHAYFQCMHQGTDITPMELIGVAKSDEGPAGMHEKLLSNLLAQAEAFMVGRTTDDVVAELTAKGVSDAEIATLAPQRTFAGNRPSTLVLLDRLTPQTFGALIALYEHKTFVEGVIWGINSFDQWGVELGKVMANRILPELESGASGQHDPSTAGLIQRLKR

SEQ ID NO: 23914 - protein, 302 aa, Arabidopsis thaliana
MAGIDTQKQLLSLIRDFTSERSRGEQRVVGLKKRIEILQSEVEAANSEVEHAKRIKEVAEEELNGYEVELSLNDATIQSLEAWICLLQDEVTTIGSEVDALKVMFVKLLVLFVIFRDQFISQMEELNKEIREFQKTVDSSLSSDDGIGITANVKASEDGSGADLEAIKGMLSEVNSQLAKEEEGYLAEQKIQEQLQKELDDYEKKMSLMEAITDKTNSVQVLTRYPLILLADIGFTWGGAAKEMPMPTLRGGKFGSPELTSSGRSRYGGVLVKSRSHLWLLGKRLIYSGLKMVRRFLPPLRI

SEQ ID NO: 23915 - protein, 860 aa, Burkholderia sp. 383
MRRAEESQLKSPTHDQIVLLAPLTGPIVALADVPDPVFSGGMFGDGIGIDPLAGRLVAPCAGVVSHLARTGHAVTITTPHGAEVLLHIGIDTVELNGQGFIAHVEAGARVEAGTLLIEFDQDAVARSAHSLVSVIAIANSDAFEVVDRASGFATAGETPLLVLRGKGEAAVQAAQTGAAAQNEVRREIVLAQPGGLHARPAARAREAVRGFDATVDVLFDGRKASIASVVGLLGLGAGEGATVELVGRGAHAQQAVDAVEHELLREAHGEVEEKPARLKSPAPQMVARNVGVPIDPNTLAGVCAAPGIAVGTLVRLDDAEIVPPEQASGTPAAESRQLDQALKAVDGELDETVRNASARGAVGEAGIFAVHRVLLEDPTLIDAARDLISLGKSAGFAWRATIRTQIDTLSKLDDALLAERAADLRDIEKRVLRALGHTNGAARALPDEAVLAAEEFTPSDLSSLDRQRVTALVMARGGATSHAAIIARQLGIPALVAVGDALYAIPDGTQVVVDASAGRLEHAPTALDVERARHERQRLDGVREANRQLAGEAASTVDGRAIEVAANIATLDDANTAVDNGADAVGLLRTELMFIHRQAAPTVVEHQQSYQSIVDALQGRTAIIRTLDVGADKEVDYLTLPPEPNPALGLRGIRLAQVRPDLLDDQLQGLLAVKPLGAVRILLPMVTDAGELVRLRKRIDEFARAQGRTEPIEVGVMIEVPSAALLADQLAQHADFLSIGTNDLTQYTLAMDRCQADLAAQSDGLHPAVLRLIDIAVRGAAKHGKWVGVCGALGGDPLAVPVLVGLGVTELSVDPVSVPGIKARVRRLDYQLCRQRAQDLLALDSAQAVRAASREVWPLD

SEQ ID NO: 23916 - protein, 526 aa, Pseudomonas putida GB-1
MCARRPARILTTPVSPQCGVAPKQEEEFRMTTLTRADWEQRAQQLKIEGRAFINGEYTDAASGETFECLSPVDGRFLAKVASCDLADANRAVENARATFNSGVWSQLAPAKRKAKLIRFADLLRKNVEELALLETLDMGKPIGDSSSIDIPGAAQAIHWTAEAIDKVYDEVAPTPHDQLGLVTREPVGVVGAIVPWNFPLLMACWKLGPALATGNSVVLKPSEKSPLTAIRIAQLAIEAGIPAGVLNVLPGYGHTVGKALALHMDVDTLVFTGSTKIAKQLMVYAGESNMKRIWLEAGGKSPNIVFADAPDLQAAAEAAASAIAFNQGEVCTAGSRLLVERSIKDKFLPMVVEALKGWKPGNPLDPQTTVGALVDTQQMNTVLSYIEAGHQDGAKLLAGGKRTLEETGGTYVEPTIFDGVTNAMRIAQEEIFGPVLSVIAFDTAEEAIAIANDTPYGLAAGIWTSDISKAHKTARAVRAGSVWVNQYDGGDMTAPFGGFKQSGNGRDKSLHALEKYTELKATWIKL

SEQ ID NO: 23917 - protein, 546 aa, Azoarcus sp. EbN1
MSNSPYAQGLAKNTANYVPLSPLSFIERTAQVYPQRTAVIHGACRFTWQETYARCRRLASALVQHGVGCGDTVAVMLPNVPAMFEAHFGVPMIGAVLNTLNTRLDPEAIAFMLAHGEAKVLITDPEFASLVGPALERLDGPKPLVIDALDDEYPGSDRLGAIEYEEFLAAGDPEFAWSLPPDEWDAIALNYTSGTTGNPKGVVYHHRGAYLNAASNIISWGMPQHAVYLWTLPMFHCNGWCFPWTMAANAGINVCLRKIDVALIYELIRTHKVSHFCGAPIVHGMLINAPEGMRDGITHKVSALIAGAAPPAAIIEGMERIGFDITHVYGLTETYGPASVCAKHPSWDELPIDRRAERNGRQGVRYHMQEAIAVLDPETMVPVPADGETMGEIMFRGNLVMKGYLKNEKASDEAFAGGWFHTGDLAVMHPDGYVKIKDRSKDVIISGGENISSLEVEEALYRHPAVMTAAVVAKPDEKWGEVPAAYIEVKDGTAVTVDDIIAHCREHLARYKVPKHIEFCVLPKTSTGKIQKFVLREQAKSALAID

SEQ ID NO: 23918 - protein, 413 aa, Rickettsia tarasevichiae
DSEFAELKIRGKIFKLPILKASIGEDVIDISRVSSEADCFTYDPGFMSTASCRSTITYIDGDKGILRHRGYDIKDLAEKSDFLEVAYLLIYGELPSSEQYNNFTKKVAVHSLMNERLHYLFQTFCNSSHPMAIMLAAVGSLSAFYPDLLKFKEADYELTAIRMIAKIPTIAAMSYKYSIGQPFIYPDNSLDFTENFLRMMFATPCTKYEVNPVIKNALNKIFILHADHEQNASTSTVRIAGSSGANPFACISTGIASLWGPAHGGANEAVINMLKEIGSSENIPKYIAKAKDKDDPFRLMGFGHRVYKNYDPRAAVLKETCKEVLKELGQLENNPLLQIAIELEASALKDEYFIERKLYPNVDFYSGIIYKAMGIPSQMFTVLFAIARTVGWMAQWKEMHEDPEQKISRPRQL

SEQ ID NO: 23919 - protein, 599 aa, Porphyromonas gingivalis W83
MQDIRNIAIIAHVDHGKTTLVDKMLLAGKLFRDDKAAEVDTFLDSNDLERERGITILSKNVSIRYKGCKINIIDTPGHADFGGEVERVLNMADGCLLLVDAFEGPMPQTRFVLQKAIEMGLKPIVVINKVDKLNCRPSEVQDMVFDLMYSLDASEDQLDFPTIYGSAKQGWMSTDYKHPTQDIAPLLDAIIRHIPAPEQPEGATQMLITSLDYTSYVGRIAVGRVHRGTLREGQDIMLCKRDGTMQKQRIKELNTFEGLGRAKADHVDAGDICAIIGLESFEIGETIADANAPEALQAIAIDEPTMSMLFTINNSPFYGKEGKYVTSRHIHDRLMRELDKNLALRVETTDNADSWLVFGRGVLHLSVLIETMRREGYELQVGQPQVIIKEIDGERCEPIELLSINLPEESSSRIIDIVTRRKGEMVMMENKNDRVFMEFHIPSRGIIGLNNAVLTASAGEAVIAHRFLEFQPWKGEIERRSNGSIIALESGTAYAYALNNLQSRGRFFISPQEEVYAGQVVGEHTKEGDLCVNVCKSKKLTNMRASGSDDKVSLAPPVVFSLEDALEYIKYDEYVEVTPKSMRMRKIILDETERKRQGR

SEQ ID NO: 23920 - protein, 456 aa, Glycine max
MDPCPFSRLTVRNLALKIPVASKPARSVVHPSSSPCFCKIQLKNFPLQSAVVPFIPPDSLFPDSLVHPIAATFHLSKSDLDKLAGKSIFSAKLCLKISIYTGRRGSTCGVSSGRLLGRVSVPLDLTGTVAKTTVFHNGWIRIGKDAKGSSAQFHLNVKAEPDPRFVFQFDGEPECSPQVFQIQGNISQPVFTCKFSFRNNGDRNHRSRSLQSEPGGSRSWLSSFGSERERPGKERKGWSITVHDLSGSPVAAASMVTPFVASPGSDRVSCSNPGSWLILRPSDGTWKPWGRLEAWRERGGSDGLGYRFELIPDTNGGMSAAGIVLAESTLSNNKGGKFVIDLSCRNGNGSGNGGSNGRATPGSATSPACSPRSSGDYGYGLWPYCMYRGFVMSASVEGEGRCSKPTVEVSVPHVNCTEDAAAFVALAAAVDLSVDACRLFSQRLRKELCQQLDLIG

SEQ ID NO: 23921 - protein, 469 aa, Gibberella zeae PH-1
MAPVTKETDYLVIGGGSGGLASARMASNKFGIKATIVENKRLGGTCVNVGCVPKKVTYNAAALAEAIHDSKAYGFSVQETAPFDWSTFKTKRDAYIKRLNGIYERNLNNDKVDYVHGWARLTSKNQAEVTLDDNSKVLINAKKILVAVGGKPTIPPEIPGSEYGTNSDGFFDISTQPKKVAIVGAGYIAVEFAGMFNALGTETHLFIRHDTFLRNFDPMIQEAVTKEYERLGVKLHKRSQASKIEKDSNGKLTVTYKDDQGNESVVSDVDNLIWAIGRTPETKGIGLEEAGVKLAKSGHIIVDEYQNTDVDSIYALGDVTGEVELTPVAIAAGRRLAHRLFGGAEFSTLKLDYSNIPSVVFSHPEVGSIGLTEPEAIEKYGKDNIKVYKTSFTAMYYAMMEPEQKGPTNYKLITTGPEEKVVGLHIMGIGSGEMLQGFGVAIKMGATKADFDSCVAIHPTSAEEIVTLK

SEQ ID NO: 23922 - protein, 212 aa, Prochlorococcus marinus str. MIT 9312
MRIKTKNEALNIVETSYLASLSSLLWVALYYLPIGGALLRLILPLPMILLHLRRGTKTALEGLLIQFLLLFIIMGPVRGTLFLFPYGILAFWLGWCWFKEKSWRLSLTIGVIIGTLGFFLRVIALSTLVGDNLWLLITRASFGLIEKFIGLFNLPFSPSILSIQLVAILLIIFQEIVYVLTVYIVAYSLFPRLKLTIPDPPRLLNTLVDLNH

SEQ ID NO: 23923 - protein, 356 aa, Streptomyces sp. FR-008
MDYVDVAVIGGGQSGLAAAHALRQRGLVPVVLEASGQAAGSWPGYYDSLTLFSPARFSSLPGLPFGGDGDRYPHRDEVVDYLTRYADRLDAEIRTHTRVESVESDGAGFVVHTVDGRLGAAGIVAASGAFGNPLLPGLPGRQGFAGEVLHVADYRSPEPYAGKRVVVVGGGNSAVQVSYELAEVAEVTLATRTPIRFLAQIRDGKDLHHWLTDTGFDHLPPHWLIHYVGGTLVLDTGRYQDALESGRLQRRPMFTALDGDEVIWDDGSRERADVVLLATGYRPHLDYLAKLGALDEQGAPRHAGGLSLTHPGLVYLGLEFQRSFASNTLRGVGRDAAYVIDPLAAHVRKTPAAAGL

SEQ ID NO: 23924 - protein, 330 aa, Bradyrhizobium sp. BTAi1
MADEHRSSISRRRMAGCTATLAAASLTSAAATERDGMAGDSRAPQRLIDPTNNYPRPPFERQSQPWPGLASKMSPRPDHGETSYKGSERLAGRKALITGGDSGMGRAAAIAYAREGADVAINYYPTEEADAQEVIGLITALPGDLRDERFCQQLVQQAVEALGGLDIIVSNAARQQARQSILDVSSEDFDATMKTNIYAPFWIIKAALPHLKPGSAIIGTSSEQAYDPSPDLYDYAQTKAATMNYVKSLAKQLGPKGIRVNAVAPGPIWTPLQVSGGATMEKLEKFGGHTPLGRPGQPAELASIYVQLAAADASYANGQVYGASGGSGQP

SEQ ID NO: 23925 - protein, 548 aa, Daucus carota subsp. sativus
MPYHSISSLSLLPIPIRQNLSKHHPPFHQPPHSLPLSIKSSLDNKPPKSNQGSWVSPDWLTSLTKSITLSKDDSNIPIASAKLEDVSELLGGALFLPLFKWMNMYGPIYRLAAGPRDFVVVSDPAIAKHVLRNYGKYAKGLVAEVSEFLFGSGFAIAEGPLWTARRRAVVPSLHKKYLSVMVDRVFCKCAERLVEKLEISALNGSAVNMEEQFSQLTLDVIGLSVFNYNFDSLNADSPVIEAVYTALKEAEARSTDILPYWKIEALCKIIPRQVKAEKAVTVIRTTVEELIEKCKKIVDTEGERISEEEYVNEADPSILRFLLASREEVSSTQLRDDLLSMLVAGHETTGSVLTWTSYLLSKNPSSLVKAQAEVDRVLEGRPPTYDDIKNLKYLTRCINESMRLYPHPPVLIRRAEVADELPGSYKVNPGQDIMISVYNIHHSSKVWDRAEEFIPERFDLDGPVPNESNTDYRFIPFSGGPRKCVGDQFALLEAIVSLAIFLQHLSFELIPDQVINMTTGATIHTTNGLYMKVSKRQIKSAAVSSISR

SEQ ID NO: 23926 - protein, 356 aa, Streptomyces sp. FR-008
MNQHADVVVVGGGQAGLAAGYYLRRQGGLDFVVLDADPVPGGSWQHMWDSLHLFSPAEHSSLPGRLMPAQAGETYPDARHVVDYLTDYEKRYDLPVQHGTRVDAVRRDAGRLLVEADTGTWRARAVISATGSWSRPFLPAVPGREVFTGRQLHTVNYRSPADFTGQRVIVVGGGNSGAQVAADLALDGRVELTWVTQRPPRFLADDIDGRALFDVATARRRALEEGRSDTGGVASLGDIVAVPPVRQARDAGLLKASPMFVRLEGDGVVWADGTRAEADAVVWCTGFRPALSHLAPLGLRGTRGHIPTAGTRAVDEPRLHLLGYGDWTGPASATLIGVGRPARDAAREIADLLASR

SEQ ID NO: 23927 - protein, 251 aa, Porphyromonas gingivalis W83
MRKNIVAGNWKMNKTLQEGLALAKELDAALKGRTINCDVIIGTPFIHLASIAAAIDTTRIGVAAENCADKESGAYTGEVSAAMVASTGARYVIIGHSERRAYYHETSPILMEKVKLALSNGLTPIFCVGEVLEEREAGKHFEVVARQVEEALFTLDQTDFAKLILAYEPVWAIGTGKTATADQAQEMHAHIRKSIAAKYGKEVANGCSILYGGSCNAANAKELFSRADVDGGLIGGASLSVDKFLPIIEAF

SEQ ID NO: 23928 - protein, 311 aa, uncultured archaeon
  misc_feature (1)..(1): Xaa can be any naturally occurring amino acid
  misc_feature (187)..(187): Xaa can be any naturally occurring amino acid
  misc_feature (211)..(211): Xaa can be any naturally occurring amino acid
  misc_feature (264)..(264): Xaa can be any naturally occurring amino acid
  misc_feature (279)..(279): Xaa can be any naturally occurring amino acid
  unsure (1)..(311): unsure at all Xaa locations
XPLDPQIKPILERIRALSIAASPQELRRQVEEQSRLLTAAVQEPIAETRDVHIPVSGGSIRARVYFPKKAAGLPAVLYYHGGGFVFGSIETHDHICRRLSRLSDSVVVSVDYRLAPEYKFPTAVEDAYAALKWVADRADELGVDPDRIAVAGDSAGGNLAAVVSILDRNSGEKLVKKQVLIYPVVNXTGVPTASLVEFGVAETTSLPIELXVWFGRQYLKRPEEAYDFKASPLLADLGGLPPALVVTAEYDPLRDEGELYAYKXKASGSRAVAVRFAGXVHGFVSFYPFVDAGREALDLAAASIRSGLQPS

SEQ ID NO: 23929 - protein, 205 aa, Listeria monocytogenes str. 4b H7858
MVVGLGTGSTVYYTIEKLGEMVNNGLHITGVATSEETSKQAQNLGIPLKSLNDVAEIDITIDGADEIDTDFQGIKGGGGALLREKMVASASLKNIWVVSEEKLVRNLGKFPLPIEVIPFGWKQIERTLEKEHVQTILRRQSSGEIYVTNNGNYILDIVNQTFRDAEMWQEKLAQIPGIVEHGLFLHYVDIIVCAKANGEIELIKK

SEQ ID NO: 23930 - protein, 114 aa, Bacillus cereus ATCC 14579
MQQLIAEITKGQLKTDLPSFRPGDTLRVHVKVVEGTRERIQLFEGVVIKRRGGGISETFTVRKISYGVGVERTFPVHTPRIAKIEVLRRGKVRRAKLYYLRNLRGKKARIKEIR

SEQ ID NO: 23931 - protein, 331 aa, Pseudomonas fluorescens Pf-5
MAAPARFRRARAKPDDRSAVHSSPHLANENSSMPTPQVETVKLDELNCWRIRHGDAELLVAQQGAHILSYQVAGQQPLIWLNDEAVFKRGKSIRAGVPVCWPWFGNFARNPQAVQAMRQGTDPAPAHGLVRATDWELLGIESQGDSLLVELRLPCPAGGFPGWPHQVEPRLSIRLDQQLHISLSSHNLGTESVSISQALHSYFAVSDVRQVQVEGVDGLSYIETLEDWKTKVQSGSLHFTGETDRIYLNAPTQLEIVDPDWQRRIRLRSEGSRTAVIWNPWIDRAAQFSDMADDGWQRMLCIETANVMDDIVTLAPGASHTLSVSISAAPL

SEQ ID NO: 23932 - protein, 511 aa, Trichodesmium erythraeum IMS101
MNNIKEKFIVTAAQMRQIEERIFIAGMPVAALMEKVAGLVTRKISELLNSNISKIGVLVGPGHNGGDALVIARELYFQGYEIIVYCPFVNLKELTNAHAKYLQYLGVNFVKNISLLKNCALLIDGLFGFGLEREISGDLAESISQINSWQKQVFSIDLPSGIHTDTGEVLGTSICATYTFCLGLWKQAFLQDKALKYFGKSELIDFDIPLADITEVLGEFPTIERITKTSALENLPLPRPPATYKYTNGNLLLIVGSHRYSGAAVLTGLGSRVTGVGMLSIAVPKSIKPILNSHLPEALIIGCPETETGTIKQLPEDIDLSKFEAIACGPGLTIEPTSIIEKVLSVNCPLVLDADALNICGNLANNSLVSQRQAPTIITPHPGEFKRLFPHLVDQLNNRILAAEKATKNSNVIIVLKGAKTIIANSQKILINPESTPALARGGSGDVLTGLVGGLLAINSTQTLPFNAVKTAVWWHAQAAILAVKERTELGVDAFTLTQYLIPALKKYNFC

SEQ ID NO: 23933 - protein, 421 aa, Aeropyrum pernix K1
MGSSSGQKPRRLEDLVDKLASGSLSHSRLEKELGNANEAALVRRLYLERLTGASLSSVASTILDFQELYGRNIENPIGAVQVPVGVAGPLRINGDYARGDFYIPLATTEGALVASVNRGAKAITLSGGARAKVIKDGMTRAPLLWTPSVYEAHRLAMWVEDRIEDLRSVVAGVTRHGRLQHIYPYIIGNLVWLRLSFSTGDAMGMNMVTISSDRICRYIEENYDGDAKCIALSGNMCTDKKPAAINKILGRGKYVVAEAVIKGEVVKNVLKTTPQNINLVNVTKNLLGSAAAGSHSFNAHFANIIAAIFIATGQDAAQVVESSMGYTWTEVRGEDLYISVTLPSLEVGTVGGGTRLPTQRELLALLGVAGGGNPPGSNALKLAEIIASAVLAGELNLLSAIAAGQLARAHELLGRGGLKIS

SEQ ID NO: 23934 - protein, 249 aa, Arabidopsis thaliana
MVSNIDHKAMEALLRGQGCANNLKILLENGEISSVSTEPLIHTILDSFSLALSFMDSPNHPPYHESSSHNMASHMSRRSSKQKLCVAEGLVNYNHDSRTMCPNDGFTWRKYGQKTIKASAHKRCYYRCTYAKDQNCNATKRVQKIKDNPPVYRTTYLGKHVCKAFAVHDDTYSSTMIRFDQVVPEPIMPQLTTIDHQVITVEENSAEHIMNQECDINDYLVDDDPFWASQFPPFPSSDTMFLENISAFD

SEQ ID NO: 23935 - protein, 836 aa, Ostreococcus tauri
MYVDGASTTRRTAFRDAEKRYQLKLVEQFRVSANGKRRGGRFVAEPTDLSDVLDFSVDDERSSRRSLVSTSGTTETYAIDGHPGFYYVKNALSAEEQRTWVRAAVSELCEPPARTNFAKELGELPSGLWNAVQEDLMLFDGAWARPGREVKRGDAEERFFARHLLKKLRWATVGAPFEWTSRVYEPDVPRRAISDDLVELTRRIARAAPEKWTFDAQAGLVNYYQPGDTLNGHMDDAENNLDRPIVSISLGCPAVFLLGHENRDKSPTAMILRSGDAVILGGESRKCYHGVPRVFASDESLEFELPTCLRAEAWDDDAYASFRTDEIEQTGRDERVERKPNRTFSSDSSSGISGSPGIGLGIGILGSFRSGKMSGRLDGTARTYSSGKSNTEPSSSSTFGSGAFLNASTTTISPLRPAPSTLALDARTRTARCRPRSENLKEPWFPVVSRVATPFTRVFTVVRAFIPASVAVVVVTPSTGVTPRRASMAKFGEGDERWIVDERADGANVHGWHWEEKDALPWSRERLGALCGGAEAKKDALLQAFPEVSFVKCVGLTKCEGEAYVNKRKGKIIPGYELEVEIAYEGECRGKACGGKVKMPYVADENADEDPECVAAPASDSTEDSIVREAVLKTLVPIILEGVRTFVKEMAKGGPGGDAPVSAEAAAKAEAAKAADAAKKAAAKENTRSDKAAPLSQKNHTIKITENFYCRPRDICEALMDGSRVMHFTRSRCSGLNGSTGKFDMFDGNIQGETIDYVPGEKIVQKWRFNSWPDDHYSTVTITFREPDPGNCWVDLVQTDVPECDKFGNETVMDTTENGWKNLIFARIRQVFGYGA

SEQ ID NO: 23936 - protein, 445 aa, Methanocaldococcus jannaschii DSM 2661
MVNSSPLWKKLMRKCKGENMALKMDKSKELFEEAKKYLVGGVNSPVRYFKPYPFFVEKAKDCYLFDVDGNCYIDYCLAYGPMVLGHANDAVIKAVKEQLELGSAYGCPTEKEIILAKEVVKRVPCAEMVRFVNSGTEATMSAIRLARGVTGRKKIIKFDGAYHGAHDYVLVKSGSGALTHGHPNSPGIPEETTKNTILIPFNDEDAVKKAINENKDEIACIIVEPIMGNVGCILPKEGYLEFLREITEENDILLIFDEVITGFRLAKGGAQEYFGVVPDIATLGKILGGGFPIGAIVGRRELMEQFSPLGAIYQAGTFNGNPISITAGIATLKQLDDRFYKETARTAKILADTLRELADKHNIKAKVYNIASMFQIYFNDKEVVNYEIAKQSDTEKFMKYFWRLLEKGVFVPPSQFECCFTSIKHDDEVVDKTIKAMEDVFEGLE

SEQ ID NO: 23937 - protein, 661 aa, Streptococcus agalactiae A909
MTFDAVDQLAVNTVRTLSMDAIQAANSGHPGLPMGAAPMAYVLWNKYMNINPKTSRNWTNRDRFILSAGHGSAMLYSLLHLAGYDLSIDDLKNFRQWGSKTPGHPEVNHTDGVEATTGPLGQGIANAVGMAMAEAHLAAKYNKPGFNIVDHYTFALNGDGDLMEGVSQEVASLAGHLKLGKLITLYDSNDISLDGPTSMAFTEDVKGRFEAYGWQHILVKDGNDLDAIAKAIEEAKAETEKPTIIEVKTIIVFGSEKQGTSAVHGAPLGAEGIVFTKNAYKWTYEDFIVPDEVKARFQEGLQARGEQAENAWNELFAKYEAEYPELAKGYKEVFSNEPVSVELAAHELGSSKASRVSSQEAIQQISEQVASFWGGSADLSASNNTMVKVEKDFQPGQYEGCNIWFGVREFAMAAAMNGIALHGGTRVYGGTFFVFSNYLLPAVRMAALQSLPTMYVMTHDSIAVGEDGPTHEPIEQLASVRSMPNLNVIRPADGNETNAAWKHALAEIDKPTMLVLTRQNLPVLEGTKELAEEGLNKGAYILSEAKGEMDGIIIATGSEVKLAMDTQAALAEEGIHVRVVSMPSQNIFDAQSDAYKEEILPATITKRLAIEAASSFGWAKYVGLAGKTLTIDTWGASAPGNRIFEEYGFTTENATVLYKAL

SEQ ID NO: 23938 - protein, 226 aa, Oryza sativa (japonica cultivar-group)
MDSEHWISRLAAAKRFYAAQLGHADRAGMEEVDMDEEVRPEFACPYCYEDHDVVSLCAHLEEEHPFEPHAAPCPICSDKIAKDMLNHITVQHGYLFKNRRRLRRFVIPGSQALSLLSRDLREAHLQVLLGGGGHRSNNSSNTTNISADPLLSSFGLSFPTSDTEETSKPPISIPDDASVIKETPAQPWDSSIDSSLTREEREQKRKQASVRATFVQDLLLTTLFGD

SEQ ID NO: 23939 - protein, 142 aa, Synechocystis sp. PCC 6803
MNTFLASPKALAGYTAHTYNRAQRAFQCCPFYLNLFRAMAQASVPLPTIAGAGGVEQGFCGQALTENRVERELMWLIQVGLLRREVDGQGITDSFRLTPLAKQILAQYPGEQRQFPSPSLLDRLQNRLARWLAPLATLLVRG

SEQ ID NO: 23940 - protein, 354 aa, Synechocystis sp. PCC 6803
MTGSFFCYLFPRSFSMLKIGINGFGRIGRLVARIAMANPQVTLVGINDLVPASNLAYLFKYDSTHGSYGGTVVAKEEGIVIDDQFIPCFSQRDPAQLPWGDLGADYVVESTGLFTTYATAENHLKAGAKRVIISAPSKDPEKIPTFVVGVNHLNYNADTDKIVSNASCTTNCLAPIAKILDDNFGIVEGLMTTVHAMTATQPTVDGPSKKDFRGGRGAAQNIIPSSTGAAKAAALVLPQLKGKLTGMAFRVPTPNVSVVDLTFKTEKATSYEEICAAMKTAAEGELKGILGYTADDVVSMDFRTDPRSSIFDAGAGIGLNSNFFKVVSWYDNEWGYSCRVIDLMLTMASKDGLV

SEQ ID NO: 23941 - protein, 641 aa, Brassica napus
MSSSWADVSEPERPPPSGWGGGGYGDSRPSRTNYVPPHLRSRPPSSDFAAPSHGNERGGYGGRVGRGSGYVGRGGGGGGGWNNRSGGWDRRDTETNPFGNDVNAEPAAVNEQENNTGINFEAYEDIPIETSGDNVPPPVNTFAEIDLGEALNLNIQRCKYVKPTPVQRNAIPILAAGRDLMACAQTGSGKTAAFCFPIISGIMKEQQHVERPRGVRGVYPLAVILSPTRELACQIHEEARKFSYQTGVKVVVAYGGTPVNQQIRELERGVDILVATPGRLNDLLERGRVSLQMVKYLALDEADRMLDMGFEPQIRKIVQQMDMPPPGVRQTMLFSATFPREIQRLASDFLSNYIFLAVGRVGSSTDLIVQRVEFVHDSDKRSHLMDLLHAQRENGNQGKQALTLVFVETKKGADSLENWLCMNGFPATTIHGDRSQQEREVALRSFKTGRTPILVATDVAARGLDIPHVAHVVNFDLPNDIDDYVHRIGRTGRAGNSGLATAFFNDNNTSMAKPLAELMQEANQEVPDWLSRYASRASFGGGKNRRSGGRFGGRDFRRESFGQGGGGGGGYYGGGGGGYGAVPGGGYGAMPGGYGNVPGGGYGAVPGGYVPYGRGGGAYYGGGYGTVPNQGYGPGVASAWD

SEQ ID NO: 23942 - protein, 380 aa, Gloeobacter violaceus PCC 7421
MSGEYVPGLEGVPATRSNISFVDGKAGVLEYRGIPIDQLAESSTFLETAFLLIFDHLPTKDELLSFEVEILGHRRVKYRIRDMIKSFPESGRPMVALQSCIAALGLFYPLQNESKEKYAYDSTIRLLAKMPTMVATFHQMRLGNDPIPPRDDLGHAANFLYMLTGKEPDPRAARIFDVCLMLHAEHTVNASTFSALVTASTLADPYTVITSAAGTLSGPLHGGANEEVIRMLKEIGTIERVRPYLENRLARKEKIMGVGHRVYKVKDPRATILQNLAQELFDRFGHSRLYDIAVEVERVCDELLGQKGIYPNVDFYSGLVYEKMGIPADMFTPVFAISRVAGWLAHWHEQLADNRIFRPTQVYTGSHNVEFTPLSLRSYA

SEQ ID NO: 23943 - protein, 356 aa, Oryza sativa (japonica cultivar-group)
MKTTYGLENLFSKASSNGAIGMDIHPPGGFLSMLQTGQQPLVPPHVLFPATWPPMPPMAPATNSGTTHARSRSKAKPVINLDDGDNVRTAKRLTWASDEDLRLVSAWLYHSNDPINGNGKKNESYRGDVVELYNNTTPINRKREVKHLKDQWQRIKRWVGFFCASWKKAALVYTSGYSDDQLRDFANQFYVNDYPNEGPFTVLHYWKVLHDEPKWHAVLEELEKPHKRSLDDGSDTLSQKDIGEKERPMGRNEAKKQRNGKGKGKGKDDDDSLHEDMKKYMDVQAAASKRHEEFLGTQHRISDAKVEVARLRREAVLTESYQKLMSMDTSQMTNEMKAEHVMGLKMLREKLLGDII

SEQ ID NO: 23944 - protein, 479 aa, Zea mays
  misc_feature (340)..(340): Xaa can be any naturally occurring amino acid
  unsure (1)..(479): unsure at all Xaa locations
MVKPPPPPPTSTCTSDTPLPTPGGLLGSLSSSAHSLLAAARRSPVTTLVAAFFLLALFMYGEDVRTIAELSIDDYLYPDADFYNVSALPPLALPPATCDLSRGRWVFDNVSLPAYREKDCTFLTKQVTCLANGRPDDLWQYWKWQPNECSLPTFDARRFMEAMRGKRLMFVGDSLNRNQWESLVCLVQPILSKGRKKIVKRGSLTVFHAKEYRATLEFYWAPFLVESNSDNPKIHSIEHRIIRPERIEGHAKYWRGVDYLIFNTYIWWMNTADMKVRRPNSRYWSEHDEVPRIEAYGLVFKTWSDWLNDNIDPDRTLVFFMTISPLHIRRCVINMVYENXSPHNWGDPGRGSGCVEGDAFRTRTTASRWDLYHDMRMHDLVVKVASAMAKVPVTVINITRMSDYRKDAHTGLYSIRQGKLLTPEQKGDPEKFADCIHWCLPGVPDVWNQILYTRILSKPPSWGSSNVSPLSPSQSLPPR

SEQ ID NO: 23945 - protein, 513 aa, Bacillus subtilis
MTKLVNEMILVLDFGSQYNQLITRRIREFGVYSELHPHTLTAEEIKKMNPKGIILSGGPNSVYDENSFRCDEKIFELDIPVLGICYGMQLMTHYLGGKVEAATQREYGKANIRIEGTPDLFRDLPNEQVVWMSHGDLVVEVPEGFTVDAATSHHCPNSAMSKGDKKWHGVQFHPEVRHSEYGNDLLKNFVFGVCESEGEWSMENFIEIEMQKIREQVGDKQVLCGLSGGVDSSVVAVLIHKAIGDQLTCIFVDHGLLRKGEREGVMKTFSEGFNMNVIKVDAKDRFLNKLKGVSDPEQKRKIIGNEFIYVFDDEADKLKGIDYLAQGTLYTDIIESGTATAQTIKSHHNVGGLPEDMQFELIEPLNTLFKDEVRALGTELGIPDEIVWRQPFPGPGLGIRVLGEVTEEKLEIVRESDAILREEIANHGLERDIWQYFTVLPDIRSVGVMGDARTYDYTIESRRTSIDGMTSDWARIPWDVLEVISTRIVNEVKHINRVVYDITSKPPATIEWE

SEQ ID NO: 23946 - protein, 594 aa, Arabidopsis thaliana
MDRILKAARTSGSLNLSNRSLKDVPTEVYQCLETTGEGENWWEAVDLQKLILAHNDIEVLREDLKNLACLVVLNVSHNKLSQLPAAIGELTAMKSLDVSFNSISELPEQIGSAISLVKLDCSSNRLKELPDSIGRCLDLSDLKATNNQISSLPEDMVNCSKLSKLDVEGNKLTALSENHIASWTMLAELNACKNMLGVLPQNIGSLSRLIRLDLHQNKISSVPPSIGGCSSLVEFYLGINSLSTLPAEIGDLSRLGTLDLRSNQLKEYPVGACKLKLSYLDLSNNSLTGLHPELGNMTTLRKLVLVGNPLRTLRSSLVNGPTAALLKYLRSRLSNSEETSASTPTKENVIASAARMSISSKELSLEGLNLSDVPSEVWESGEITKVNLSKNSIEELPAQLSTSVSLQTLILSRNKIKDWPGAILKSLPNLMCLKLDNNPLNQIPLDGFQVVSGLQILDLSVNAVSFREHPKFCHLPQLRELYLRYRIPYTSLDSRIQLSEVPEDILNLSNLIILDLNQNSLQSIPKGIKNMTSLKHLDISNNNISSLPPELGLLEPTLEVLRLDGNPLRSIRRPILERGTKAVLNYLKDRLPDQ

SEQ ID NO: 23947 - protein, 231 aa, Zea mays
MCPTKKGMTGEPSSPCSSASASTLPEHHQTVWTSPPKRPAGRTKFRETRHPVFRGVRRRGSAGRWVCEVRVPGRRGCRLWLGTFDTAEAAARAHDAAMLALAGAGACCLNFADSAWLLAVPASCASLAEVRHAVADAVDDFLRHQLVPEDDALAATPSSPSSEDGNTSDGGESSSDSSPPTGASPFEFDVFNDMSWDLHYASLAQGLLVEPPSAVTAFMDEGFADVPLWSY

SEQ ID NO: 23948 - protein, 249 aa, Prochlorococcus marinus str. MIT 9312
MSNTALLSGKVALITGASRGIGKEIALELSRLGAEVFINYSSSDEKAEEVINSIKNSGGKAHKLKFDVSKEDSVSSAFEEIIKINGSIDILINNAGITRDGLLMRMKSEQWDDVLNTNLKGVFLCTKYASKFMMKKRSGSIVNISSVVGIIGNPGQANYSAAKAGVIGFTKTCAKEFASRGINVNAIAPGFIETEMTEKLNTEEILKVIPLGKLGSCTQIANLVSFLVSSNAGSYITGQTISIDGGMSI

SEQ ID NO: 23949 - protein, 129 aa, Zea mays
  misc_feature (72)..(72): Xaa can be any naturally occurring amino acid
  unsure (1)..(129): unsure at all Xaa locations
MAMSWTRALKHGVITRDAAQLVGIRGFAAQAKGKKGGKGGAADAKPVLSKEMKSTTVFGANILKEGSDPKIXPDSEYPDWLWHLVDKRPVLSELRRKDAKTLPYEDLKRFVKLDNRARIKENNALTAKN

SEQ ID NO: 23950 - protein, 611 aa, Oryza sativa (japonica cultivar-group)
MAPLRGAKRRRKAAAEKKAAMAAAAAAGGAPGAGGGDWWDGFCMRMSGTLSGIQDAQRFEFIFKMPRRTFNYICGLVRDEMMVRSSSYTFLDGKVLSLEDRVAVALIRLNSGGSLVTVGSAVGVNHSTVSLITWRFVEAMEERASHHLRWPDSSEVEKIKSMFEKIHGLPNCCGVVDTTHITMCLSSAEPNCKVWLDHEKNYSMVLQAVISPDMRFMDIVTGWPGSMKESSILHSSGLFKMCEKGARLNGSKMVVSDGSEIGEYIIGDAGYPLLPWLLTPYQEKDLSDSKLEFNKRHAAAITVAPSTLANFKDTWKFLHGEMWRPDKHRLPRIIHVCCMLHNIIICLQDATIDEAAMSNDHDANYKQQVCQLADENAVRVRDKLSEHLVSRLTVRLREYMRSDRLGFSQTDPRRSDRQPNIPRLPTTACALMRRKKTHRTKLSLEKLRLPSLLYRSIFIGKDLLCKVVSQLTLKEAGKTSILSSRWKDRWTYHSNLCFDHSEFPRYTADRFINYVNHVLQQHSFLAVDRFEIRFPLQKQQTKHVDSWVAFASASRAKHFVLDLSPAVHTNHQSEEHMYVFPVDLLDGQNGSPIISLRLGLVCLKLPSDFLA

SEQ ID NO: 23951 - protein, 315 aa, Arabidopsis thaliana
  misc_feature (31)..(31): Xaa can be any naturally occurring amino acid
  unsure (1)..(315): unsure at all Xaa locations
GIVVHSCSSCRISWDSLSPLSLASRFMDLLXSQQESHNNETNQYEVGSSEIPVFGTQRCQESHEERYASRVAIARKKWAAKEDIVLISAWLNTSKDPVVGNEQKAPAFWKRIASYVAASPDLDGVPKRASAQCKQRWAKMNELVMKFVGCYATTTNQKASGQTENDVMLFANELFENDMKKKFSLDHAWRLLRHDQKWLISNAPKGKGIAKRRKVRVGTQAASSQPIDLEDDDVMRRPPGVKAAKAKAKMTPTVKGEEVNSVEHLTSLWDLKERDWDRKDKQSKNQMLESLLSRTEPLSECDLVLKKKLIEELFS

SEQ ID NO: 23952 - protein, 260 aa, Prochlorococcus marinus str. MIT 9312
MSSQKIFLFDFDGVIVDGMQEYWHSSLLACERYLNSPYISIDQKLYEKVPNSFKEIRPWVKYGWEMILIVHEIIKTENPLKNDNKDDFMNNYHQNCQRILNENSWIAEDLQKMLDKSRKYQIDKDFKSWVNLHNPFFEIINFMKELRKREIKIGVITTKSKIFAEKILKQLNIFPEFIFGYESGTKIKITEKLTQTYEILGFIEDRKKTLIDIKQNSETSHIPCFLADWGYLKGTDRDTLSNEIKLLKLGNLEELVAFKR

SEQ ID NO: 23953 - protein, 285 aa, Oryza sativa
MLRYNATPKASPPMSPLRPPPTPRTPLGGAATTPDQLPPPSPHTPRPAITLTAPPSKKKRRGGAAARSLRAIRAVRALFRSLPILAPACRFHGAIRAPGGASRAHDGHVSGASRTTGTLFGYRKARVTLAVQETPGSVPILLLELAMQTGRFMQEMGAEHLRVALECEKKPPGAGAGIGRTRLLDEPLWTAYVNGRKIGYAMRREPTEGDLTVMQLLRTVSVGAGVLPTDVMGGDAGAEVQDAGDLAYMRARFDRVVGSRDSESFYMLNPDGNNGPELSIFFIRI

SEQ ID NO: 23954 - protein, 161 aa, Ostreococcus tauri
MDNPSPKVYVTRARTTGAASRGARGREESREDGRDAFDAREIFEHVRDINDPEHPHSLEALGVVREGDIAVDDSKNRVKVEFTPTVPHCSMATLIGLSIRVRLLRTLPRRFKVDVLIAPGTHTSEKAVNKQLNDKERVAAALENANLLEKVDLCLSGKTAI

SEQ ID NO: 23955 - protein, 175 aa, Nicotiana tabacum
MGSKMSDPLVIGRVIGEVVDYFTPSVKMSVTYNSSKHVYNGHELFPSSVTSKPRVEVHGGDLRSFFTLIMIDPDVPGPSDPYLREHLHWIVTDIPGTTDCSFGREIVGYEMPRPNIGIHRFVFLLFKQKKRQTLLSAPLSRDRFNTRKFSEENELGSPVAAAFFNCQRETAARRR

SEQ ID NO: 23956 - protein, 225 aa, Prochlorococcus marinus str. MIT 9211
MKKLIKDNTSTLSTSVAREQSIRLVETAYLAAATALIWIALYYLPVGGAFFRLALPLPLALLQVRRGHQAGLEGVSLLIMLLIVLMGPIRGPLVLFPYGFLSLWLGWSWCRKLSWWLSWSVGAFLGTIGFLIRVLFLSILVGENLWVVITRAASALLERIIDIFNLPLIPDMALIQLAALSLVVIQELIFVLTLHAVAFWVFPRLSASIPHPPRLLNGLIGWEPT

SEQ ID NO: 23957 - protein, 181 aa, Porphyromonas gingivalis W83
MKKTALVFLAPGFEETEAVGTLDILRRGGVVAEFVSITDSLYVEGANGITVKADRLMTDLPTVDALVLPGGLPGADNLNSCEPLRRLLSEHYAAQKLVAAICAAPLVFGGLGFVCGRKATCYPGFESKLEGADYTGEAATRDGHVITGKGPACVFAFAIEVVRYLCGDQVADEIATGTLFR

SEQ ID NO: 23958 - protein, 461 aa, Frankia sp. EAN1pec
MCRRPCRRPSARPVGRRRQPRPQRCAAWPRAPRAEAARHHVSVAEETTDQPPWVGRERDVTAGASGPAMRISGRAQTFTESVIRDMTRLALRHGAVNLAQGFPDFACPTELKEAAKAAIDADVNQYAITWGAADFRAAIAAKIGRTYPGWTVDPDTEICVTCGSTEAMIAAMLALVDPGEEVVFFEPFYENYGPDSILSGAVPRLVRLHGPDWSIDPAELRAACSDRTRAIVVNTPHNPTGKVFSADELALIAELCQRHDILVFTDEIYEHIHYLGPGGHIPPATVPGLEDRTVTVNALSKTYAVTGWRVGWTVAPAPYTEAIRKVHDFLTVGAAAPLQAAGVAAMGLPPEYYAGLAQEYRVRRDLLCGALENTGFALRPPDGAYYVMCDTTDLDPAGDDVAFARRLVSELGVAAVPGSSFYADPADGRRIVRFGFPKRLETLRAATDRLRLLERTRAAHP

SEQ ID NO: 23959 - protein, 760 aa, Petunia x hybrida
MLRTLASVLLISSFLVYLSAADDGFPRCNCEDDGFWSIESILECQRISDFFIAIAYFSIPIELVYFVSCSNFPFKWVLFQFIAFIVLCGMTHLLNFWTYYGQHTFQLMLSLTIFKVLTALVSFATAITLITLFPMLLKVKAREFMLTKKTWDLGREVGLIKKQKEAGLHVRMLTQEIRKSLDRHTILYTTLVELSKTLNLHNCAIWKPNENRTEMNLIHELKGRSFSSMYSLPIPTSDPDVKAIKGSDGVKLLDVDSPLAAASSGGSSQPGAVAAIRMPMLKVSNFKGGTPELVPECYAILVLVLPSEQGRSWSNQEIEIVRVVADQVAVALSHAAVLEESQHMRETLEEQNRALPQAKQDALKASQARNASQMVMSHGLRRPMHSILGLLSLLQDDKLGNEQQLLVDAMAKTSNVVSTLINDVIDTSTKDNGRFPLEMKHFQLHSMIKEAACLAKSLCAYRGYKISIEVDKSLPNHVMGDERRVFQVILHMVGNLLKDPNGGYLTFRVLAESASREDIEGAWRTRRSNSSRDNAYIRFEVGTRNIHSGITSTLPHCSQRRCSREVEESLSFAVCKKLVKLMQGDIWVIPNPDGFDQSMAVVLGFQLWPSISIGIPEYRELSDHSHPHLLLQGVKVLLADYDDVNRAVTRKLLEKLGCSVSAVSSGHDCLGALGPAASLFQIVLLDLHLPDLDGFEVTMRIRKYRSRSWPLIVGLTASADEDVSGRCVQIGMNGIIRKPVLLPGIADELQRILLQATRIM

SEQ ID NO: 23960 - protein, 516 aa, Gloeobacter violaceus PCC 7421
MTQGFALTTPLFYVNALPHIGSAYPTLAADAVARYHRLRGRSVRFVTGTDEYGLKIERQAAERHLTPREHCNEIAAGFEKLWRALSIDYDRFIRTTDPRHAAIVREFFERCWQAGDIYKGRYTGLYCIDCEEFKKKPDEDYFIENGEPRCKIHLKPLREQDEENYIFALSRYQQKLEQYFDEHPEFVQPDFRAHEVRNFIAGGLEDFSISRANVSWGLPIPVDSSQTIYVWFNALLGYVTALLEPEDEPTLENALARWWPIDLHIVGKDILRFHAVYWPAMLMSAGLPLPGMIFGHGFLTRDGRKMGKALGNVIDPGVLVEQYGSDAVRYYFLKAIEFGRDNDFNETRFREILNADLANDLGNLLNRTGNMVVKYCGGVIPSVAIDPTDALRDKATGLAQVCAEHWEALRFSEASGLALALVRAGNRYLDARAPWSLYKKGEQVQVEQVLYAVLESVRIAAVLLSPLIPGLAAEIYRQLGFSVQAWEDRSWDDALWGGLPGGQPLCLGSPLFPRLE

SEQ ID NO: 23961 - protein, 325 aa, Thermobifida fusca YX
MVGSTTPNAPFGQMLTAMITPMLDNGEVDYDGVARLATYLVDEQRNDGLIVNGTTGESATTSDEEKERILRTVIDAVGDRATIVAGAGSNDTRHSIELARTAERAGADGLLLVTPYYNRPPQEGLLRHFTAIADATGLPIMLYDIPGRTGTPIDSETLVRLAEHPRIVANKDAKDDLGASSWVMSRTDLAYYSGSDMLNLPLLSIGAAGFVSVVGHVVGSELHDMIDAYRAGDVARALDIHRRLIPVYRGMFRTQGVITTKAVLAMFGLPAGVVRAPLLDASPELKELLREDLAMAGVKGPTGLASAHEDAASGREAERLTEGTA

SEQ ID NO: 23962 - protein, 110 aa, Emiliania huxleyi
MATTRAADAVKEKKSEEEEFHTGPLSVLTQSVKSNTQVLINCRNNKKLLGRVKAFDRHCNMVLENVKEMWTEVPKKGKGVKKAKPVNKDRFISKMFLRGDSVIIVLRNPK

SEQ ID NO: 23963 - protein, 379 aa, Glycine max
MDRLLSSSSPPSFTFLTRFESATARFNFSPSTRSHSHLKRLSSICCQHANPSPFSSSTPFLASSNHPINFPSFSSSSDPSTLESHSLNQIKTGAFPKPKVITARTLVILSALAMILIQPTIAPAAFATFQTAAKTGGPAAAAAVGRKLIHTELLSSAWTGFLAGCLHTLSGPDHLAALAPLSIGRTRMESAAVGALWGCGHDAGQVLFGLIFLILKDQLHIEIIRTWGTRVVGLTLLIIGAMGIREASEVHAPIVALESGECDVNVYESLDNPTVGKKKIGFATFATGIVHGLQPDALMMVLPALALPSRLAGAAFLIMFLIGTVIAMGSYTVFIGSCSQALKDRVPRITEKLTWVSSLIAIALGFAIIISQFFGFSLY

SEQ ID NO: 23964 - protein, 270 aa, Burkholderia sp. 383
MAGPGRVLLDAPQLPSLPTARSMYKLVLIRHGESTWNKENRFTGWVDVDLTEQGRNEAYQAGELLKEAGYTFDIAYTSVLKRAIRTLWHVQDKMDLMYLPVVHSWRLNERHYGALSGLNKAETAAKFGDDQVLVWRRSYDTPPPALEATDERAPFNDPRYAKVPREQLPLTECLKDTVARVLPLWNESIAPAVRAGKQVLIAAHGNSLRALIKYLDGISDSDIVGLNIPNGVPLVYELDENLKPIKHYYLGDQDAIAQAQAAVAKQGKAG

SEQ ID NO: 23965 - protein, 592 aa, Burkholderia sp. 383
MRVSFTLHGIPVSRGIAIGRAYLIAPAALDVAHYLVEANQIDAEVERFRTALEVVHHELEALRADLTDDTPSEVGAFIDVHAMILSDEMLVQETIDLIRTRRYNVEWALTEQLELLTRHFDDIEDEYLRERKADIEQVVERVLKALAGAPSASQALDRAARNGTNEMIVVAHDIAPADMMQFKSQSFQAFVTDLGGRTSHTAIVARSLGIPAAVGVQHASALIRQDDLIIVDGDQGIVIVDPAPIVLEEYSYRQSEKLLEQRKLQRLKFSPTQTLCGTKIELYANIELPDDAKAAVDAGAVGVGLFRSEFLFMHQKEMPEEEEQFAAYKRAVEWMKGMPVTIRTIDVGADKPLEALDEGYETAPNPALGLRAIRWSLSEPQMFLTQLRAILRASAFGQVKILIPMLAHAQEIDQTLDLIREAKRQLDDAGLAYDPNVRLGAMIEIPAAAIALPLFLKRFDFLSIGTNDLIQYTLAIDRADNAVAHLYDPLHPAVLHLIAYTLREAKRAGVSVSVCGEMAGDPALTRLLLGMGLTEFSMHPSQLLVVKQEILRAHLKALEKPTADVLAAFEPEEVQAALQRLSVAEPRADAAA

SEQ ID NO: 23966 - protein, 476 aa, Campylobacter coli RM2228
MGKFVNNVNEFFDFCKQNEVLFVDFRFTDMIGTWHHITYNLHAISEETFEAGIPFDGSSIHGWQPIEKSDMILKPDAQSAFLDPFTADPTIIVFCDVYDIYKGQMYEKCPRSIAKKAMEHLKNSGIADTAYFGPENEFFVFDSVKIVDTTHCSKYEVDTEEGEWNDDKDFADSYNTGHRPRNKGGYFPVQPIDSLVDIRSEMVQTLEKVGLKTFVHHHEVAQGQAEIGVNFGTLVEAADNVQIYKYIVKMVAHLNGKTATFMPKPLYGDNGNGMHVHMSLWKDGVNLFYDKEGYGGLSQTAINYIGGVLKNARSVAAFTNPSSNSYKRIVPGFEAPCILTYSCQNRSASCRVPYGIGKNSARVEIRFPDSTANPYLAFVSLLMAGLDGIKNKTIPVGPMDENLFDLTLDEIREKGIEQLPHTLRGSLEALIRYNAFLKPVMSDIFIDDYQHLKFETQVWPVEARPTAYEFKTCYSC

SEQ ID NO: 23967 - protein, 175 aa, Nicotiana tabacum
MGSKMSDPLVIGRVIGEVVDYFTPSVKMSVTYNSSKHVYNGHELFPSSVTSKPRVEVHGGDLRSFFTMIMIDPDVPGPSDPYLREHLHWIVTDIPGTTDCSFGKEIVGYEMPRPNIGIHRFVFLLFKQKKRQTVLTAPLSRDRFNTRKFAEENELGSPVAAVFFNCQRETAARRR

SEQ ID NO: 23968 - protein, 174 aa, Nicotiana tabacum
MASRVVEPLVVARVIGEVVDSFNPSVKLNVIYNGSKQVFNGHELMPAVIAAKPRVEIGGEDMRSAYTLIMTDPDVPGPSDPYLREHLHWIVTDIPGSTDSSFGREIVSYESPKPVIGIHRYVLLLYKQSGRQTVKPAATRDHFNTRRYTAENGLGSPVAAVYFNAQRETAARRR

SEQ ID NO: 23969 - protein, 367 aa, Ostreococcus tauri
  misc_feature (1)..(1): Xaa can be any naturally occurring amino acid
  misc_feature (367)..(367): Xaa can be any naturally occurring amino acid
  unsure (1)..(367): unsure at all Xaa locations
XSPNPSVDVPRASASLANPITTRGATNPTCVKSSLALTVALVPSPVRARASVVPIAPSTAPVPSRNSLAAASVTMGSATRAWGDETCDAATNWCARATTDRVFFDVDIGDARAGRIVLGLFGDDAPRTVANFKALATGEKGYGYEGSIFHRVIPNFMLQGGDFERGDGRGGRSIYGGKFADETFAIPHAGPGTLSMANAGPNTNGSQFFITTAATPWLNGKHVVFGHVLEGMDVVRAIESNPTARGDRPVAPPPTTPTPTTTTRRPRAPPSSLARVPFPCNDRPHRARARLNHPAHESRAFAPRARPHKARANAGAPPDRARAKNALLRARARVDTDDARERERSPVDARASDRAGASRGRRPRDDX

SEQ ID NO: 23970 - protein, 212 aa, Trichodesmium erythraeum IMS101
MTTAARLGIGGPVGSGKTALLECIVPLLTNQGIEVAIVTNDLLTTEDAERLKSGGILPRDRIIGVETGSCPHTAIREDPTMNILAVQDLEQLFPNLNLIMIESGGDNLASTFSYDLVDAYIFVIDVGAGDDIPRKKGPGFMQADLVVINKIDLAPYVNANLNLIRKEASVYRQSKPIAYTNCKTGVGLNEVVNFILERVLFRTALSVKNLEK

SEQ ID NO: 23971 - protein, 445 aa, Saccharomyces cerevisiae
LDAFGDDQAISKPNTVVIQQPQNEPVLVLSSLSQSPCVSSSSSLSTPCIIDAYSNNFGLSPSSTNSTPSTIQGLSNIATPVENEHSISLPPLEESLSPAAADLKDTLSGTSNGNYIQLQDLVQLGKIGAGNSGTVVKALHVPDSKIVAKKTIPVEQNNSTIINQLVRELSIVKNVKPHENIITFYGAYYNQHINNEIIILMEYSDCGSLDKILSVYKRFVQRGTVSSKKTWFNELTISKIAYGVLNGLDHLYRQYKIIHRDIKPSNVLINSKGQIKLCDFGVSKKLINSIADTFVGTSTYMSPERIQGNVYSIKGDVWSLGLMIIELVTGEFPLGGHNDTPDGILDLLQRIVNEPSPRLPKDRIYSKEMTDFVNRCCIKNERERSSIHELLHHDLIMKYVSPSKDDKFRHWCRKIKSKIKEDKRIKREALDRAKLEKKQSERSTH

SEQ ID NO: 23972 - protein, 356 aa, Prochlorococcus marinus str. MIT 9312
MRKVLAIETSCDETSVSIVSNIGNTFKIHSNIIASQIEDHSKWGGVVPELAARKHLELLPFVLEKALTESKIKIEEVDYIASTVAPGLVGCLRVGSITARSLCMLHSKPFLGIHHLEGHLSSILFSENYPKKSFLTLLVSGGHTELIKVDDRRGMQRLGKSFDDAAGEAFDKVGRLLGLSYPGGPAIEKIAKNGDPMKFNLPKCRISDKKGGFLKYDFSFSGLKTAVLRLVEKINLDGKTVPVPDIAASFERVVAEVLVERTIRCAEDHSLDNVVVVGGVAANNTLRKMMISEANKKSIKVHLAPLNLCTDNAAMIGAAALFRIKFKDHLSSLKLGVSGRLSIEQANTLYEENPPF

SEQ ID NO: 23973 - protein, 362 aa, Bacillus cereus ATCC 14579
METTVRKQKKNLETKKPSIYSLQLHEMQDWLKEQGEPKFRAGQIFDWLYKKRVKNYEDMSNLSKGLRDKLSNSFDITTLKTLVKQTSSDGTIKFLFQLYDGYSIETVLMRHEYGNSICVTTQVGCRIGCTFCASTLGGLKRNLEAGEIVAQVVEVQRALDETEERVSSLVVMGIGEPFDNYDNLMGFLRIINHEKGLHIGARHMTVSTSGIIPKIYKFAEEDLQINFAISLHAPNSELRSKLMPINRAYKLPDLMEAIKYYVNRTGRRITFEYGLFGGENDQVEHAEELAALLKGVKCHVNLIPVNYVPERDYVRTPREQIFLFEKTLKDRGVNVTIRREQGHDIDAACGQLRAKERKEETR

SEQ ID NO: 23974 - protein, 127 aa, Arabidopsis thaliana
MESYQNQSGAQQTHQQLDQFGNPFPATTGAYGTAGAPAVAEGGGLSGMLHRSGSSSSSSSEDDGLGGRRRKKKGITEKIKEKLPGHHDSNKTSSLGSTTTAYDTGTVHHEKKGMMEKIKEKLPGGHH

SEQ ID NO: 23975 - protein, 935 aa, Glycine max
LKNNTKKHQFNWVLIPLLTSFAVCQLEEFVSIDCGGTSNYTDTSTGLAWISDSRIMQHGISVEVESPNRSMVQYQKRRDFPIESKKYCYTLSTEERRRYLVRATFQYGSLDSGDTYPQFQLYLDATKWATVSIYDASRIYVKEMIIRAPSNSIDVCMCCATTGSPFISTLELRPLNLSMYATDFEDNFFLEVAARINFGAPTEDAVRYPDDPYDRIWDSDLIKRQNYLVGVAPGTERISTTRNIDIETREYPPVKVMQTAVVGTKGVLSYRLNLEDFPANARAYAYFAEIEDLGQNESRKFKLKQPYIADYSNAVVNIAENANGSYTLYEPSYMNVTLEFVLSFSFVMTPDSTRGPLLNALEISKYVQIASKTDKQDTTVVNAFRLLSAQSSQTNEGDPCVPTPWEWVNCSTTTPPRITKIILSRRNVKGEIPSELSNMEALTELWLDGNLLTGQLPDMSKLINLKIVHLENNKLTGRLPSDMGSLPSLQALFIQNNSFSGEIPAGLISKKIIFNYDGNAELHRGKKKHFKMVLGISIGVLVILLILFLVSLVLLLNTRRKASKKKREEKGISGRTNSKPGYSFLRGGNLMDENTTCYITLSELKEATDNFSKKIGKGSFGSVYYGKMRDGKEIAVKSMNESSCHGNQQFVNEVALLSRIHHRNLVPLIGYCEEECQHILVYEYMHNGTLRDHIHESFKKQKLDWLARLRIAEDAAKGLEYLHTGCNPSIIHRDIKTGNILLDINMRAKVSDFGLSRLAEEDLTHISSIARGTVGYLDPEYYASQQLTEKSDVYSFGVVLLELIAGKKPVSSEDYSDEMNIVHWARSLTHKGDAMSIIDPSLEGNAKTESIWRVVEIAMQCVEQHGASRPRMQEIILAIQDAIKIEKGTENKLKSSSSFSGSSSSKPHSSRKTLLTSFLEIESPDVSNGCLPSAR

SEQ ID NO: 23976 - protein, 294 aa, Ostreococcus tauri
MELGRAPTTTAGDARGAGGTIDAGAIERLSWAPHAEVYRGFLTEAECEHIERLATAELKPSTVVDASTGGDASSEIRTSSGMFLGRAEDDVIEAIEARIAAWTHVPESHGEGFQVLRYEKHQEYRAHYDYFHDKFNVKREKGGQRMGTVLMYLSDVEEGGETVFPKFEDGTPAGSEASECARNKLAVRPRKGDALFFRSLRHDGVPDTFSEHAGCPVIRGVKFSATKWMHVSPIEDGSNGLLLPPGVCKDLHAACVAWAKSGECEKNKNYMVGRGRSKGNCMRSCGACPEGTHE

SEQ ID NO: 23977 - protein, 120 aa, Arabidopsis thaliana
  misc_feature (10)..(10): Xaa can be any naturally occurring amino acid
  misc_feature (17)..(18): Xaa can be any naturally occurring amino acid
  misc_feature (22)..(22): Xaa can be any naturally occurring amino acid
  misc_feature (26)..(26): Xaa can be any naturally occurring amino acid
  misc_feature (31)..(31): Xaa can be any naturally occurring amino acid
  misc_feature (36)..(36): Xaa can be any naturally occurring amino acid
  misc_feature (40)..(42): Xaa can be any naturally occurring amino acid
  misc_feature (46)..(46): Xaa can be any naturally occurring amino acid
  misc_feature (51)..(59): Xaa can be any naturally occurring amino acid
  misc_feature (62)..(64): Xaa can be any naturally occurring amino acid
  misc_feature (70)..(70): Xaa can be any naturally occurring amino acid
  misc_feature (76)..(77): Xaa can be any naturally occurring amino acid
  misc_feature (80)..(80): Xaa can be any naturally occurring amino acid
  misc_feature (82)..(82): Xaa can be any naturally occurring amino acid
  misc_feature (87)..(87): Xaa can be any naturally occurring amino acid
  misc_feature (89)..(89): Xaa can be any naturally occurring amino acid
  misc_feature (91)..(91): Xaa can be any naturally occurring amino acid
  misc_feature (93)..(97): Xaa can be any naturally occurring amino acid
  misc_feature (100)..(103): Xaa can be any naturally occurring amino acid
  misc_feature (106)..(106): Xaa can be any naturally occurring amino acid
  misc_feature (108)..(110): Xaa can be any naturally occurring amino acid
  misc_feature (112)..(112): Xaa can be any naturally occurring amino acid
  misc_feature (114)..(115): Xaa can be any naturally occurring amino acid
  unsure (1)..(120): unsure at all Xaa locations
MASSMLSSAXVVTSPAXXTMVXPFTXLKSSXAFPVXRKTXXXITSXASNGXXXXXXXXXPPXXXKKFETXSYLPDXXDVXLXKEVDXLXRXKXXXXXSNXXXXHGXVXXXHXNXXGKPLA

SEQ ID NO: 23978 - protein, 432 aa, Prochlorococcus marinus str. MIT 9211
MPRMAAWKVLQAVSAGAYAETALDQVLNKYSMKAIDKALTTEIAYGSIRQRKYLDSWIDNLAKISALKQPPRLRWLLHIGLYQIFLMERIPVSAVVNTTVQLAKNNNLNKLSSVVNGILRNAIRIREAGQGLPFKSNASEELAQSFSIPLWLANSLITWRGEQGAKSIAMAFNQPPAFDLRINRCKTNPRSVQEIFDKFGITSLPIKGCTSGLQITSGMGDLRKWPGYEGGEWSVQDRSSQWIAPLLEAEPGDRILDACSAPGGKATHLAELIDDNGEIWAVDRSPKRLQKVSENATRLGLNSLKCLAADASMLLDCKPHWKGYFQRILVDAPCSGLGTLSRNPDARWRMTPEKIDELIILQARLLRGVLPLLSPGGRIVYSTCTMHPEENFKQVGEFLALHPKVKLKYQNQIWPDDAQSGDGFYAAVIDID

SEQ ID NO: 23979 - protein, 456 aa, Bilophila wadsworthia
MTYDKAELVALDKKYVWHHLTQHKNFEPAIYVKGEGMRITDIDGKTYLDAVSGGVWTVNVGYGRKEIVDAVAKQMMEMCYFANGIGNVPTIKFSEKLISKMPGMSRVYLSNSGSEANEKAFKIVRQIGQLKHGGKKTGILYRARDYHGTTIGTLSACGQFERKVQYGPFAPGFYEFPDCDVYRSKFGDCADLGVKMAKQLEEVILTVGPDELGAVIVEPMTAGGGILVPPAGYYETIREICDKYELLLIIDEVVCGLGRTGKWFGYQHFNVQPDIVTMAKGVASGYAPISCTVTTEKVFQDFVNDPADTDAYFRDISTFGGCTSGPAAALANIEIIERENLLENCTKMGDRLLEGLKGLMAKHPIIGDVRGKGLFAGIEIVKDRATKEPIAEAVANAMVGAAKQAGVLIGKTSRSFREFNNTLTLCPALIATEADIDEIVAGIDKAFTTVEQKFGL

SEQ ID NO: 23980 - protein, 118 aa, Campylobacter coli RM2228
MKNKYIEQFEAKQIEGKNVPEFRAGDTLRLAIRIKEGDKTRIQNFEGICIARRGNGVDETFIVRKMGANNVGVERIFPIYSESLESITVVRKGRVRRARLFYLRDRRGKAARIKELKK

SEQ ID NO: 23981 - protein, 137 aa, Campylobacter coli RM2228
MLSTKKILLALINIPIFLNATEYQLSTHILDINSGQPASNVKVELYNLDQNRQWVKISEKFTKKNGRIADFLPYEKTENRSFGVYKLKFYTKDYYISHKVDSFYPFVEVSFELLKDQKHYHIPITLSPFGYSTYRGS

SEQ ID NO: 23982 - protein, 272 aa, Oryza sativa
MALASALSCLLACRWSRFSLSFESPRLVMCSAHGGWAGRSSQLLSETVQQIRDQQPDAHLEAFQIDLSSYKSIKKFETSLNQWIKDSNMEHSIQLLVNNAGILAKSYRITEDGLDEMIQANYIGPFVLTNILLPLLKNSSTPSRVVNLTSFTHRCVSEINLSEKGLSGVRAADPGVVQTGIMRELPPCLSWLALSVLRLLNLLQQPDTGVDAVLDAALAPPDSSGKYFFGGKGRTITSSQLSYNVEVAKKLWAESLALFNELQNRVCELRTS

SEQ ID NO: 23983 - protein, 337 aa, Thermoproteus tenax
MKIGVLTGGGDAPGLNIAVYTFVKLAERKHEVYAIYHGWRGLLNKEVKRVSSRDLLDFAFSGGTYIRTSRTNPFKDEERARLLESNVKELGLDVVVAIGGDDTLGAAGEAQRRGILDAVGIPKTIDNDVYGTDYTIGFDSAVNAAIEATESFKTTLISHERIGVVEVMGREAGWIALFTGLSTMADAVLIPERPASWDSVAKRVKEAYNERRWALVVVSEGIKEYGGPKDEYGHSRLGGVGNELAEYIERSTGIEARAVVLGHTIRGVPPTAFDRILAVRYATAAYEAVENGRYGVMVAYSNGDIAYVPIVDVVGKNRLVSGYWMRLYETYWPDLAG

SEQ ID NO: 23984 - protein, 285 aa, Oryza sativa
MLKRLFDRQLLRVSPAERIVAVGGGEKDEVEPSSVCLDGMVRSFLEDGSGVGAAVERAGGHGARRCNCFHGGGSSDDDDDEDDAAASSDVAETIKGLVHCATLRERNLLADVCGHVERHRAGGARRRELLGLVAASLRAAGHDAAVCVSRWDKSPTHPAGEHAYVDVLLPPASDRGARERVLVDVDFRSAFEVARPTKAYRALLQRLPAVFVGKDDRLRLLVAASADAARASLRKRGLHLPPWRKPEYMRAKWLSPYDREPAPPDEASASAAAAEVAGEEAPAAA

SEQ ID NO: 23985 - protein, 456 aa, Candida albicans SC5314
MVLPHEPEFQQAYDELVSAVEDSTLFKEEPQYKKVIPVVSIPERIIQFRVTWENDKGEIEVNNGFRVQYNSALGPYKGGLRFHPTVNLSILKFLGFEQIFKNALTGLSMGGGKGGSDFNPKNRSDNEIRRFCVSFMRQLARYIGPDTDVPAGDIGVGGREVGFLFGAYKQMRNNWAGVLTGKGLTWGGSLIRPEATGYGCVYYVEKMIEKATNGKETFKGKRVAISGSGNVAQYAALKVIELGGTVVSLSDSKGSIISKNGITADQVYAIAAAKLKFKSLEEIVADSVQLFSGDHSVEYLAGVRPWTKVGQVDVALPSATQNEVSGEEAKALVDAGCKFIAEGSNMGSTKEAIEVFEANRDSNGVWYAPGKAANCGGVAVSGLEMAQNSQRVQWTNEEVDAKLKEIMYTCFENCYKTAQKYSIEKNENGLPSLLKGANIAGFIKVADAMFDQGDVF

SEQ ID NO: 23986 - protein, 156 aa, Prochlorococcus marinus str. MIT 9312
MAKEKQENELETIIKTDGSVDVAVEQKEKNLVSETTKTISVSNLIEEFENEQLKKELPEIYVGDTVKVGVRITEGNKERVQPYEGVVIAKRHGGIHQTITVRRIFQGIGVERVFMLHSPQVASLKVERRGKVRRAKLFYLRDRVGKATRVKQRFDR

SEQ ID NO: 23987 - protein, 508 aa, Arabidopsis thaliana
MFEAGGLFGFTGTTMASLMFFWSVYRQFVPYQIRDYLEKCFYKMFGLVSNSVHIKFTEYTEDKGLKKSQAYDLIRNYLSSKSTARAQRLKANESKNSKSLVLSLDNHEAVEDVFQGVKVVWSLSVWKSNDQADSSEKRYLTLSFHNRYREMITTTYLDHVLREGKEIGLKNRERKLYTNNSSQDYSAWREGRWSNVPFDHPATFETLAMDLEKKEGMKKDLIKFTKGKDYYRKVGKPWKRGYLLFGPPGTGKSTMISAMANFLEYDVYDLELTTVKDNSELKKLMLDTKGKSIVVIEDIDCSLDLTGQRKKKKEEDEDEEEEEKKKEAEKLLKRERGERESKVTLSGLLNAIDGLWSACSGEKIIVFTTNYLDKLDPALIRRGRMDNHIEMSYCRFEAFKVLAKNYLEIESHDLFGEIKRLVEETDMSPADVAENLMPKSDEDDADICLTRLVKSLEEEKEKAKKLAEEEKMKKAARDARRIKKKAEEEHKKKNKVEENGDVSHDNGK

SEQ ID NO: 23988 - protein, 115 aa, Gibberella zeae
MADVEMSDAPVAKKAEGSNSKSVEGKKKFEVKKRNAVALWAWDIVVDNCAVCRNHIMDLCIECQANQASATSEECTVAWGICNHAFHFHCISRWLKARSVCPLDNRDWEFQKYGR

SEQ ID NO: 23989 - protein, 460 aa, Arthrobacter globiformis
MADQATAQEFDILVLGGGSGGYAAALRAVQLGLTVGLVEKGKLGGTCLHNGCIPTKALLHSAELADHARDSAKYGVNVTLDSIDINAVNAYKDGIIAGKYKGLQGLIKSKGITVIEGEGKLQGTDTVVVNGTAYKGKNIVLATGSYSRTLPGLEIGGKVITSDQALTMDYIPKSAIILGGGVIGVEFASVWKSFGVDVTIVEGLPSLVPNEDATIVKNFERAFKKRGIKFSTGVFFQGVEQNDDGVKVTLVDGKTFEADLLLVAVGRGPVTANLGYEEAGITIDRGFVITNERLHTGVGNVYAVGDIVPGVQLAHRGYQQGIFVAEEIAGLKPVVVEDINIPKVTYSEPEIATVGYTEKAAKEKFGEDQVQTQEYNLAGNGKSSILGTSGLVKLVRQKDGPVVGVHMIGARMGEQVGEAQLIVNWEAYPEDVAQLLHAHPTQNEALGEAHLALAGKPLHG

SEQ ID NO: 23990 - protein, 267 aa, Prochlorococcus marinus str. MIT 9312
MSTSFKNVTPTGPGGTATLLIVLSFTGFLLLTQSLFVVPSGQVAVVTTLGKVSGPSRRAGLNLKLPFIQSVYPFDIKTQVQPEKFETLTKDLQVIRATATVKYSVKPQEAGRIFATIASRNSDVYQKIVQPSLLKALKSVFSQYELETIATEFAVISEKVGDTVAQELNSFDYVDVKSLDLTGLEIAEEYRAAIEQKQIAGQQLLRAKTEVEIAEQEALRYETLNKSLDDQVLFKLFLDKWDGSTQVVPGLPGSEGGTPPVIVGGRR

SEQ ID NO: 23991 - protein, 434 aa, Prochlorococcus marinus str. MIT 9312
MTDILNCTKSEEIFSAAQELMPGGVSSPVRAFKSVGGQPIVFDRVKGPFAWDIDGNRYIDYIGSWGPAICGHAHPEVTTALQEAIEKGTSFGAPCVLENKLAEMVIDAVPSVEMVRFVNSGTEACMAVLRLMRAFTGRDKVIKFDGCYHGHADMFLVKAGSGVATLGLPDSPGVPRTTTANTLTAPYNDLEAVKKLFSENPDAISGVILEPIVGNAGFITPEPGFLEGLRELTTENGSLLVFDEVMTGFRISYGGAQEKFGVTPDLTTLGKVIGGGLPVGAYGGKKEIMSMVAPSGPVYQAGTLSGNPLAMTAGIKTLELLKQEGTYEKLDAITSRLIEGIIQSAENNGIAIYGGSVSAMFGFFLCDGPVRNFDEAKTNDAKLFGKLHREMLRRGVYLAPSPFEAGFTSLAHNEEEIDKTIEVFDQCFNTIKNQ

SEQ ID NO: 23992 - protein, 420 aa, Arabidopsis thaliana
MKCFLFPLGDKKDEQRSPKPVSPTSNFSDVNKSGSDFSPRDVSGTSTVSSTGRNSNTSMSARENNLREFTIGDLKSATRNFSRSGMIGEGGFGCVFWGTIKNLEDPSKKIEVAVKQLGKRGLQGHKEWVTEVNFLGVVEHSNLVKLLGHCAEDDERGIQRLLVYEYMPNQSVEFHLSPRSPTVLTWDLRLRIAQDAARGLTYLHEEMDFQIIFRDFKSSNILLDENWTAKLSDFGLARLGPSPGSSHVSTDVVGTMGYAAPEYIQTGRLTSKSDVWGYGVFIYELITGRRPLDRNKPKGEQKLLEWVRPYLSDTRRFRLIVDPRLEGKYMIKSVQKLAVVANLCLTRNAKARPKMSEVLEMVTKIVEASSPGNGGKKPQLVPLKSQETSRVEEGKNKKVLDGAEGGWLEKLWNPKNVRAC

SEQ ID NO: 23993 - protein, 484 aa, Oryza sativa
  misc_feature (474)..(474): Xaa can be any naturally occurring amino acid
  unsure (1)..(484): unsure at all Xaa locations
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLXLAEQLYEVAA

SEQ ID NO: 23994 - protein, 641 aa, Ostreococcus tauri
MDEVFGRASGASGDGLSMGVRAPTWAEDARAEAEQREERRFEADLAAAISASLGEKQSATDDGGRGESGMMEEERAMLEARRQSLRERFGGSAMAERFYSRYSLNFSERLADGFYSIYPNPVDGTFPKTFDLESLRAFVADDGEGEREVSIVDRSTDLLLQECDASPELARLVAERMGGPAESDETLRERWEVERRRLSKEHGGAVFPIGSIKVGLQRHRALLFKSVADFLEIPSQIVRGKYYCGHDDGVMIIVMCGGMKRMLNLMDSPGRMQQPFNSDSKTPSVYSDSGRMSPDNTADAGHFGVMPQENLPSHETKETPLRLQIAVDLTIDPSQILLGERIGIGSFGEVHRALWRGTEVAVKRFLDQDISRNLLDEVTFEIDIMRRLRHPNVVLLMGAVTVPGNLSIVTEFLHRGSLFKLLHREQPPAVAAALDNRRRMRMAMDVVRGMHYLHSFEPMIVHRDLKSPNLLVDKSFVVKVCDFGLSRMKRNTYLSSKTNAGTPEWMAPEVLRNEASDEKADVWSFGVILWELATVLEPWQGLNPMQVVGAVGFAGKQLEIPSDVDEVIANMCRDCWQTNPRERPSFEHLAESLRSVPLAPSLPSDPPSRERSRLTVPTVPPVPEEASKPNPDDWSDDRFRV

SEQ ID NO: 23995 - protein, 232 aa, Nicotiana tabacum
MGCLSVVGASPCVSSSALSSPTSRLSCAPSCKLILNPIKKNHHLAAFQPAVHLFASNQSRSHASKRNHTTRIFLPHLVASMEEVEETYIMIKPDGVQRGLVGEIISRFEKKGFKLTGLKLFHCPKELAEEHYKDLQSKPFFPKLIDYITSGPVVCMAWEGVGVVASARKLIGATNPLNAEPGTIRGDLAVQTGRNVVHGSDSPDNGKREIALWFGEGELCSWTPVQEPWLIE

SEQ ID NO: 23996 - protein, 358 aa, Triticum aestivum
MAKFGEGDARWIVQERADGANVHNWHWAERDCLDWSRALLSKLLAGLPVLSGEGGLTLRTTTLDKLDGEAYVNIRKGKVIPGYELSLTLAWEADATTESGVVKVTGTAEVPYLADENADEDPELRITVRGDDGPLARRAKDAFIAHGKPLVITKIRDYVAAMANGGPAKDEIDSKKISTKAAPAAGGAAVAPAPSVKVTAAPVQAPAAKEKKANGKDKEGFQTIEMTEKFNCRSKDIYEILMDDHRWKGFTQSNARISKDVGGQFSLFDGSITGVNEELQEGKLIVQKWRFGSWADGVHSTVRLVFDEPESGVTTIKLKQTDVPEEDRYGNSTVVENTERGWKELIFQRIRAVFGFGV

SEQ ID NO: 23997 - protein, 553 aa, Burkholderia pseudomallei K96243
MQRPRLFPTLTRRTQRIWRQYGVFWLGAVVVGLTAVMYARLIDWGYEAFRSLGQGRPWLPFLLTPAIAALSVWLTRRFFRGAEGSGIPQVIATLHAQPSAFGSRLLTLRILFGKVLISLLGIAGGFTIGREGPTVQIGASLMFNLRRFYPRSNALIERQLVLAGAAAGLSAAFNTPLAGVVFAIEELSRSFSARASGVLITAIIIAGVIALGLNGNYTYFGTIEIGQHFPKMLAAAVLLTALVTGVAGGLFGWLLLNTGRWLPARLLALYRERPIVFAAACGLAIAAVGVASGGTTFGSGYAEARGLLDGREQLSVLYPFLKMISMVASYLPGIPGGIFAPSLSIGAGFGNLLHFVFSGMHLPMLIALAMVGYLAAVTQSPITSFVIVMEMINGHALVISLMATALIASRVSRLFVPPLYETLAERYLKPPQPKQAATAPAPAHTGIAAVKMPEDAESAPADPLDTLRDEAANEANANEPDAGDAGGHTGAGAAAHADDAPCGAADAARAGAPPDASPASAPGAAGASNTRANDPTPPSGDDENREPPQRPAQ

SEQ ID NO: 23998 - protein, 284 aa, Oryza sativa (japonica cultivar-group)
MASHDHDHDHHHHHSHDDGDHHHSHHQDGSHGGGGGSWVGEDGRVWHSHDGLAPHSHEPIYSPGDFSKRAPPLISRRFAERAFTVGIGGPVGTGKTALMLALCRSLREKYSLAAVTNDIFTKEDGEFLIKHGALPEERIRAVETGGCPHAAIREDISINLGPLEELSNLCKADLLLCESGGDNLAANFSRELADYIIYIIDVSGGDKIPRKGGPGITQADLLIINKTDLAPAVGADLAVMERDALRMREGGPFVFAQVKHGVGVEEIVNHILQAWEIATGNKRR

SEQ ID NO: 23999 - protein, 459 aa, Glycine max
MTRGIKHRQKAKSKKKGGSSSSLAPEIPAKVWQPGVDKLEEGEELQCDPSAYNSLHAFHIGWPCLSFDILRDSLGLVRTEFPHTVYFMAGTQAEKPSWNSIGIFKVSNITGKRREPVPKLGTDDTEMDGEDSDSDDDSEEEDEGGAQGPRCVNRIRSMPQNPHICAAWADTGHVQVWDLNSHLNVLAETETEGVQGVAAVFNQDPLYKFKHKDEGYAIDWSPLVPGKLASGDCNNCIYLWEPTSAGTWNVDNAPFIGHTASVEDLQWSPTESHVFASCSVDGNIAIWDTRLGKSPAASFKAHNADVNVMSWNRLASCMLASGSDDGTISIRDLRLLKEGDSVVAHFEYHKHPITSIEWSPHEASSLAVSSSDNQLTIWDLSLEKDEEEEAEFKAKTKEQVNAPEDLPPQLLFIHQGQKDLKELHWHTQIPGMIVSTAEDGFNVLMPSNIQSTLPSNGAL

SEQ ID NO: 24000 - protein, 594 aa, Gibberella zeae PH-1
MNRVAVKSLRTTSLSTVHALPRAPRRGFSISSTVLAHQSRSKASAHARYAHRKSTKHIPLKSSMYFRRLPTALLSSIVVGYGAWYSYNSTDSVPTSTFSANSLTSTQTADAVPTRTVLVVGADELRQGTIVGEGPISKATSDDGRRIVEMLTPDQATQKLRRLEQSYSVSRGQGVTRYDLVQLPSNDPIEDDHAEKIVQVPSRSSAETDNSDWMFWGVFDGHSGWTTSATLRESLINYVARELNATYKLASGELPSEDAVTQAIKTGFNNLDNEIVHKSVEKVFKGGSKTVAAELLQPALSGSCALLSFYDSRSNLLRVACTGDSRAVLGRRAANGKWTATALSDDQTGSNPSEVDRMRKEHPGEENVIRNGRVLGGLEPSRAFGDAVYKWSRDVAYKLRENFFGRSPSPLLKTPPYVTAEPVVTTTKVSPENGDFLVLATDGLWEMLTNEEVVGLVGKWIETEGQSGTNSQFDAAWDRIFGSSKTPLPVEESKTAGPDGNKTPIRVQQWGIDPDAKDRFTVKDKNVATHLIRNALGGNNDEQVCALLTLPSPFSRRYRDDLTVQVIFFGHGEKTGEITVNLEATAGEGVKAKL

SEQ ID NO: 24001 - protein, 346 aa, Oryza sativa (indica cultivar-group)
MAMHRFSLCCVVLLVLAPLAAVAWRPWPPRNGSGEVEGIGASKKFEGSSDFVKLQYHMGPVLAADITVHPIWYGRWPAEQKRTIRAFLRSLSPPGSGSGDGGIPSPSVAAWWRTVRLYTDQTSANVSGVVRLGREKCDARASRGGRLTRLDIQSVVRDAVTARTRPLPVDSSGVYLVLTSPEVVVENFCGQVCGFHYFTFPSVVGYTLPYAWVGNSAARCPEVCAYPFAIPSYVGGGRRAEAPPNGDVGVDGMVSVIAHELAELASNPLANAWYAGEDPSFPTEIADLCEGIYGTGGGGAYTGQLLTDGRSGASYNVNGVGGRKFLVQWVWNPILSYCSGPNALDQ

SEQ ID NO: 24002 - protein, 628 aa, Oryza sativa (indica cultivar-group)
MGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 24003 - protein, 552 aa, Zea mays
  misc_feature (94)..(94): Xaa can be any naturally occurring amino acid
  misc_feature (126)..(126): Xaa can be any naturally occurring amino acid
  misc_feature (139)..(139): Xaa can be any naturally occurring amino acid
  unsure (1)..(552): unsure at all Xaa locations
MARRVASSLVSRCLLARAPAGAPPAAPSALRRTVPADGMHRLLPGVLQRFSTAAAVEEPITPSVHVNYTKLLINGNFVDSASGKTFPTLDPRTXGEVIAHVAEGDAEDINRAVAAARKAFDEGPWXPKMTAYERSRILXGRFADLIEKHNDELAALETWDNGKPYEQAAQIEVPMVARLMRYYAGWADKIHGLIVPADGPHHVQILHEPIGVAGQIIPWNFPLLMFAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 24004 - protein, 443 aa, Zea mays
MASKRANAGDEQQKLSPSGLPVHKIPGSYGVPFFTPLRDRLDYFYFQGAEEYFRFRVAKHGGATVLRVNMPPGPFLSGDSRVVAVLDARSFRVLLDDSRVDKDGTLDGTYMPSLALFGGHRPLAFLDGADPRHAALKRVMIRLAAAGMQHVAPAFGAAFTATFDAVEAGMAGGASAVEFNKHNMRHMLDFTCASLFGGKLPSKAIGDGAAAKAFKWLVFQLHPLASKAIRPWPLEDLLLHTFRLPPFLVRRDYAELTAYFADVAAGVLDDAEKAEPGAVPRDELLHNLIFLAIFNAYGGYKIFLPHVVKWLARSGPELHARLADEVRAVVPPGSASAGDAITLSDVEKMPLVKSFVWETLRMNPPVEFQYGRARQDMVVESHDAAYEVKKGEMLFGYQPLATRDERVFRRGREFVPDRFAVCSDDERRRLLDHVVWSNGPETG

SEQ ID NO: 24005 - protein, 707 aa, Synechocystis sp. PCC 6803
MERIDIHPTHTANGYKLRCGQPFPFGATIVPGGVNFSIYSSHSTACTLVLFEKRAPQPFVEIPFPESFRIGNVYCMVVFDLDFENLEYGYRMEGPNNFQQGHWFDPSKVLLDPYAKVVSGRDVWGTQPNWDDIYQHRGRLSFDDFDWENDSPLDVPLEDMVIYEMHVRGFTKDPSSGVKENHRGTFAGILSKIPYLQELGVNTIELMPIFEFDEFEHSRYHPETGEFLVNYWGYSTVNFFAPKAGYAATGKFGMQIDELKNLVKELHKVGISVILDVVFNHTAEGNERGPTISFRGLDNKTYYMLTPEGYYFNFSGTGNTLNCNNPIVRGMVLDCLRYWTAEFHIDGFRFDLASILGRDPWGYPLANPPLLETLAFDPILARSKLIAEAWDAGGLYQVGSFPSYGRWAEWNGKYRDTVRKFIKGDAGVIGEMAQRLQGSPDLYQGAGRPPSTSINFVTAHDGFTLADLVAYNGKHNYANGENGNDGANDNYSWNCGVEGPTDNPDILRLRARQMRNAIAILLVSQGVPMLLMGDEMGKTQDGNNNTYCHDSPFNWLNWHLLEQNQAWFRFVKHCIAFRLAHPVLRNSEHFQNCDYLGVGFPDISWHGVKPWHADWSADSRVLAFMLCGRHAKGGRVKDNQIYVAMNMHYESLWFELPAPPVGTTWHVFANTGAQPPEDIHPPGQEPPLSSQSSLLIGDRSVVILLAK

SEQ ID NO: 24006 - protein, 815 aa, Euglena gracilis
MAHYRTIPSEAGRPIETNKVLVVLSVTCGAALAALLANENLSQNQWAVTQAPTRPLHLDFSSTSRQMEPREYVQMLPPQQQSTRQTQNTRAPRREASWALATTALGSVAVFLGLYMRNRSPTLDLVEVKLQDPIALFATTGKVELGSTLEDFMKAYVPDPKLRIIMATMAESGRTIDHKVTTASCGGTACTNVFGDEQLAVDMLADKVLFEGLRHCGVCEIACSEENPVPLPMGGQGYSVCFDPLDGSSIVDTNFSVGTIFGVWPGDKIVGTTGRDLAASGIIVYGPRTVLCVAFKGVPGTFDFMLQDDGKWHLVKETTKIGEGKLFSPGNLRCTYDNPEYLNLISFYNNEQYTLRYTGGMVPDVYQLLIKGRGVFTNVTSPTTKAKLRLSFEVAPIALLIESAGGASSCDGKSVSALDVTITGIDQRTQVCFGSRTEVARFEQFMFGQVSPRLAATLSADELAKATAAPKSSKLITDAADPAPAFVPPVWKAQAVPEISAKIGESLEEVLAKAVPDLKLRRVMTTMANSCRIISHKVKTAATTGTAATNVFGDEQLAVDMVADKVLFEGLSHCEACEIACSEENPVPLEMGGSGYSVCFDPLDGSSIVDTNFAVGTIFGVWPGNKIIGSTGRDLAASGICVYGPRTVLCVAFKDYPGTHDFLLGDDGKWTYVKAYTHIGEGKLFAPGNLRCTLDNPEYERLISYYTRQQYTLRYTGGMVPDVYQILVKEKGVFTNVISPSTKAKLRLSFEAAPIALLVEKAGGASSCDGKCVSALDVQINGIDQRTQVCFGSRTEVARFEHYLYGKVSDRLLAA

SEQ ID NO: 24007 - protein, 197 aa, Oryza sativa
  misc_feature (14)..(14): Xaa can be any naturally occurring amino acid
  unsure (1)..(197): unsure at all Xaa locations
MAGGKKRKAEAARXLEETDRALYGAFRGAANSLSQLYTLAMGGQKLSFQAGERHAMEKLYEWILRQHENGLRLTVADIASHIQHEIQYGGDNASASPRSQHASQSTQATVPIPNTMSQQPSPNLFALGNTGLVQSKNSAVFSNALSSPVRRSLQPFHLEQGGDAGYFANGVNRDQNSTASNDSSMDMHSDSPAHDSY

SEQ ID NO: 24008 - protein, 379 aa, Arabidopsis thaliana
  misc_feature (51)..(51): Xaa can be any naturally occurring amino acid
  misc_feature (249)..(249): Xaa can be any naturally occurring amino acid
  unsure (1)..(379): unsure at all Xaa locations
MAEADDIQPIVCDNGTGMVKAGFAGDDAPRAVFPSVVGRPRHHGVMVGMNXQKDAYVGDEAQSKRGILTLKYPIEHGVVSNWDDMEKIWHHTFYNELRIAPEEHPVLLTEAPLNPKANREKMTQIMFETFNSPAMYVAIQAVLSLYASGRTTGIVLDSGDGVSHTVPIYEGFSLPHAILRLDLAGRDLTDYLMKILTERGYMFTTTAEREIVRDIKEKLSFVAVDYEQEMETSKTSSSIEKNYELPDGXQVITIGAERFRCPEVLFQPSFVGMEAAGIHETTYNSIMKCDVDIRKDLYGNIVLSGGTTMFSGIADRMSKEITALAPSSMKIKVVAPPERKYSVWIGGSILASLSTFQQMWISKAEYDEAGPGIVHRKCF

SEQ ID NO: 24009 - protein, 470 aa, Pseudomonas fluorescens Pf-5
MPSANALSSSPPASAHNASLDGGFTHSAQGTSLRRILGLPALVFFGLVYMVPLTVFTTYGVVTQLTGGRTAAAYVITLLAMIFTALSYSVMVKKYPIAGSAYSYASLSFGPGIGFLAGWSLLLDYLFLPMINYLVIGLFLNLAFPAVPAWVFVVATISLVTLLNIRGIGSVSSMSNLIVCAQMVFVVVFMALVVRQLAGAESLDLSAPWVGDGSQDGLLPLMAGAAVLCLSFLGFDAVSTLAEETRDPRRDIPRAIVITTLGAGLLFILLAMTSQLAFPGSSFKDADSAASEVMLHAGGRFLEMFFTATYVAGAAGSALASQASVSRILFSMGRDGILPRRVFGTLSERYKTPVVAIVLVSLVSLLAVVIDLTTLASMISFGALVAFSVVNLAVIKSHLGQGQPRSTARLLQYGLLPLIGFALIAWLWTSLSALTLGIGLAWFALGLLYLGIHTRGFRQPAPTVQFSEQA

SEQ ID NO: 24010 - protein, 1072 aa, Bacillus cereus ATCC 14579
MPKRLDINTILVIGSGPIVIGQAAEFDYSGTQACQSLKEEGYKVILVNSNPATIMTDTATADKVYIEPLTLEFVSRIIRKERPDAILPTLGGQTGLNMAVELAKSGVLDECGVEILGTKLSAIEQAEDRDLFRTLMQDLNEPTPPSEIIHNLDEAYGFVNEIGYPVIVRPAFTLGGTGGGICHNEEELIEIVTSGLKHSPVTQCLLEKSIAGCKEIEYEVMRDSNDNAIVVCNMENIDPVGVHTGDSIVVAPSQTLSDREYQMLRNTSLRIIRALGIEGGCNVQLALDPYSFQYYVIEVNPRVSRSSALASKATGYPIAKLAAKIAVGLTLDEIVNPVTQKTYACFEPALDYVVSKIPRWPFDKFESANRTLGTQMKATGEVMSIGRNLEESLLKAVRSLELGIYHLELDHLKELDKETMKKRIIKADDERLFIVAEAIRQGVTKEEINEWCEMDFFFLQKVENIVNMEREVKANVGNMEVLQTAKEMGFSDHYIAAAWNKTEREIYDMRKENNMMPVFKMVDTCAAEFESATPYYYSTYADENESIVTDRKSVVVLGSGPIRIGQGVEFDYATVHSVWAIKEAGYEAIIINNNPETVSTDFSISDKLYFEPLTIEDVMHIIDLEKPEGVIVQFGGQTAINLAAKLEEHGVKILGTSLEDLDRAEDRDKFEAALTKLGIPQPVGKTATTVEQAVAIAEEIGYPVLVRPSYVLGGRAMEIVYRQEELLHYMKNAVKVHADHPVLIDRYMVGKEIEVDAISDGENVFIPGIMEHIERAGVHSGDSIGVYPPQSLSEKLKEQIIEHTIALGKGLNIVGLLNIQFVVFKDQVYVIEVNPRASRTVPFLSKITGVPMANVATKVILGQDLVEQGYGTGYHPEEKEVYVKAPVFSFAKLRSVDTTLGPEMKSTGEVMGKDLTLEKALYKGLVASGINIPTHGSVIITVADKDKEEAMEIAKRFHEIGYNLLATAGTAQSLEEQNIPVQVVNKIDSEDYNLLDIIRQGKAQFVINTLTKGKQPARDGFRIRRESVENGVACLTSLDTTRAILRVLESMTFSAHSMKEITQTKRHEVVHA

SEQ ID NO: 24011 - protein, 275 aa, Arabidopsis thaliana
MSLFLKDDSIQIREVWNDNLESEMALIREVVDDFPFVAMDTEFPGIVCRPVGTFKTNTEYHYETLKTNVNILKMIQLGLTFSDEKGNLPTCGTDNKYCIWQFNFREFDLESDIYATDSIELLRQSGIDFVKNNEFGIDSKRFAELLMSSGIVLNENVHWVTFHSGYDFGYLLKLLTCQNLPETQTGFFEMISVYFPRVYDIKHLMKFCNSLHGGLNKLAELLDVERVGICHQAGSDSLLTSCTFRKLQENFFIGSMEKYSGVLYGLGVENGQIVH

SEQ ID NO: 24012 - protein, 448 aa, Bacillus cereus ATCC 14579
MCTGTKSFFLLQRFKLKEDVTMEQKPVLDVNEVPKPGKWLFLSIQHLFAMFGSTVLVPFLTGLNPSVALISSGLGTLAFLLITKGQVPAYLGSSFAFIAPIITAKTAGGPGAAMLGGLLAGLVYILISLGIKKSGSEWIMKLLPPIVVGPVVMVIGLALAHTAVNMAMNGADGKYSFTHFSVALVTLAITIICSIFGRGFFSIIPVLLGIIGGYIFAYFQGLVDLKPVAEAKWFVVPDFTVPFVTYTPEFSWKIVLLMVPVALVTISEHIGHQIVLGNVIKRDLIEKPGLHRSIFGDGVATLIASLIGGPPNTTYGENIGVLAITRAYSVYLFIGSAVFAIMFGFIGKISALIHSIPTPVMGGVSILLFGVIASSGLRMMVDDKTDLSDKRNLMIASVILVIGIGGAVLHVGESFQVEGMALAAIVGVLLNLLLPETKQIKQSKQIAS

SEQ ID NO: 24013 - protein, 449 aa, Prochlorococcus marinus str. MIT 9211
MPALSSTMTEGKIVEWLKNPGEKVARGEAVLVVESDKADMEVESFQDGYLAAVLMPAGSTAPVGEIIGLIVETEDQIAEVKAKNPTKDQASKEVSSSDSESSKQTLEVASQDQGSVLEVQASKKAESLPPRAVVNDGRIIATPRARKLASQLGVDLATVLGTGPHGRIQAEDVQTAQGQPITVPWVAESDAPARLEVFNSQAANTGAPQEETKVNEAPKGNSFGAPGETVSFNTLQQAVNRNMEASLSIPCFRVGYSINTDKLDIFYKQVKPNGVTMTALLAKAVGKTLARHPQLNAACSNEGMSYPEQVNVAVAVAMEEGGLITPVLQNADTTDLFELSRQWADLVKRSRSKQLQPNEYSSGTFTISNLGMFGVDRFDAILPPGTGAILAIAASIPQVVAAKDGSMAVKRQMQVNLTADHRVIYGADGAAFLKDLSRLIENNPEQLAT

SEQ ID NO: 24014 - protein, 2214 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRARVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 24015 - protein, 678 aa, Oryza sativa (indica cultivar-group)
MAASSAQLIFLLLLAVLAAASSRNDEEARALMALKESLDPAGRVLGSWARSGEPCGGSFVGVTCDSGGRVTAISLQGRGLSGTLPPAIAGLRRLTGLYLHYNGIKGAIPREIGSLSELTDLYLDVNHLTGPLPVEIAAMENLQVLQLGYNQLTGSIPPQLGKLNKLAVLALQSNQLTGAIPATLGDLTQLARLDLSFNSLFGSIPSKIAEVPLLEVFDVRNNSLSGSVPAGLRRLNGGFQYVNNKGLCGVGFSLLDLCLSSEDGLKPSKPEPFGPDGTVKTRQVPQSANTDNHCEGSGCSKSSNASVGVLVVGVVAVVIGAAFCGIFAFSYYRRQKQKIGSSLEVSDSRLSTDHYQQKEVCRRSASPLISVEYSNGWDPLSGGGVGSSGEVGDSFRFNLEEVECATQYFSEVNLLGKSGFAATYKGILRDGSVVAVKSLNKTSCKQEESDFLRGLKMLTVLRHENLVGLRGFCCSRGRGECFLVYDYMVNGCLSQYLDVKEGSGANVLDWPTRVSIIRGIAKGVEYMHSKKANKPSVVHQNISAEKILLDHHLTPRLSVPGLHKLLADDVVFSTLKASAAMGYLAPEYATTGRFTEKSDVFAFGIVVLQVITGRRAVSQLKVSTVANDLDSLIDENLNGVFSRTEAAKLAAIAALCTSETASQRPTMEAVVQQLSNCH

SEQ ID NO: 24016 - protein, 105 aa, Yarrowia lipolytica CLIB122
MATESAIKTIKEHIAKDKVFVASKSYCPYCKQTKQLLSQFKEAKPVILELDELDDGAELQAALAEITGQRTVPNVFIGGQHIGGNSDLQVLAQKDELADKIKAAL

SEQ ID NO: 24017 - protein, 867 aa, Frankia sp. EAN1pec
MHAEHHEPRKQPSSVTPAPTALPYPSEPDTDRAKIPDHADSPGHTENPDHPEKPDRLPGRRPWRRARRAPASPAADSSDNPASDNPPSGGAARHDPDGTGRPGSGGSAGRTLRGAWRHDLEASVVVFLVALPLSLGIAVASGAPVVAGIIAAVVGGVVAGAVGGVPLQVSGPAAGLTAVVAEIVATHGWRVACFVTAAAGVVQILFGLSRVARAALAISPAVVHGMLAGIGLTIVIGQIHVVLGGTAGSAAWDNLIVLPGEIVSPAVPAAALLGIAAIALTVVWTRLPRPLSSIPAPLAAVSIVTAASLPFDVPRVALPDDLLGAIALPELPAGGEWGAITLAVLTVALVASIESLLSAVAVEAMHSGPRGDLDRELLGQGAANTVSGLLGGLPVTGVIVRSSTNVRAGARTRASAILHGLWMAGFALLLAPLVGRIPLAVLAGLLVVIGIRLVDLAHIRAIARHGELAIYLTTVVGVVLFNLLEGVLIGIATALLLALRRTLVAPVHVHPPTGPGSPWRVVVEGALTFLSLPRLSRRLAEVPAGASVRLDLAVDYLDHGAHKMLDDWIAERHRAGATVTVDEVGAAPLAIPTVAARPREGRLSKSLFGGRSTGRHARSARPPRWLAPWSDWQHGQLHDRQHLLNGVDEFHRRTAPMIEPFLTELTSGQRPSTLFITCSDSRLVPNVITSSGPGDLFTVRTPGAFVPGPQAVGDSTLAAIEYAVEVLRVRTIAVCGHSGCGAVAALLDRGTPGHSGSIVGPLRNLEAWLRHGEPALARAARDAGGLPPEPDELSRVSVAQQLVALRGLSVVRRAEAEGRLQLVGMWFDIATARAIVLNESTDRFEIPTVSVVPALESGQRLADATRG

SEQ ID NO: 24018 - protein, 294 aa, Symbiobacterium thermophilum IAM 14863
MTKRRSTSRGPGRILGILGHPVAHSASPAMHNAAFAAQGMHAMYGAFDVPPSQLEKAIAGIRALGLLGVNVTIPHKEAVMAYLDDVAPTARQVGAVNTIVNRGGRLIGYNTDGWGFLLSLEERGVRVAGRNAVVLGAGGAARAVALHLGMAGVARLTIINRSRQRAEFLAADLARAKTPVRAEVADPGSEEARAALAEAGLVVNCTPLGMEPDTESTPLEDVGLLPAHCVVYDTVYRPLETRLLREARQHGLITVNGLAMLVHQGACAWEYWFGRRGPVDVMRTAALAALEGQP

SEQ ID NO: 24019 - protein, 301 aa, Arabidopsis thaliana
MDDMNPFYQSSGFMDLLQSQQEDMSQFASGSTEVPAFSSQLSEEGSELEGSEDEVKPKQSISRKKWTAKEDIVLVSAWLNPSKDPVIGNDQQAYVAASPSLDGLPKREHAKCKQRWGKVNKSVTKFVACYKTTTTHKTSGQSEDDVMKLAYEIYFNDTKKNFTLDHAWRELRYDQKWCEATSRKGDENAKRRKCGDGNASSHPIHVEDDSIMSRPPGVKAAKAKGRKSAIVKEGKKPATVKDDSGQSVEHFQNLWELKEKDWDRKEKQSKHQQLERLLSKTEPLSDIDLFLKNKLITDLWS

SEQ ID NO: 24020 - protein, 884 aa, Methanococcoides burtonii DSM 6242
MADNKFVYIFGNNETEGKNSMKDLLGGKGANLAEMSNLGIPVPVGFTITTEVCTLYLKNGQYPPGFEEHIDNAIKQLESTTKKNFGDLKNPLLLSVRSGARVSMPGMMDTVLNLGLNDDSVVGLAAKTGNERFAYDSYRRFLTMFANVVLDIDHEKFESTLSAMKKDKNVKQDNDLEVEDLKELVEKFKTIIKDEAGKEFPQNAREQLQMAIDAVFGSWNNQRAKTYRKLNGIPGEWGTAVNVQSMVYGNMGETSGTGVAFTRDPATGEKRFFGEYLINAQGEDVVAGIRTPQPIKALKNTMPKVYDQLVDIYMKLEDHFKDMQDIEFTIEKGKLFMLQTRTGKRTAAAAIKIATEMVEEGLIDKHTALLRVEPEQIDRLLHPNIDPTSAYEVMATGLPASPGAAVGEVVFTAEHAEEMAKNGEKTILVRAETSPEDIGGMNASEGILTVRGGMTSHAAVVARGMGKPCVAGCGEITIDIKEKVFNVGDYTVKEGDIISIDGSTGNVILGKVDLILPGVTDELETILTWADEVRTLKVRTNADTPHDAEVARDFGAEGIGLCRTEHMFFGEDRIPAVREMIMAEDIESRKLALKKLLPMQREDFIGIFKAMEGFPVTIRLLDPPLHEFLPNHEEVMEKLWELESSDASQEEMDRVKKIGERIEYLKEINPMLGHRGCRLGITYPEIYEMQAQAIIEAACELSKDGMKIVPEIMIPLVSHVKELEFVKKHITSIFESVMEEMGIKLDYMVGTMIELPRAVLTADQIAKEAEFFSFGTNDLTQTTFGFSRDDAGKFLPFYLESGILEDDPFAVLDQDGVGQLVKIGIEKGRATRPDIKIGICGEHGGEPKSVKFGHNVGLDYVSCSPFRVPIARLAAAHAVLENKQ

SEQ ID NO: 24021 - protein, 496 aa, Oryza sativa
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHALAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 24022 - protein, 526 aa, Medicago truncatula
MASSESNSQMKVVHGDAGYILEDVPHLSDYVPNLPTYPNPLRSNPAYSVVKQYFVHMDDTVPQKVVVHKDGPRGVHFRRAGPRQKVYFRSDDVIACIVTCGGLCPGLNTVIREIVCGLSYMYGVDKVLGIDFVKCARKGGYRGFYSKNTITLTPKVVNDIHKRGGTILGTSRGGHDTGKIVDSIQDRGINQVYIIGGDGTQRGAAVIYEEVRRRGLKVAIAGIPKTIDNDIPVIDRSFGFDTAVEEAQRAINAAHVEAESVENGIGVVKLMGRYSGFIAMHATLASRDVDCCLIPESPFYLEGKGGLYEFITKRLKESGHMVIVIAEGAGQDLLTESMQDMDQKDASGNKLLQDVGLWISHKIKDHFAKENKMAIVLKYIDPTYMIRAIPSNASDSVYCTLLAQSAVHGAMAGYTGFTAGLVNGRHTYIPFNRITEKMNNVVITDRMWARMLSSTNQPSFLKPKDVHQIMKAGQSPTQLLEGSNCNGGGEEAKKVEQIPTQLMEGDKSKDNQKSRNLADSDSCIKK

SEQ ID NO: 24023 - protein, 290 aa, Mycobacterium leprae
MTISAVPGTIILAIETSCDETGVGIACLDDYGTVTLLADEVASSVDEQARFGGVVPEIASRAHLEALGPTIRCALAAAGLTGSAKPDVVAATIGPGLAGALLVGVAAAKAYSAAWGVPFYAVNHLGGHLAADVYEHGPLPECVALLVSGGHTHLLQVRSLGAPIVELGSTVDDAAGEAYDKVARLLGLGYPGGKVLDDLARTGDRDAIVFPRGMTGPADDLNAFSFSGLKTAVARYVESHPDALPADVAAGFQEAVADVLTMKAVRAATGLGVSTLLIVGGVAANSRCAS

SEQ ID NO: 24024 - protein, 147 aa, Pseudomonas fluorescens Pf-5
MIRRPPLSLLDLEAAPLGSRWALTAVLDALPWNSDGLIAAIAQQHDSGEVLMLAWMNRQALGETLASGQACYWSRSRRCLWRKGESSGHRQRLIEARLDCDGDAVLLLVDQQGPACHTGRPNCFYNAIRDGAVEVISSPLKDSRHDS

SEQ ID NO: 24025 - protein, 668 aa, Prochlorococcus marinus str. MIT 9312
MVAASVSIESLCVNSIRMLAVDAVNKSNSGHPGLPMGCAPMGYALWQNILNHNPNNPKWFNRDRFVLSAGHGCMLLYSLLHLTGYKSVSIEDIKEFRQWGSKTPGHPETFETEGVEVTAGPLGAGISNAVGLAIAETHLAAKFNKPDCNIVDHYTYVIMGDGCNQEGIASEACSLAGHLKLGKLIALYDDNQITIDGRTDVSFTEDVLKRYEAYGWHVQHVEDGNHDVKGITEAIEKAKSITNKPSIIKISTTIGYGSPNKSDTAGIHGAAVGEEEASLTREFLNWEYPPFEIPDEVYKHFRKSIDKGENLEKEWDSRFEEYQKKYPSEGAELKRMLKGQLPENWDSDLPSYTPNDKGLATRKHSQICLGALGPNLPELIGGSADLTHSNYTDIKGETGSFQPHSPEKRYLHFGVREHAMAAVLNGIAYHNSGLIPYGGTFLVFADYMRGSMRLSALSELGVIYVLTHDSIGVGEDGPTHQPIETIPSLRAMPNMLVFRPGDGNETSGAYKLAIKNRKRPSALCLSRQGMPNQENTSIEKVALGGYIVADCEGTPDLIFIGTGSELNLCIEASKEISNLGKKTRVVSMPCIELFEEQEESYKESVLPNSVTKRVVVEAAHSFGWHKYTGFDGICITMDRFGASAPGGECMKNFGFTVENVVNKTKEIL

SEQ ID NO: 24026 - protein, 456 aa, Prochlorococcus marinus str. MIT 9312
MRSSWIKPRLGKDNVTQINFARNGYITEEMDFVAKKENLPASLIMEEVARGRLIIPANINHLNLEPMSIGIASRCKVNANIGASPNASDINEEVEKLKLAVKYGADTVMDLSTGGVNLDEVRKAIIHESPVPIGTVPVYQALESVHGSIDRLTEDDFLHIIEKHCQQGVDYQTIHAGLLIEHLPKVKGRITGIVSRGGGILAQWMLHHFKQNPLYTRFDDICEIFKKYDCTFSLGDSLRPGCLHDASDDAQLAELKTLGELTRRAWEHNVQVMVEGPGHVPMDQIEFNVRKQMEECSEAPFYVLGPLVTDISPGYDHISSAIGAAMAGWYGTSMLCYVTPKEHLGLPNAEDVREGLIAYKIAAHAADIARHRAGARDRDDELSHARYNFDWNKQFELSLDPERAKQYHDETLPEEIFKKAEFCSMCGPKHCPMNSKISDESLDQLKDKLEECNSSV

SEQ ID NO: 24027 - protein, 641 aa, Burkholderia pseudomallei K96243
MSTGAQTKAAAASQHADGPRLLADVGGTNARFALETGPGEITQIRVYPGAEYPTLTDAIRKYLKDAKIGRVNHAAIAIANPVDGDQVRMTNHNWSFSIEATRRALGFDTLLVVNDFTALAMALPGLTDAQRVQIGGGARRQNSVIGLMGPGTGLGVSGLIPADDRWIALGSEGGHATFAPMDEREDLVLQYARRKYPHVSFERVCAGPGMEIIYRALAARDKKRIAANVDTADIVERAHAGDALALEAVECFCAILGTFAGNLAVTLGALGGIYIGGGVVPKLGELFMRSPFRARFEAKGRFEAYLANIPTYLITAEYPAFLGVSAILAEQLSNRTGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVEQAIDILNNARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLVMIDILAVGVAIRRAAPNAELAEAMARAKARAGASAGDEAADVLDWLSHGAAPAAKD

SEQ ID NO: 24028 - protein, 389 aa, Campylobacter coli RM2228
MLTQRSQVLEESITLAITALANELKAKGEDVISFSAGEPDFDTPQTIKNAAIAAIEKGCGKYTAVAGIADVLKAIQNKLKKDNNLSYETSEIITNVGAKHSLFECIECLVEEGDEVIIPSPYWVSYPEMVKFAGGKPVFIEGLEENGFKINAEQLKKAITPKTKILMLNSPSNPVGSIYNKEELLSIAKVLEGTKIIVLSDEMYEKLRYDGFEFVAFASVSENALNRTVTINGLSKCGAMPGWRFGYMASKNKALISAVKRLQGQSTSNICSITQHAAIPAFNGECDEDIEKMRQAFEKRRDLALNMLHQIPNISVYKPEGAFYLFVNTQKIEKDSMKFCQKLLEQEKVAVVPGIGFGMDGYFRLSYATSDELIKKGIERIANFIKNYK

SEQ ID NO: 24029 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFINLNRSNVVL

SEQ ID NO: 24030 - protein, 222 aa, Brassica napus
RLVLQQIQILKKEISKSRLKLLEPLLKGPAGLEYLKKSFSSRYGSPDQAASSLPLTKRWLFSVRGEAEKEWDEHKDALSAVTNNNPGSSGLPSTTMRTGGNVPSVSKVNAPSSAFPGIELSECKGETVDLLVRLGLLKMVSEIGGLTLETIPETVQLNLTRLRAIQSQIQKIILVSISVLILQQTLASHKASDVETITWTCINRLYEMLDAKPDAGHSEIME

SEQ ID NO: 24031 - protein, 300 aa, Pneumocystis carinii
MEQYQRLEKIGEGTYGVVYKAKDLESGTIVALKKIRLEAEDEGVPSTAIREISLLKEMHNDNVVRLLNIIHQESRLYLVFEFLDLDLKKYMNSIPKDMMLGAEMIKKFMSQLVSGVKYCHSHRILHRDLKPQNLLIDREGNLKLADFGLARAFGVPLRGYTHEVVTLWYRAPEVLLGGRQYATALDIWSIGCIFAEMATKKPLFPGDSEIDEIFRIFRILGTPDENSWPGITSYPDFKATFPKWSPKNLGELITELDSDGIDLLQKCLRYYPAERISAKKALDHPYFDDFININRSNVVL

SEQ ID NO: 24032 - protein, 403 aa, Oryza sativa
DSLEEGFWFGLVWWFVRDFVGRRVMATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 24033 - protein, 85 aa, Oryza sativa (indica cultivar-group)
MVFVWLTAFFLVVALIVLVIYQLMCLADLEFDYINPFDSSSRINKVVIPEFVLQAALSVLFLLSGHWAMFLLSAPMVYYNYTLKH

SEQ ID NO: 24034 - protein, 475 aa, Oryza sativa (indica cultivar-group)
MAVTIQSVKARQIFDSRGNPTVEVDVGLSDGSFARGAVPSGASTGIYEALELRDGGSDYLGKGVLKAVSNVNTIIGPALIGKDPTEQVDIDNFMVQQLDGTSNNWGWCKQKLGANAILAVSLAVCKAGAMVKKIPLYQKLQHIANLAGNKTLVLPVPAFNVINGGSHAGNKLAMQVKYCLNNKTMSMHDSVIFSAHLAAVQEFMILPTGASSFKEAMKMGVEVYHHLKSIIKKKYGQDATNVGDEGGFAPNIQENKEGLELLKAAIAKAGYTGKVVIGMDVAASEFYSEKDKTYDLNFKEDNNDGSHKISGDSLKDVYKSFVSEYPIVSIEDPFDQDDWATYAKLTDEIGQQVQIVGDDLLVTNPTRVAKAISEKTCNALLLKVNQIGSVTESIEAVRMSKRAGWGVMASHRSGETEDTFIADLSVGLSTGQIKTGAPCRSERLAKYNQLLRIEEELGDAAVYAGEKFRAPVEPY

SEQ ID NO: 24035 - protein, 578 aa, Oryza sativa (japonica cultivar-group)
MELSSLAALLHSPLLLAVLLLVFSWLIVSSTKKRPPPPCGDGGRRLPLPPSPPGVPLLGHLPLLGTLPHRKLRSMAEAHGPVMLLRLGRVPAVVASSAAAAEEVMRTRDLAFASRPRVRMSERLFYGRDMAFAPYGEFWRQARRVTVLHLLSPRRVLSFRGVREQEVAALLDRVRRRCGGGGETVNLSDLLMSYAHGVISRAAFGHGGAHGFDGDEGGEKLRKLFADFEGLLGTMTVGEFVPWLAWVDKLTGLDAKVARTSAAMDGLLERVIADHRERRRSRGQAVGDGEADADHRDFVDVMLDVSEAEEGAGAGAGGVLFDTVAIKAVILSKKVPRVTCMNERFIEQDMMAAGTDSSFTTTEWVMAELINHPRVMRKLQDEIRAVVGTSSASAAAAATGGGQVTEDHLGELPFLRAVIKEMLRLHAPGPLLLPRETVEDTELLGYRIPARTRVIINVWAIGRDAAAWGDSAEEFVPERWLDGGGGGGVEYAQQLGKDSRFVPFGAGRRGCPGAGFAALSVELALANLLYHFDWELPPPAASGIMATTRLDMDELFGLSVRLKADLNLVAKPWSPGAS

SEQ ID NO: 24036 - protein, 267 aa, Methanococcoides burtonii DSM 6242
MLDFVGLGLFDEKDISLKGLEKIHNADKVYVEFYTSILMGTDLEKMEMLYKKKITVLSREDVEQHAEDWLVDAKDSNVVFLTGGDTMVSTTHVDLRLRAADMGIKTTLIHGASIASAICGLSGLQNYRFGKSVTIPHPYVSNRGVRVVSQTPYDTIKNNIEAGLHTAVFLDIDKDKGYMTVNQAMEILLEVEGKLGEGVMVDRLAVGIARAGSPSPVVKADYIEALRDYYLGGPLHIVVIPAELHFVEAEALVKLAGAPEGILENID

SEQ ID NO: 24037 - protein, 1145 aa, Pinus sylvestris
MVSISSDQACTIPKLYANFFLGSDIEFVRPDGRPEFFNADRFLSYYHSMTFAVNQEGQALLPGRKLLAMELHEPFFESWDPRHENPCKWTGVICSLDHENLVTEINIQSVQIAGNVPSQFAVLGSLRSLVISAANLTGSIPAEIGGYESLEILDLSGNRLRGNIPAEISKLKNLKSLILNSNQLQGSIPAEIGNCHNLVDLVVFDNQLSGKIPAELGRLANLEVFRAGGNENIEGTLPDELSNCTNLVTLGLAETNISGKIPLSFGSLKKLQTLAIYTAFLSGTIPAELGNCSELVNLYLYENRLSGAIPRELGKLQKLEKLYLWDNELDGSIPAELGSCSSLKFVDLSTNSLSGSIPDSFGSLKNLSELEITDNNVSGSIPAALANCTELTQIQLYNNQISGQMPAELGALKKLTVLFLWQNNLEGPIPSSLGSCDNLQSLDLSHNRLTGSIPPSLFEIKNLTKLLLLSNELTGALPPEIGNCVALSRLRLGNNRLLNQIPREIGKLENLVFLDLAMNQFSGSIPAEIGGCSQLQMLDLHGNRLGGELPRALGFLHGLQVVDLSANELTGLIPANLGNLVALTKLTLNGNALSGAIPWEISRCTNLQLLDLSLNRFSGQIPPEMGKCKRLEIALNLSWNNLSGSIPAQFSGLTKLASLDLSHNLLSGNLSALAQLSESCFSQHFFQRFFRVSARYQVFSDLCLPSDLSGNAALCTSEEVCFMSSGAHFEQRVFEVKLVMILLFSVTAVMMILGIWLVTQSGEWVTGKWRIPRSGGHGRLTTFQKLNFSADDVVNALVDSNIIGKGCSGVVYKAEMGNGDVIAVKKLWTGKESECEKVRERDSFSAEVNTLGAIRHRNIVRLLGCCTNGRSKLLMYDYMPNGSLGGLLHEKRSMLDWEIRYNIVLGVRRGLSYLHHDCRPPILHRDVKANNILLGSQYEPYLADFGLAKLVDSADFNRSSTTVAGSYGYIAPEYGYTMKITQKIDVYSFGVVLLEVVTGKQPIDPTIPEGVHLVEWARDAVQSNKLADSAEVIDPRLQGRPDTQIQEMLQVLGVAFLCVNSNPDERPTMKDVAALLKEIRHDCHDYNGKADLLLKQTPAPGSTRSPNPTADARSPVGSSFGLEYSSASTTAHESYSLHSSVSNVI

SEQ ID NO: 24038 - protein, 537 aa, Ornithobacterium rhinotracheale
MAEIIKMPRLSDTMEEGKVESWNKKVGDKVSYGDILAEIETDKAVQEFETDVEGTLLYIGVEAGQAAPVDSILAIIGAEGEDISGLVSGGGASQSAPAQEAAAPAEEPQAEAAPAAEVPENVTIVSMPRLSDTMEEGKVESWNKKVGDKVSYGDILAEIETDKAVQEFETDVEGTLLYIGVEAGQSAPVDSILAIIGPEGTDVSAIVAGGGAKPAAKAEAPKAEAPKQAAPAQEKKETPAPAAPKAQATNNSGRVFISPLAKKLADEKGYDINQIQGTGDNGRIIKKDVENFTPQAAAAKPAVAGPVALEVGEDTVIPNSQMRKVIAKRLSESKFTAPHYYLTIEVDMDNVMAARKQINQIPNTKVSFNDIVLKATAMAVKKHPVVNSTWKDNEIVQYAAVNIGVAVAVPDGLVVPVVKNTDLKSLSQISAEVKDLATRSRDRKIKADEMEGSTFTVSNLGAYGVESFTSIINQPNSCILSVGAIVEKPVVKNGQIVVGHTMKLCLACDHRTVDGATGSTFLQTLKQYLETPMSMLV

SEQ ID NO: 24039 - protein, 106 aa, Brassica napus
  misc_feature (13)..(15): Xaa can be any naturally occurring amino acid
  misc_feature (29)..(29): Xaa can be any naturally occurring amino acid
  unsure (1)..(106): unsure at all Xaa locations
MMDVEPVMCECCXXXEDCTQHYISEVKAXFAGKWLCGLCSKVVSDEVSRDLKQTTMEEALNAHVLFCGKFKANPAELVADGMKQMLRRRSGDMLPAKSKMFGRSKF

SEQ ID NO: 24040 - protein, 179 aa, Fritillaria agrestis
MASSATMLSSVATAACVAPAQASMVAPFVGLKSASAFPVTQKTVTGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 24041 - protein, 179 aa, Fritillaria agrestis
MAASSTMLSSVATAACAAPAQASMVAPFVGLKSTSAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVERPE

SEQ ID NO: 24042 - protein, 173 aa, Flaveria pringlei
MASIPATVATVAQANMVAPFTGLKANAAFPVTKKVNDFSTLPSNGGRVQCMKVWPPLGKKKYETLSYLPDLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPGGF

SEQ ID NO: 24043 - protein, 178 aa, Flaveria pringlei
MASISSTVATVSRAAPAQANMVAPFTGLKSNVAFPATKKANDFSTLPSNGGRVQCMKVWPPLGKKRYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPEGF

SEQ ID NO: 24044 - protein, 179 aa, Fritillaria agrestis
MASSATMLSSVATAARAAPAQASMVAPFVGLKSASAFPVTQKPATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTDAAQVVKEAAECKKEYPAAFIRVIGFDNVRQVQCVSFIVEKPE

SEQ ID NO: 24045 - protein, 179 aa, Fritillaria agrestis
MASSATMLSSVATAACAAPAQASMVAPFVGLKSASAFPVTQKTATGLSTLPSNGGRVQCMKVWPIVGLKKFETLSYLPTLSVESLLKQIEYLIRNGWVPCLEFSLEGFVSRDNNKSPGYYDGRYWTMWKLPMFGCTGAAQVVKEAAECKKEYPAAFIRVIGFDNVRQVQCVSFIVEKPE

SEQ ID NO: 24046 - protein, 227 aa, Phalaenopsis hybrid cultivar
IKRIENTTNRQVTFCKRRNGLLKKAYELSVLCEAEIALIVFSSRGRVYEYSNNSIKATIEKYKKTCAGSSNPGSLVEVNSHQYYQQESAKMRHQIQLLQNSNRHLMGDGLSSLNLKELKQLENRLERGITRVRSKKHELLFAEIEYMQKREVELQNDNMYLRAKIADNERAQQANIVQAGVDFESIPSFDSRNYYHINMLESASHYSHHQDQTALHLGYETKADQSA

SEQ ID NO: 24047 - protein, 1020 aa, Gibberella zeae PH-1
MSSPTKRSTRSSATPRRSGRNPEPNQASGPGNSQLEVPSSPLPYPSSSPGPSGQNDLPRGVSSPFAQMMSSQSTRARSNIPSSPFHQMTESQSDIDPQRTPRANPTTPAYHGGSSPVRYDPSSSPGRSLRHQSELRSEASGLFVGSQIGSPAPHRRGDINSDAARTPRASRRVILDDVGRVVREGPADGSDVASFANRDPNTSEADVLGGQGQSLIWGTTVSIDDTFASFKDFLRNFTQKYRMYRDGASDEDVQNDPDAESKPYWEALENMLLLGTTRLYLDISDLNLYPPTRKLWHQIQAYPQEIVPVMDQSVHDMMVEIARTETMRNRSQSTAGHQASQHSTQSSEPNFPSSDRPEEAPTPRAQPDQQQASLEDQVASSIYVLRPFGLDKTTNLRDLNPSDMDRLISIKGLVIRTTPVIPDMKDAFFRCNVCNHSVNVGLDRGKIREPTECPREICKSKNSMLIIHNRCSFEDKQVIKLQETPDAVPAGQTPHSVSVCVYNELVDFCKAGDRVELTGIFRVSPVRVNPAQRAVKSVHKTYVDVLHIQKVDKRRMGADPSTLGIAGEEDAEAGENGIEETRKISIEDEEKIRETAARDDIYDLLSRSLAPSIYEMDDVKKGILLQLFGGTNKSFQKGGSPKYRGDINVLLCGDPSTAKSQMLSYVHKIAPRGVYTSGKGSSAVGLTAYVTRDPETRQLVLESGALVLSDGGVCCIDEFDKMSDATRSVLHEVMEQQTVSVAKAGIITTLNARTSILASANPIGSRYNPDLPVPQNIDLPPTLLSRFDLVYLMLDTADEKNDRRLAKHLLSLYLEDKPQSAPTDNDILPVEFLTLYISYARSKIQPVISQEAAQELVECYVAMRALGQDVRSADKRITATTRQLESMIRLAEAHAKMRLAETVTRDDVREANRLIQSALKTAATDANGRIDMSLLTEGTSAADRKRREELRTAILHLLDEMTAGGNTVRWGDVFRRLSEGASIPVEQSEFNEVMRALEAENALMIMGEGARRTIRRVNVA

SEQ ID NO: 24048 - protein, 427 aa, Burkholderia pseudomallei K96243
MSNNQTLFERAQRTIPGGVNSPVRAFRSVGGTPRFVARAQGAYFWDADGKRYIDYIGSWGPMIVGHVHPDVLAAVQRVLADGFSFGAPTEAEIEIAEEICKLVPSIEQVRMVSSGTEATMSALRLARGFTGRSRIVKFEGCYHGHADSLLVKAGSGLLTFGNPTSAGVPADVAKHTTVLEYNNVAALEEAFAAFGGEIAAVIVEPVAGNMNLVRGTPEFLNALRALTAKHGAVLIFDEVMCGFRVALGGAQQHYGITPDLTCLGKVIGGGMPAAAFGGRGDIMSHLAPLGGVYQAGTLSGNPVAVAAGLATLRLIQAPGFHDALADKTRRLADGLAAEARAAGVPFSADAIGGMFGLYFTEQVPASFADVTKSDIERFNRFFHLMLDAGVYFAPSAYEAGFVSSAHDDATLDATLDAARRAFAALRA

SEQ ID NO: 24049 - protein, 331 aa, Penicillium chrysogenum
MASTPKANVPKIDVSPLFGDNMEEKMKVARAIDAASRDTGFFYAVNHGVDVKRLSNKTREFHFSITDEEKWDLAIRAYNKEHQDQIRAGYYLSIPEKKAVESFCYLNPNFKPDHPLIQSKTPTHEVNVWPDEKKHPGFREFAEQYYWDVFGLSSALLRGYALALGKEEDFFSRHFKKEDALSSVVLIRYPYLNPYPPAAIKTAEDGTKLSFEWHEDVSLITVLYQSDVANLQVEMPQGYLDIEADDNAYLVNCGSYMAHITNNYYPAPIHRVKWVNEERQSLPFFVNLGFNDTVQPWDPSKEDGKTDQRPISYGDYLQNGLVSLINKNGQT

SEQ ID NO: 24050 - protein, 256 aa, Yarrowia lipolytica CLIB122
MTREDNIYLARLSEQAGRYEDMVEYMKEIATGDQELSVEERNLLSVAYKNVIGAHRAWWRVVSSCEQKEEQKGKETKIIDDFRQKIEAGLQDICHDILNVLEKHLIPKLEKPSAEATEAAAKDGADPSELSESIVFYYKMKGDYYRYLAEFTTDDKRKEAAEKSLQAYQFASDEATSKLPPTHHIRLGLALNFSVFYYEILNSPERACQLAKQAFDDAIADIDSITEERSKDYALIMQLLRDNLTLWTNNDEPEQA

SEQ ID NO: 24051 - protein, 416 aa, Burkholderia pseudomallei K96243
MRARGARPLFAFLPRFDSTMNTAADSLLRLASRVDAIEPFYVMEIVKEAAVLERAGRDIIHMSIGEPDFTAPEPVVDAAAAALRRGVTQYTSALGIAPLREAIAAHYARAHGLSIAPERIVVTAGASAALLLACLALVGRDDEVLMPDPSYPCNRHFVATAEGRAVLVPSGPETRFQLTADDVKTRWGERTRGVLLASPSNPTGTSLEPAELGRIIDAVRARGGFSIVDEIYQGLSYDGAPVSALSFGDDVVTVNSFSKYFNMTGWRLGWLVVPPALVGTFEKLAQNLFICPSALAQHAALACFEPDTLAIYEARRAEFRRRRDFIVPAIESLGFKVPVMPDGAFYVYAQCGGVAHPAAGDSAALVNAMLHDAGVVLVPGMDFGVHAPRDYIRLSYATAYSRLEEAVERLGKLFGR

SEQ ID NO: 24052 - protein, 407 aa, Oryza sativa
MGVSASCLWGGSESRGNQNGSAAVTSPRSGQVISRAGSNGRVFSLKELKLATRNFHMMNCIGRGGFGAVYKGNLKDGTQIAIKKLSAESKQGANEFLTEINVISNVRRPNLVKLIGCCDEGTNRLLVYEYAENNSLAHALLGPRSRCIPLNWQKRAAICIGTAPGCRILHEEAQPRIVHRDIKASNILLDKKLLPKIGDFGLAKLFPDTITHISTRVAGTMGYLAPEYALLGQLTKKADIYSFGVLVLEVISGESSSKSTWGQDMNVLVEWTWKLREQGRLLEIVDPELEEYPEEEMLRFIKVALVCTQATSQQRPSMKQVVDMLSNPTEISLENLVAPGVLKEPRHHSSSSGLTPDTTSNRSTKANPADSYSTQTRDMNSYQLSTIEVSLSKSNFAPFAKLQGPKL

SEQ ID NO: 24053 - protein, 221 aa, Methanococcus vannielii
MAKARIGHFVEAQVLESIGVDMIDESEVLTPADEINHINKKAFTAPFVCGARNLGEALRRIDEGAAMIRTKGEAGTGNVVEAVKHMRAVNEGIARVVGYHEMGLEAELVQMARNELKVPMEIILEVAKLKRLPVVNFAAGGIATPADAALMMQMGCDGVFVGSGIFKSGNPEIRAKAIVEATYNFDKPELIGEVSKNLGEAMVGINIDQIPEEMLLAKRGI

SEQ ID NO: 24054 - protein, 206 aa, Schizophyllum commune
MALCGSSKGRGRGRPIQRKVVVCGDGACGKTSLLNVFTRGFFTQVYEPTVFENYVHDLYIDDQLVELSLWDTAGQEEFDRLRSLSYAETHVIMICFSVDNPTSLENVESKWLDEILEYCPGVKLVLVDSKCDLRDDPAVLDRLQRYGTHTDQYEEGLGVARRIRASRYLECSSKHNRGVNEVFLRGRARVTVHSIRQGSAGSCCVM

SEQ ID NO: 24055 - protein, 718 aa, Arabidopsis thaliana
MVVATTIALYASPASTVCSTAHQINAHISCDLDLNSRSSSASSSTSSPTIGGLSLLFSGASVKSSSSSSSSHPSVGEELASIRHDRSEDRTLSGSFCYSPSKFIGSSYLKRDHQSPVSVLHGPISSGNSPPMRISRDRNLDGGSALRVGSSRLFNGFVRKAIGSCVDYDTDSVLVDEQLPFTMDDGFEGERRQPYARDLLRRAQLKHKIFEDESVIKAFYEAEKAHRGQMRATGDPYLQHCVETAMLLADIGANSTVVVAGILHDTLDDSFMSYDYILRTFGSGVADLVEGTSSPPPPPQLSKLARENNTACKTVEADRLHTMFLAMADARAVLIKLADRLHNMMTLYALPPVKRQRFAKETLEIFAPLANRLGISSWKVKLENLCFKHLHPDQHHEMSDMLEDSFDEAMITSAIEKLEQALKKEGISYHVVSGRHKSLYSIYCKMLKKKLTMDEIHDIHGLRLIVDNEKDCYKALGVVHKLWSEVPGKLKDYISHPKFNGYQSLHTVVMGDGTIPLEVQIRTKEMHLQAEFGFAAHWRYKEGDCKHSSFVLQMVEWARWVVTWHFETMSKDGSSICSSEPLCSFPSHAEDCPFSYKPSGNQEGPVYVIVIENEKMTVQEFPENSTVSDLLRRAGPGSSRWSMYSIPAKEELRPRLNQTPVSDLKCKLKMGDVVELTPAIPDKSLTEYREEIQRMYDRGLAFSRPHRAATGTMVGWGS

SEQ ID NO: 24056 - protein, 173 aa, Flaveria pringlei
MASIPATVATVAQANMVAPFTGLKSNAAFPVTKKVNDFSTLPSNGGRVQCMKVWPPLGKKRYETLSYLPNLTESQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 24057 - protein, 178 aa, Flaveria pringlei
MASISSTVATVSRAAPAQANMVAPFTGLKSNAAFPATKKANDFSTLPSNGGRVQCMKVWPPLGKKKYETLSYLPNLTEAQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 24058 - protein, 173 aa, Flaveria pringlei
MASIPATVATVAQANMVAPFTGLKSNAAFPVTKKVNDFSTLPSNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 24059 - protein, 94 aa, Picea glauca
  misc_feature (6)..(6): Xaa can be any naturally occurring amino acid
  unsure (1)..(94): unsure at all Xaa locations
DICRIXLAEQAERYEEMVEFMEKVTKGVEVEELTVEERNLLSVAYKNVIGARRASWRIIWSIEQKEESRGNDEHVVTIREYRSKVESYLSACSA

SEQ ID NO: 24060 - protein, 304 aa, Xylella fastidiosa Ann-1
FRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGKLTHIAWNHQVQVMVEGPGHVPMQLIKANMDKQLAACGEAPFYTLGPLTTDIAPGYDHITSAIGAAMIGWYGTAMLCYVTPKEHLGLPNLQDVHDGIIAYKIAAHAADLAKGHPAAQVRDDALSKARFEFRWQDQFHLSLDPEKAMALHDESLPKEAHKRAAFCSMCGPQFCSMKISQEVRDASSTELSDANKDTNTSDGI

SEQ ID NO: 24061 - protein, 180 aa, Spinacia oleracea
MASSVLSSAAVATVSRTPAQASMVAPFTGLKSTVGFPATKKNDDITSLASNGGRVQCMKVWPTQNMKRYETLSYLPPLTTDQLARQVDYLLNNKWVPCLEFETDHGFVYREHHNSPGYYDGRYWTMWKLPMFGCTDPAQVLNELEECKKEYPNAFIRIIGFDSNRQVQCVSFIAYKPAGY

SEQ ID NO: 24062 - protein, 182 aa, Fagus crenata
MASSMISSATVATVSRATPAQATMVAPFTGLKSTAAFPATRKSNNDITSLASNGGRVQCMKVWPPLGLQKFETLSYLPPLSIESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPAK

SEQ ID NO: 24063 - protein, 187 aa, Capsicum annuum
MASSVMSTATVATGANAAQASMIASFNGLKSAASFPVTRKQDLDITSIASNGGRVECMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEATKFSMFNV

SEQ ID NO: 24064 - protein, 411 aa, Clostridium thermocellum ATCC 27405
MKYVIIGNSIAAVGAVEGIRKIDTEGEITIIGKEPYHVYSRPLISYLLYGKTDEERMKYRGSSFYDTMNCKVILGREAVKINDAKKEVVLDNGEVINYDKLLVATGSLPFVPPMKGLEGVEKRFSFLSLDDAKKLESAISPSSKVLIIGAGLIGLKCAEGISKKVESITVVDLADRILSSILDKDGAEIVKSHIEKENIKFVLNAKVEEFINSNEALLDSGEKVEFDVLVVAVGVIPNTGLIKDINGKVNRGIVVDEFCQTSIPDIYAAGDCCESFDITSEQNRVLALLPNAYMQGECAGINMAGGKKEFGKAIPMNAISFFGLHIITAGSYVGEVFSKINGDNYKKLFVKDGLLKGYIMIGDVDKAGIYTSLIREKTPLSEIDFELIFERPGLMAFTRKERQRMLGGVVR

SEQ ID NO: 24065 - protein, 175 aa, Aegilops tauschii
MAPTVMASSATSVAPFQGLKSTAGLPVSRRSNGASLGSVSNGGRIRCMQVWPIEGIKKFETLSYLPPLSTEGLLKQVDYLIRSKWVPCLEFRKVGFIFREHNVSPGYYDGRYWTMWKLPMFGCPAPTQVIPEVEEVRKEYPDPYCRIIGFDNMRQVQSVSFIASKPPGCEESGKA

SEQ ID NO: 24066 - protein, 174 aa, Hordeum vulgare
MAPTVMASSATSVAPFQGLKSTAGLPVSRRSNASSASVSNGGRIRCMQVWPIEGIKKFETLSYLPPLSTEALLKQVDYLIRSKWVPCLEFSKVGFIFREHNASPGYYDGRYWTMWKLPMFGCTDATQVLNEVEEVKKEYPDAYVRIIGFDNMRQVQCVSFIAFKPPGCQESGKA

SEQ ID NO: 24067 - protein, 440 aa, Clostridium thermocellum ATCC 27405
MSYNIKIKEVLEFVEENDVKFIRLAFCDILGIPKNISIMPQELERAFEQGISFDASSILGFMNVEKSDLFLHPDPSTLSILPWRPQQGRVIRFFCDIKHPDGSAFEGDSRNILKKAVERAEKMGYACRIGSECEFYLFETDEKGRPTYIPHDEGGYLDMAPLDKGENVRREICLSLEQMGIQPESSHHEQGPGQHEIDFKYSDALTAADDLMTFKTVVKAVASRNGLFASFMPKPILTESGSGLHINISLSKDGFNIFKERNYDSSAAKSFIAGVIDKILDITAFANPITNSYARLGSFRAPKYVSWSHQNRSQLIRIPAETGEYSRMELRSPDPACNPYITFALILHAGLDGIERKLELPGPINQNLYNAGADELQNIKALPQNLKEALDVASKSSFVRNILGEEMLSKYLEIKLKEWNMYFESEDRESVEKQMYFKII

SEQ ID NO: 24068 - protein, 183 aa, Amaranthus hypochondriacus
MASSMLSNAAMATTAATAGAQASMVAPFNGLKSFATFPITKKSSNDFSSLPSNGGRVQCMQVWPPVGKKKFETLSYLPPLSDAQLLAQVQYLLNKGWIPCIEFELEHPFVYRENHRSPGYQDGRYWTMWKLPMYGCTDPAQVLNEVEEAKKAYPSAFIRIIGFDNKRQVQCVSFIAYKPAGGL

SEQ ID NO: 24069 - protein, 618 aa, Chlorobium tepidum TLS
MTTPLPELSEQAQALSQKLPASAMKKAKEHGFSDFQIATIFQTSEAAVRELRNHYGVISVFKTVDTCAAEFDASTPYHYSTYDEENESVRSDKKKVIILGGGPNRIGQGIEFDYCCVQAVFALRESGYETIMVNCNPETVSTDYDIADKLYFEPLTFEDVIRIIEHEQPLGVIVSFGGQTPLKLSTKLDKAGVHILGTSSDGIDLAEDRKRFGALLEKLDIPHPEYGTATTFAEAQEITNRIGYPVLVRPSYVLGGRAMKIIYNDDSLKEYVDQALFITEKYPLLIDRFLETAVEFDIDALADSTDCVISGIMQHVEAAGIHSGDSTSILPYYNIDPAAIATMKEYTRKLAEHIGVIGLMNVQYAVQNGKVYVIEVNPRASRTVPFVGKATAIPVVKIATRIMLGEKLCDLRKEFNLKDCDELGLKHMAIKEPVFPFSKFVKSGVYLGPEMRSTGEAMSLAESFPEAFAKAYQAANMHLPLSGTVFISVNDQDKNQRIINIARELYRMDFDLVATAGTHAFLTQHGIDCKKIFKVGEEGRPNIFDIIKLGKIDFVINTPRGERALHDEEAIGSASVQNGVPFVTTIEAAEASVRAIDCIRCQEFGVKSLQEYATYRDQ

SEQ ID NO: 24070 - protein, 304 aa, Vibrio sp. Ex25
MKIDWKGVYPAVSTQFRQDQSIDLDATQTVIDNQIKDGVNGIICLGTVGENCALFPEEKRQVLQAAKEVVNGRVPLIAGTAESITTAAVDYMQDAYKIGIDGCMVMPAMVYRTSESETFEYYRTLAEATPEMPIMIYNNPVAYGVDVNLDIMAKLAEFESIVAIKESTTDTRRITELYNKFDDRFTVFSGVDDIALESLMLGATGWISGLTNAFPEESVAIYKLASQGRYAEALEIYRWFLPLLRLDTIPTLVQCIKLAEQVCGRGSEQVRAPRQLLQGEERQQVIQMVEHALETRLDLSKYNL

SEQ ID NO: 24071 - protein, 351 aa, Ostreococcus tauri
MRGIDATTNGDDDDVNETEEVPTVSLELYEGDFNEFVVRLGEAYTKYGFVILENHGIPQEMIERAMGRSRAFFECDEVKKKKYTLRGLGGARGYTAFGVEQAKGASKPGACDRCFGDTLTDKDDSYARVDLKEFWHLGRDLPPGHKYEASMPPNVDEVVEVEGFSEVNKQIFNALDALGNRVLEALAVHLEQPRDYFSDKTNEGNSILRIIHYPPIPPDAAGRVRAGAHEDINLITLLLGADEGGLQILRKDGKWLDVNPPPGCVTCNIGDMLQRLSNHKLPSTTHRVVNPPVERAHLPRFSMPFFLHPNPDFVIETLESCISDENPNRYPEPISSDDYLQERLREIKLKS

SEQ ID NO: 24072 - protein, 509 aa, Dehalococcoides sp. BAV1
MPELLTDDLNALLEVLPPHIRQPLTDPANRENLIEIVMDLGRTPEARFPDREIILSERDVTQEDIDYVSSRTGDFGDDNRAGIERTLHRISAIRNRKGKIVGLTLRVGRAVFGTIKIIQDLIKSDQSVLMLGRPGVGKTTMLREVARVLAGDLKKRVVIVDTSNEIAGDGDIPHPAIGHARRMQVRTPDMQHAVMIEAVENHMPQVIVIDEIGTELEALAARTIAERGVQLVGTAHGNVLDNLMLNPTLSDLIGGIQSVTLGDEEARRRGTQKTILERRAPPTFQVIVEIQDRNKVAVHPDVGAAVDSILRGVSPSAEIRYLDGNGEVVISKQQPSEEKVKSAPESLPVFRGKELPIMYLFGVNRSRMEEIAREMHLDIRISERLEQAQLMVTSRNYYRSKPQRVRDAENMNIPIYVLKSHTPGQFQQLLATLSGRDVAYAVEKPPEIDVAIHEAEEAVAQVKTSHIPVELSPQGAYIRRFQHIIAEKEHLSSHSLGREPHRRVRISRG

SEQ ID NO: 24073 - protein, 305 aa, Thiomicrospira crunogena XCL-2
MERGVLAEMIQQFEVTGVHLSMREQLMMIEVENDFAKATITPHGASVLSFVPKSGNASGQDLLWVSDAAVYTGEKPVRGGIPICWPWFGPSQEAGLPAHGFVRNRVWHLDSVRNLEAGVTEVILMLESDDASLAVWPHAFRLELKIEIGTELVMTLITHNLNDHDIEVTEAFHSYFTVSDAESIQVDGLVHSFCYDKLTNADPVEQTESLKITPPIDSVFIDQLAPIKIKDAQLQRNICIEKGNGRSAVVWNPGPEIIKGFADMPNDAWPTMLCVEAGNVLQNAVWIPSGEKHKFIMKLYAEDFH

SEQ ID NO: 24074 - protein, 132 aa, Triticum aestivum
  misc_feature (106)..(106): Xaa can be any naturally occurring amino acid
  unsure (1)..(132): unsure at all Xaa locations
DDALTARNNGAQGIGLCRTEHMFFASDERIKAVRQMIMAPTLELRQQALDRLLPYQRSDFEGIFRAMDGLPVTIRLLDPPLHEFLPEGNIEDIVSEYCLRRDQQEXMPSRELKAFRINPMLGFRGCSLGNRT

SEQ ID NO: 24075 - protein, 82 aa, Arabidopsis thaliana
  misc_feature (2)..(3): Xaa can be any naturally occurring amino acid
  misc_feature (8)..(10): Xaa can be any naturally occurring amino acid
  misc_feature (14)..(14): Xaa can be any naturally occurring amino acid
  misc_feature (20)..(20): Xaa can be any naturally occurring amino acid
  misc_feature (22)..(22): Xaa can be any naturally occurring amino acid
  misc_feature (33)..(34): Xaa can be any naturally occurring amino acid
  misc_feature (39)..(39): Xaa can be any naturally occurring amino acid
  misc_feature (43)..(43): Xaa can be any naturally occurring amino acid
  misc_feature (45)..(45): Xaa can be any naturally occurring amino acid
  misc_feature (53)..(53): Xaa can be any naturally occurring amino acid
  misc_feature (60)..(60): Xaa can be any naturally occurring amino acid
  misc_feature (62)..(62): Xaa can be any naturally occurring amino acid
  misc_feature (66)..(66): Xaa can be any naturally occurring amino acid
  misc_feature (69)..(69): Xaa can be any naturally occurring amino acid
  misc_feature (71)..(74): Xaa can be any naturally occurring amino acid
  misc_feature (76)..(77): Xaa can be any naturally occurring amino acid
  misc_feature (80)..(80): Xaa can be any naturally occurring amino acid
  unsure (1)..(82): unsure at all Xaa locations
SXXLSSAXXXASPXQATMVXPXNGLKSSAAFPXXRKANXDITXIXSNGGRVNXMHVWPPXGXKKFXTLXYXXXXTXXELXKE

SEQ ID NO: 24076 - protein, 742 aa, Deinococcus radiodurans R1
MEWGEDADGPVHLVVGIAAASDEHLQILRRLTRVLGDEALVERLWTTTDAGDLIEALTGERPVAAAAAAPGLPYSAQVTLPNPQGLHARPATLLAGMVKKAGAKARLTRDDGRSADATKLMELLSLGLTRGTPLTVSTDQQALLRPLVDAIQSGLGDDLSAAAPQAAAPPTTRTPDWVPQQVGAALEGVGAADGLVVGTTRQHLQRSLTVTDEPADPAQGAAQLDAALQAAAADLDSMMADVHARFGADKAAIFAAHKELLADEGTVQDAVSRILDGHGPAWAYQQATNERIAQLQKLDDPVLAGRASDLGDVQRRVLRHLLGLGEDTVQTGAAPVILLAPDLTPSDTARLGPDTLLGFATAQGGPTSHTAIIARGLGLPAIVAAGAGVLEVPDGTLAILDGSAGRLYLNPSENDVQAARERMAVLTAEREAARAARHQPGGTRDGVRVEIAANINRAADAAGALDAGAEGVGLMRTEFLFLERDSAPSEANQEQEYRAMAAALGERPLIIRTLDIGGDKEVPYLGLAREDNSFLGMRGIRLCFERPDLFLPQLRAIARVAKDHPNVHVMFPMIATLEDFRRARAILDEVRAEVGAPHIPLGVMIEVPSAALLAEALAPEVDFFSVGTNDLTQYTLAMDRLHPQLARQTDAMHPAVLWLIKRTVNAAQRHGKWVGVCGGAAGDDVGALVLTGLGVKELSVSTPQVAAVKAALRGRSSQDLQQLAAQALTQTDAAAVRALVRG

SEQ ID NO: 24077 - protein, 583 aa, delta proteobacterium MLMS-1
MCTIVVTYNEAQPEVLRAMAKAVHHRGPDSLEICCHGNHGVAACRLTILGDPKAPMIYHDPHSGRIILLNGEIYNYSELWQELNKVGIVAGTDLEAELISRLYSVHGPQFAQRLKGMFAIAILDEANLVLIRDRFGIKPLYFTRHGQRILVSSEIKGILAHPGITPILNHSSFQETRVFGYVSSPEQTFFENIQQVQPGQVLVFNAAGREHATTFGAIPKAHFVNGQPEPDYEESVVITRETILKAVERMFGHGEMDKGVFLSGGIDSSTIALVASLHSGRKLQTFTLADSNETPDLLAARQVAEALKTDHHEYIVTSDDYWRWLPDYVAHYEGLMAGGVFHIQGGLAFHILAQYISKHVKVAFSGEGADELFGGYYWIHTHPLGFSDRIRKNLTAVKGNAALTATVNTLFPPPEDATVYQKNLFDFLLKGGLSNYHLQSVDRSAGAFGMEIRPFYLDDDLSQWAASLPIEYKVPNKQTTKRILRDAFRQDFQKLGLETVLTRQKMGMPSALANLDKEINEKVERAVTAEDLAGHPYGAILGSKMNLLLFDLFEHIFFKGWNHHSALPPSDSYLARVWPTYST

SEQ ID NO: 24078 - protein, 335 aa, Streptococcus suis
VVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTILGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 24079 - protein, 514 aa, Arabidopsis thaliana
MSFLSFSPISLDLLSSNVFLTILAIIISGLLKTITYRKHNSNHLNLPPGPPGWPVIGNLFQFTRSGKQFFEYVEDLVKIYGPILTLRLGTRTMIIISDASLAHEALIERGAQFATRPVETPTRKIFSSSEITVHSAMYGPVWRSLRRNMVQNMLSSNRLKEFGSVRKSAMDKLIERIKSEARDNDGLVWVLQNSRYAAFCVLLDICFGVEMEEESIEKMDQLMTAILNAVDPKLHDYLPILTPFNYNERNRALKLRRELVDFVVGFIEKRRKAIRTATVSSFSYLDTLFDLRIIEGSETTPSDEDLVTLCSEFLNAGTDTTGAAIEWGIAELIANPEIQSRLYDEIKSTVGDRAVDERDVDKMVLLQAVVKEILRRHPPTYFTLSHGVTEPTTLSGYNIPVGVNIEFYLPGISEDPKIWSEPKKFDPDRFLSGREDADITGVAGVKMMPFGVGRRICPGMGMATVHVHLMIARMVQEFEWLAYPPQSEMDFAGKLVFAVVMKKPLRAMVRPRVQ

SEQ ID NO: 24080 - protein, 115 aa, Buchnera aphidicola str. APS (Acyrthosiphon pisum)
MFSIIQNIEKEQIKKNIPVFRSGDTIEVKVWVIEGSKKRLQSFEGIVIAIKNRCLNSSFTVRKISNGEGVERVFQTHSHGIEEILVKRKGLVRKAKLYYLRTRTGKAARIKERLN

SEQ ID NO: 24081 - protein, 672 aa, Methanococcoides burtonii DSM 6242
MDSLIYLAPLAGIVSLAFAAFFASGVLKEGTGTKEMQDISLAIQEGAMAYLNRQYKTVAVVAIILAALMFFLLGDDSGKIVIGFIVGAAASALAGYVGMNVSIRANVRTAHAASKSLQEAMSVAFRGGAVTGLAVVGLALLGTSGFYILFGDVDLVIGFGFGASLISLFARVGGGIFTKAADVGADLVGKVEAGIPEDDPRNAAVIADNVGDNVGDCAGMGADLFETYVVTVLASMLLGSLILEQFPNAILYPLILGAVAIFASIISMFFVKVGKDGKIMKALYKGVAVSAILSMIAFYFVTDSLMGDVRLYYASLVGIIIMVLMVIFTEYYTSTSFRPVKTIAKASETGAGTNVISGLAIGFESTALPLIIIIAGILASFFVVGGATDPSMGVYGIAIAAAAMLSTTGMIVALDSYGPITDNAGGIAEMAKMPAEVRKITDALDAVGNTTKAVTKGYAIASAALGALALFADYRHKVNLEAGSLSLENPIVLVGLLIGALLPFLFTAVTMKAVGKAAFAIVNEVRRQFREIPGIMEGTAKPEYGKCVDIVTAAAIREMVIPGILAIFVPLLVGIVLGPEALGGLLIGIIVSGLLLALTMNNGGGAWDNAKKLIEDGQYGGKGSDAHKAAIVGDTVGDPFKDTSGPALNALIKVVNMIAILFSSLFIGKGLF

SEQ ID NO: 24082 - protein, 178 aa, Glycine tomentella
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYRENHRSPGYYDGRYWTMWKLPVFGCTDASQVLKELQEAKTAYPNGFIRIIGFDNVRQVQCISFIAYKPPSF

SEQ ID NO: 24083 - protein, 744 aa, Arabidopsis thaliana
MRNFAMLLLLILLLHSLASFPICFARLFPMSLPFTRSKAHQMHFFHPYLNPSVAPTPSPAFSPNPSRIPPLRHKGHHRHRRWHLRRNATAVSPSSHDCQQTCVEPLTSTPFGSPCGCVFPMKVQLLLSVAPFSIFPVTNELEIEVAAGTYLEQSQVKIMGASADSENQGKTVVDINLVPLGEKFDNTTATLIYQRFRHKKVPLNETVFGDYEVTHISYPGIPSSSPNGDVTGDAPGGLPIPINATTFANKSQGIGFRTIAIIALSGFVLILVLVGAISIIVKWKKIGKSSNAVGPALAPSINKRPGAGSMFSSSARSSGSDSLMSSMATCALSVKTFTLSELEKATDRFSAKRVLGEGGFGRVYQGSMEDGTEVAVKLLTRDNQNRDREFIAEVEMLSRLHHRNLVKLIGICIEGRTRCLIYELVHNGSVESHLHEGTLDWDARLKIALGAARGLAYLHEDSNPRVIHRDFKASNVLLEDDFTPKVSDFGLAREATEGSQHISTRVMGTFGYVAPEYAMTGHLLVKSDVYSYGVVLLELLTGRRPVDMSQPSGEENLVTWARPLLANREGLEQLVDPALAGTYNFDDMAKVAAIASMCVHQEVSHRPFMGEVVQALKLIYNDADETCGDYCSQKDSSVPDSADFKGDLAPSDSSWWNLTPRLRYGQASSFITMDYSSGPLEDMENRPHSASSIPRVGGLILPNRSGPLRPMRSRRNFFRLRGSMSEHGGPSSSRHLWSGNGDWL

SEQ ID NO: 24084 - protein, 319 aa, Oryza sativa (japonica cultivar-group)
MLISTGDLSKSKSKNLDRISGGLVGDHEKYSVATALLSKGLDDEASMPHEASAAAYDFYGHGGGAGDGILQASPEASSCKSQLSQMLLQAAASSPRSCVTTSGLGSSMMDFSNTAAVAPAAEPELTRKHHAGQSDNSSECNSTETGSALKKARVQASSSAQFTQKVIFHARPLSIFSRLCIVMGCHMLHSVSPKLNQRFSEVCTPYDSNPMPAKVRKERLGDRITALHQIVSPFGKTDTASVLQETIGYIRFLLGQIEALSYPYLGQCCSANPMQQQTGIMAGERSTDGLFPEFPAGQLLNCSSSQHINAPADNSCRPE

SEQ ID NO: 24085 - protein, 178 aa, Glycine tabacina
MASSMISSPAVTTVNRAGAGTVAPFTGLKSMAGFPTRKTNNDIASIASNGGRVQCMQVWPTTGKKKFETLSYLPDLDDAQLAKEVEYLLRKGWIPCLEFELEHGFVYREHHRSPGYYDGRYWTMWKLPMFGCTDASQVLKELQEAKTAYPNAFIRIIGFDNVRQVQCISFIAYKPPSF

SEQ ID NO: 24086 - protein, 182 aa, Betula pendula
MACSMISSATVAAVSRASPAQSSMVAPFTCLKSTSAFPVTQKTNNDITSIASNGGRVQCMQVWPPLGLKKFETLSYLPPLSSEQLAKEVDYLLRKNLIPCLEFELEHGFVYREHNRSPGYYDGRYWTMWKLPMFGCNDSSQVLKELEECKKAYPSAFIRIIGFDNKRQVQIISFIAYKPPGV

SEQ ID NO: 24087 - protein, 623 aa, Medicago truncatula
MAKSKNNAKKLSYISVPSQIINSISSSSIQSLLDDQTPKKSSTKIASNFFFTTLTKWKNPSRLFFLFTLFFLGGFALFMIGFNLKTPFSKSPCATNVEKSLISNGFGSKSELKVVSMNKNEILNGGVLVKSELGVVQNPSISNGFDSKSELGVVSVNKDEVLNDGSLSNSLPLITNVMLQAKVPSGVDLEDEEKGEGVEKGEFWKQPDGLGYKPCLDFSKDYRRESDGIVKNRKRYLMVVVSGGMNQQRNQIVDAVVIARILGAALVVPILQVNVIWGDESEFADIFDFEHFKNVLANDVRVVSSLPSTHLMTKPVEGSPPLHVTPSWIRSRYLKRFNREGVLLLRSLDSRLSKDLPSDLQKLRCKVAFNALRFAKPVQELGNKIAERMQSKGPYLALHLRMEKDVWVRTGCLPGLSPEFDEIVKNERIQRPELLKGRSNMTYHERKMAGLCPLTAMDVTRLLKALGAQKDARIYWAGGQPLGGKEALHPLIHEFPHLYNKEDLALPGELEPFAKKASLMAAIDYIVSEKSDVFMPSHGGNMGHALQGHRAYAGHKKYITPNKRQMHPYFLNPSLPEAEFNSIVKELHQNSLGQPELRTSKVGRDVTKYPVPECMCNDSHNDS

SEQ ID NO: 24088 - protein, 561 aa, Triticum aestivum
  misc_feature (456)..(456): Xaa can be any naturally occurring amino acid
  unsure (1)..(561): unsure at all Xaa locations
MGSVAADAPEAPVATETVFRSRLPDIEIPAHLTLQDYCFERLPEVAARPCLIDGQTGAVHTYAEVEQLSRRCAAGLRRLGVGKGDVVMNLLRNCPEFAFVFLGAARLGADTTTANPFCTPHEIHRQASAAGARLIVTEACAVDKVRAFAAERGIPVVTVDGPASGDGGCLAFDDALLPAEPLAADELVDPDDVVALPYSSGTTGLPKGVMLTHRSLVTSVAQQVDGENPNLYFGPNDVLLCVLPLFHIYSLNSVLLAGLRAGCAIVIMRKFDHGALVSLVRAHAVTVAPFVPPIVVEIAKSDRVTAADLASIRMVMSGAAPMGKDLQDAFMAKIPNAVLGQGYGMTEAGPVLSMCLAFAKEPFGVKSGSCGTVVRNAELKIVDPDTGASLGRNLPGEICIRGNQIMKGYLNDPESTKNTIDKDGWLHTGDIGYVDDDDEIFIVDRLKEIIKYKGFXQVPPAELEALLITHAEIKDAAVVSMQDELTGEVPVAFIVRIEGSEISESEIKQFVAKEVVFYKRIHKVFFADSVPKSPAGKILRKDLRAKLAAGFPGSGSTQSKS

SEQ ID NO: 24089 - protein, 173 aa, Flaveria pringlei
  misc_feature (63)..(63): Xaa can be any naturally occurring amino acid
  misc_feature (172)..(172): Xaa can be any naturally occurring amino acid
  unsure (1)..(173): unsure at all Xaa locations
MASIPATVAAVAQANMVAPFTGLKANAAFPVTKKVNDFSTLPSNGGRVQCMKVWPPLGKKKYXTLSYLPNLTEAQLAKEVDYLLRNKWVPCLEFELEHGFVYRENARSPGYYDGRYWTMWKLPMFGCTDSVQVMKELQECKKEYPQAWIRIIGFDNVRQVQCISFIASKPDXF

SEQ ID NO: 24090 - protein, 173 aa, Flaveria pringlei
MASIPATVATVAQANMVAPFTGLKSNAAFPVTKKVNDFSTLASNGGRVQCMKVWPPLGKKRYETLSYLPNLTEVQLAKEVDYLLRNKWVPCLEFELEHGFVYRENARSPGYYDGRYWTMWKLPMFGCTDSAQVMKELQECKKEYPQAWIRIIGFDNVRQVQCISFIASKPDGF

SEQ ID NO: 24091 - protein, 204 aa, Oryza sativa (japonica cultivar-group)
MQGRMVTWSMASVIVAAACIFLSCSASVAHGRRFVRSSSYDKPCKEMRLYLHDILYDYSNSTSNSTSAAATKPTALATAVPSTGGTFFGQVVVFNDPMTEGRALPPSLEETAVRAQGVYLYNSKEAFNAWFAFSIVFNSTGRRGTLNLMGADIIAEKTRDISVVGGTGDFFMSRGVATLRTDAFEGFTYFRLQMDIKLYECYVV

SEQ ID NO: 24092 - protein, 180 aa, Musa acuminata
MVSSMMVSSAATFTRASPAQSSMVAPFTGLKSASAFPVTRKPNADLSHLPSNGGRVQCMKVWPIEGVKKFETLSYLPTMKDEALVKQIEYLLRSKWIPCLEFCPKGFVWRENHRSPGYYDGRYWTMWKLPMFGCTDAVQVAKEVEECKKEYPHAFIRIIGFDNNRQVQCISFIAYKPTGY

SEQ ID NO: 24093 - protein, 471 aa, Clostridium thermocellum ATCC 27405
MFPLGYNYIITLFANNILKGVVNMSKITFPKDFIWGSATAAYQIEGAYNEDGKGESIWDRFSHTPGNIADGHTGDVACDHYHRYEEDIKIMKEIGIKSYRFSISWPRIFPEGTGKLNQKGLDFYKRLTNLLLENGIMPAITLYHWDLPQKLQDKGGWKNRDTTDYFTEYSEVIFKNLGDIVPIWFTHNEPGVVSLLGHFLGIHAPGIKDLRTSLEVSHNLLLSHGKAVKLFREMNIDAQIGIALNLSYHYPASEKAEDIEAAELSFSLAGRWYLDPVLKGRYPENALKLYKKKGIELSFPEDDLKLISQPIDFIAFNNYSSEFIKYDPSSESGFSPANSILEKFEKTDMGWIIYPEGLYDLLMLLDRDYGKPNIVISENGAAFKDEIGSNGKIEDTKRIQYLKDYLTQAHRAIQDGVNLKAYYLWSLLDNFEWAYGYNKRFGIVHVNFDTLERKIKDSGYWYKEVIKNNGF

SEQ ID NO: 24094 - protein, 431 aa, Dehalococcoides sp. BAV1
MTQLKQARKGIVTPEMEAVAKTEGLQPEFILKGIADGNIVIPVNKLRKNLKLCGIGKGLSTKVNANIGTSTDFGSVASEVEKLKMAEMVGADTIMDLSTGPKINTIRKAILENTCLPLGTVPVYQAAVEAKDRYGAMVKMTADDLFGAIESQAREGVDFVTVHCGVTRQVIDTFKGQGRLTDIVSRGGTFTAGWMVFHGAENPLYEHFDRLLDICREYDVTLSLGDGLRPGCIADATDRAQVAELLVLGELVKRAREAEVQVMVEGPGHVPLNQIEANVRLQKSICEDAPFYVLGPLVTDIAPGYDHITGAIGGAIAAAAGADFLCYVTPAEHLSLPDVTDVRNGVIASRIAAHAADIVKGVNGAAERDRQMAIARKKLDWETQLKLSLDPEHARVTRDRFKTRGKACSMCGDFCAMELAEKHLGVSVSRC

SEQ ID NO: 24095 - protein, 178 aa, Zantedeschia aethiopica
MASSMMVSTAAVSRTSPAQSNMVVPFAGLHSSAAFPVTRKFADSSKLPSNGLRVRCMQVWPPEGKKKFETLSYLPPLTREQLGQEVDYLIRNGWIPCIEFCKVGFVYREYHNSPGYYDGRYWTMWKLPMFGCTDSSQVLKEVDECSKAYPDYFNRIIGFDNTRQVQCISFLTYKPEGN

SEQ ID NO: 24096 - protein, 795 aa, Clostridium thermocellum ATCC 27405
MKAPIDWLKDYVDINVSTKELADAMTMSGSKVEGIEVQGEEITKVVVGKILSLEKHPDADRLQVAKVDVGSEVLQIVTGAQNVNVGDYIPVALVGSTLPGGKKISKGKLRGVESYGMMCSIEELGLTRDDCPDAPEDGIYILPKEEELGKDIKEVLGLNKEIIEFEITSNRPDCLSIIGLAREAAVTLKTKFKRPVINVKEEGDDASQYISVEVKDTGLCPRFAARVVKDVKIGPSPKWMRDRLKAAGVRPINNIVDITNYVMLEYGQPMHAYDIKDIKGNKIIVRRAFDGEIIKTLDDQDRELDSSMLVIADEERAVGVAGVMGGANSEIKDDTKTIVFEAANFNGTSVRLTAKKLGMRTEASGRFEKGLDPENVEAAINRAAQLVEELGIGTVCKGMIDCYPEKKEPRIIKLRVDKINSLLGTNIPKEEMIDILRALEFEVDENNMTVKVPTFRDDVEREADIAEEIARFYGYNNIEATLLSGKTATQGRKTYKQTIEDLIKETMIACGLCETYTFSFTSPKVFDKLNLPADSELRKAVVISNPLGEDYSIMRTTTIPDMLAVISTNYNRRIEEARLFEMSKVYIPKSLPLEELPEEKTVLTLGMYGELDFYDLKGVVEELLERLGIKNYDVSPEKNNVVFHPGRTALINIDGEYAGIIGEIHPEVAEKFECPERTYIGVIEVETLVRKASMDCQYKGLPKYPAVTRDIAMLVKDEVMVKEIEDIIKQRAGKILESVKLFDVYKGKQVPEGMKSVAYSITFRASDRTLTDEEVGKAMTKILDGLKRNLGAELR

SEQ ID NO: 24097 - protein, 401 aa, Chlorobium tepidum TLS
MKKIGILTSGGDCGGLNAVIKGAALMALNKGLELYVIPNGYAGLYNLLNQDRLVRLDEARLDQFQASFAGSEAGHSRVKIKAISNPDKYNRIKVGMKKFDLDALIISGGDDSGSVMIDLNHNGIQCIHCPKTMDLDLQTYSVGGDSTINRIAQFVEDLKTTGRTHNRVLVTEVFGRYAGHTAFRSGVAAEADCILIPEIPVDWDVVYEHIVERFTRRIRQSDVHSGTYTIVVAEGMKNADGTDIVDESAGIDAFGHKKLAGAGKYVCQEIKKRFKTDPRMPQFMKDTGMFVEGIYEIPEVREVHPGHLVRAGHSSAYDINFGFEAGAAAVLLLLEGKTGVTISKVKGRKIEYIEASKAIEQRYVDLDQVAMYESIGTCFGRTPAAYEPILREVDGVYERIY

SEQ ID NO: 24098 - protein, 394 aa, Rhodobacter sphaeroides 2.4.1
MRALTWHGKHDVRVETHPDPEIVNPRDAIIEVTATAICGSDLHLYDGVIPGLMSGDILGHEFMGRVVETGPKSTLKKGQRVVVPFTISCGQCFFCEHQLFSACDNSNPAEKQDLSEPLYGHAVSGLFGYSHLTGGYPGGQAEYVRVPYSDVGPIVIPDGLEDEQVLFLSDILPTGWMAAENAGIEEGDTVAVWGCGPVGLFAIQSALLMGAGKVIAIDEYPKRLALARRLGAEVIDFRRTKVLEALMEMSGGLGPDAVIDAVGMEAHGFMPDTLMDNMKQRVGIGADSGHALREAILAVRKGGRVSVPGVYGGFLDKFPLGALMEKGLTVKTGQTHVQRYTEELLRRIGEGEIDTTFLISHRLPLEEAARGYENFRFNQNEWTKVVLKPGLTGA

SEQ ID NO: 24099 - protein, 127 aa, Triticum aestivum
VSNVIDLGTVAHAALSTVSVIIYFCCFVMGFGPIPNILCAEIFPTRVRGLCIAICALTFWIGDIIVTYSLPVMLNAIGLAGVFGIYAVVCLIAFVFVFLKVPETKGMPLEVITEFFAVGAKQAAAKA

SEQ ID NO: 24100 - protein, 484 aa, Prochlorococcus marinus str. MIT 9211
MAGRFSQQHKRLRPNSNEDAVIKRAQEHFERSLVEISGSISGSVAALEHPANNDALNYGEIFLRDNVPVMIYLLTQNRYDIVKKFLTVCLDLQSTTYQTRGIFPTSFVEENGELIADYGQRSIGRITSADASLWWPILCWLYVRKSKDTNFGVSQQVQRGVQLLLDLVLHPTFEGTPVLFVPDCSFMIDRPMDVWGAPLEVEVLLYACLSSCIELMDLSSKHQVSRLLDQRLLLTRQWVHDLRQFLLKHYWVTSKTMQVLRRRPTEQYGEDQHQNEFNVQPQVVPSWLQDWLENRGGYLIGNIRTGRPDFRFYSLGNSLACMFGVLTAPQQRALFRLVLHNRQHLMAQMPMRICHPPMEVEEWQNKTGSDPKNWPWSYHNGGHWPSILWFFGASILMHEKRYPKADVLLMGQMRTLLEECYWSQLNQLPKQKWAEYFDGPTGTWVGQQSRTYQTWTIVGFLLLHHFLKVCPDDISMLDLDLEKT

SEQ ID NO: 24101 - protein, 502 aa, Leymus chinensis
SAIPRRGLFIGGGWREPTLGRRIPVINPATEDTIGDIPAATVEDVELAVAAARSAFLLDGGSRWSRASGATRAKYLNAIAAKIKEKISYLALLETVDSGKPKDEAVADMDDVAACFEYYAGLAEALDGKQHAPISLPMEEFKTYVLKEPIGVVGLITPWNYPLLMATWKVAPALAAGCTAVLKPSELASLTCLELGAICEEIGLPSGVLNIITGLGADAGAPIASHPHVDKIAFTGSTATSKTIMTAAAQMVKPVSLELGGKSPLVIFDDVADIDKAVEWAMFGCFFNGGQVCSATSRLLLREKIAERFLDRLVEWAKNIKISDPLEEGCRLGSVVSKGQYEKIKKFISTARSEGATILHGGDRPKHLGKGFFIEPTIITDVSTSMQIWREEVFGPVICVKVFKTESEAIELANDTHYGLAGGVISDDLERCERIAKVIHSGIVWINCSQPTLVQAPWGGNKQSGFGRELGEWGLENYLSVKQVTRYCKDELYGWYQRPSKL

SEQ ID NO: 24102 - protein, 241 aa, Prochlorococcus marinus subsp. pastoris str. CCMP1986
MRKSVIAGNWKMHMTCADTKKYLEEFLPLIEEIPNDRKIVIAPPFTAISTFSNYTNFDYLNIASQNIHWEDKGAFTAEISPNMLIEHKVKYAIVGHSEPRKYFSESDEQINKRAVFAQSSGLTPIVCVGETLEQRERGEADRVITRQVEQGLENTDPSNLIVAYEPIWAIGTGKTCEASDANKICALIRSLIGFSDVIIQYGGSVKPNNIDEIMSMSDIDGVLVGGSSLDPISFSRIANFE

SEQ ID NO: 24103 - protein, 192 aa, Ostreococcus tauri
MRTATTRRVASLATMERTTTRGRSRAGVAREAASSTRATGSEVRVEDLFPEGERRGIILYDGVCNLCNGAVNFAIANDGNGGQGGSVRFAALQSETGRRLLRNAGRDAEDISSIVFVEAANSEASYVKSEAVLRIAKRMRAPFPQLAAIGSVFPRALGDLAYDLVADNRYFILGRRDECRLGDDVHDDRFLR

SEQ ID NO: 24104 - protein, 502 aa, Leymus chinensis
MASPAIPQRQLFIDGEWRAPALGRRLPVINPTTEASIGEIPSGTSEDVDAAVAAARAALKRNRGRDWSRAPGAVRAKYLRAIAAKMIERKADLARLEALDCGKPLDEAAWDMDDVAGCFEFFAGHAEALDKRQNAAVSLPENFKCHLKKEPIGVVSLITPWNYPLLMATWKVAPALAAGCTAVLKPSELASVTCLELADVCKEVGLPPGVLNVVTGLGPEAGAPLSSHPDVDKVAFTGSYATGQKIMVAAAPTVKAVTLELGGKSPIVVFDDVDIDKAVEWTLFGCFWTNGQICSATSRLLIHKNIAKEFVDRMVAWSKNIKVSDPLEEGCRLGPVVSEGQYEKIKKFISNAKSEGATILTGGVRPKHMEKGFFIEPTIITDINTSMEIWREEVFGPVLCVKEFSTEEEAIELANDTHYGLAGAVISGDRERCQRLAEEIDAGCIWVNCSQPCFCQAPWGGNKRSGFGRELGEGGIDNYLSIKQVTEYTSDAPWGWYKAPAN

SEQ ID NO: 24105 - protein, 399 aa, Glycine max
  misc_feature (144)..(144): Xaa can be any naturally occurring amino acid
  misc_feature (258)..(258): Xaa can be any naturally occurring amino acid
  unsure (1)..(399): unsure at all Xaa locations
MESRVLSRAGTLSSLPHLRKPPREAVSSASLVAVKAVGSVADGGNLIWGRQLRPELCSPVLKREAVLLRPCLAAASLAGRGLLPAGFFDKYPALVTGFFFFTWYFLNVIFNILNKKIYNYFPYPYFVSVIHLFVGVAYCLVSWXAVGLPKRAPIDSNLLKLLIPVAVCHALGHVTSNVSFAAVAVSFTHTIKALEPFFNAAASQFILGQSIPITLWLSLAPVVIGVSMASLTELSFNWVGFISAMISNISFTYRSIYXKKAMTDMDSTNIYAYISIIALIVCIPPAVILEGPTLLKHGFNDAIAKVGLVKFVSDLFWVGMFYHLYNQVATNTLERVAPLTHAVGNVLKRVFVIGFSIIVFGNKISTQTGIGTAIAIAGVALYSFIKARMEEEKRQAKAA

SEQ ID NO: 24106 - protein, 351 aa, Arabidopsis thaliana
MTTICDLPRDLVARILSRVPLTSMRRVRFTCKRWNTISKDPSFAKTHFGKAARQFIMMSQSRVSLMSVKLHGDGNEDELADPYIYEGYRLDVYALGYDKNLKNHKILRFVDSYEPAVKHSIIEHEIFDLKSNAWRVLDATPDWEIDSYQRGVSLKGNTYFFAKEKIVVEGDDVVVIEDFKDFLICFDFTSERFNLDHVCLYRFTLTMERPVREEQLAVLYQQDTCLMEIWVTNKIEPDVVSWSKVFLAVDMEPLTGSFIPFAFFAGSFFIDEEKKIAVVFDKDQEEINDRAYLIGENGYYKEVDLGYMNGYYQQQVDPRGPDPVFPLVCSYSPSLVTIPQGTRGKRKERDY

SEQ ID NO: 24107 - protein, 258 aa, Glycine max
  misc_feature (107)..(107): Xaa can be any naturally occurring amino acid
  misc_feature (112)..(112): Xaa can be any naturally occurring amino acid
  misc_feature (181)..(181): Xaa can be any naturally occurring amino acid
  unsure (1)..(258): unsure at all Xaa locations
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKIXDFGLXRAFGIPVRTFTHEVVTLWYRAPEILLGSRQYSTPVDIWSVGCIFAEMVNQRPLFPGDSEIDELFKIFRXIIMGTPNEDTWPGVTSLPDFKSAFPKWQPKDLKNVVPNLEPAGLDLLSSMLYLDPSKRITARSALEHEYFKDIKFVP

SEQ ID NO: 24108 - protein, 510 aa, Streptococcus pyogenes SSI-1
MENHKNEFTFSNKSIIAYVWRGVVVGIIAGVIVSLFRLLIEVTADWVIEWYRYAHINSLLLLPILSVSLLAVLFVGFLVKSDSDIKGSGIPHVEGELKGLMSPDWWSILWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPAYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 24109 - protein, 574 aa, Yarrowia lipolytica CLIB122
MTTIIHKSTFPDIELFQGSITDFIRTGAYAEDDYKPCMIDAETGEQLTQKQILDCADQFRSLLYQHGVQKTPNRDERIGDVVIPFIDNNIYLPAIHYACLELGCCMNPASTQQTPLELSKQIRVTDPKVIIYQRKYRKTVMHAIDLVCYTNFPIVIEFETMLFLRNSVPPPPKKAKFHITSTEQARKRIAYLGMSSGTSGKSKAVRLSHHNIVACSQVSQVTFPALYKASNVCVAVLPSCHVFGLYIFFMVLPRSGGTTIMHTKFDLKQLLESQKKYKANFLPLVPPIAVQLAKNPMVKNYADSLKQVKLIMSAAAPLGAEVTQSLIKAIGPQVRVVQGYGMTETSPCVTLFDPADPHLHIKACGKLVPNCEVRIVADGVDQPAYSGSVSDVAKNKTDNLPVGEIWVRGPQVMDGYHKNKSATSEAFVEANDSSVCYNTKWLRTGDVGLVDSLGRFMIVDRTKEMIKSMSKQVAPAELEDMLLAHADVSDAAVIGVENEAKGTEQIRAFLVLKKGGDALEVKKWMDSKLPKYKQLHGGVVVIDQIPKSQAGKILRRMLRLRQDDVVLGTDQAKL

SEQ ID NO: 24110 - protein, 279 aa, Triticum aestivum
  misc_feature (38)..(38): Xaa can be any naturally occurring amino acid
  unsure (1)..(279): unsure at all Xaa locations
MLWFTGTQNSPLLTCGMEDATRRWNIESGECIHVYRKXGLGLTSCGWFPDGKQILCGLSDQSLCLWDLDGKEADCWKGQRSSKTSDFAVTKDGKVIIIMNRDSTILLFNRDTKQERLIEEDNTITSFSLSDDGDFLLVNLISEKIHLWNIRNDPSRVKQYIGHKRSRFVIRSCFGGSDQAFIASGSEDSKVYIWHRATEDVIETLSGHSGAVNCVSWNPTNPHMLASASDDHTIRIWGVKKASTKRKDIGSSSSSNGTHMNGSANGNGFVHQCNGSRSK

SEQ ID NO: 24111 - protein, 120 aa, Triticum aestivum
ATYHYYRPAQNNWDLGAPAVSAYCATWDASKPLSWRSKYGWTAFCGPAGAHGQAACGKCLRVTNPATGAQVTARIVDQCANGGLDLDWDTVFTKIDTNGIGYQQGHLNVNYQFVDCRDNN

SEQ ID NO: 24112 - protein, 128 aa, Thiomicrospira crunogena XCL-2
MREIISTDKAPQAIGTYSQAVKVGSTVYLSGQIALIPETMEVKEGDISERIHQVFNNLSAVCEAAGGTLQDIVKLNIFLTDLSHFATVNEIMAQYFQQPYPARAAVGVKELPKGTDVEMDGVLELSSY

SEQ ID NO: 24113 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLRHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 24114 - protein, 223 aa, Buchnera aphidicola str. APS (Acyrthosiphon pisum)
MNLNKLKKKAAWAALDYIDPGTIIGVGTGTTIFYFIEALGTIKNLIYGAVSSSNSSTVLLKKHGIEVFDLKNFSSLAIYVDSADEINNHMQMIKGGGGALTREKIIASMSKKFVCIIDKSKKVDVLGTFPLPIEIIPMALSYIFREMIKIGGTPKYRKNVITDNGNIIIDVYNLCIKDPISMEKKINSLPGVVTVGLFASRSADIVLIGTQKGIRTINKKENR

SEQ ID NO: 24115 - protein, 434 aa, Buchnera aphidicola str. APS (Acyrthosiphon pisum) [sequence omitted]

SEQ ID NO: 24116 - protein, 590 aa, Arabidopsis thaliana
MAFGYSPSYCSFWRTLLGLYCLFTLVHTVISTPPEDPVKCVSGNTNCIVTNSLGAFPDRSTCRAANVAYPTTEAELVSIVAAATKAGRKMRVTTRYSHSIPKLTCTDGNDGLFISTKFLNHTVQADAKAMTLTVESGVTLRQLIAEAAKVGLALPYAPYWWGVTVGGMMGTGAHGSSLWGKGSAVHDYVTEIRMVSPGSVNDGFAKIRVLSETTTPNEFNAAKVSLGVLGVISQVTFELQPMFKRSLKYVMRNDLDFNDEALTFGKKHEFADFVWLPSQGKVVYRMDDRVAVNTLGNGLYDFFPFRSQLSAVLATTRSSEETQETLRDAHGKCVTATTISSTLFSTSYGLTNNGITFTGYPVIGSQNRMMSSGSCLDGLEDKLTSACAWDSRVKGVFYHQTTFSIPLTQVKSFINDIKSLLKIDSKSLCGLELYYGILMRYVTSSPAYLGKETEAIDFDITYYRANDPLTPRLYEDFIEEIEQIALLKYNALPHWGKNRNLAFDGVIKKYKNAPAFLKVKESYDPNGLFSSEWTDQILGIKGNPTIVKDGCALEGLCICSDDAHCAPSKGYLCRPGKVYKEARVCTHVPK

SEQ ID NO: 24117 - protein, 436 aa, Streptococcus thermophilus LMG 18311
MYRVFKEYFDIVNNVKYDVNDMPKVGLLVGLSFQHLFAMFGATVLVPILVGIDPAIALFSSGLGTLAHLTVTKYKIPAYMGSSFAYIAAMQMLMKTDGIGAVAQGAMAGGLVYLIVALVVKYVGNAWIDRVLPPIVVGPIIIVIGLSLAANAVKDATMVNDTYSIFSLVISMVTLFSVILFNMYGKKIIGVIPILLGLIVGYIFSVVLGWLTGHEFVQFSKVAAAHWFQVPSFDIPFVNYDFKLYPSAILTMAPIAFVTMTEHFGHVMVLNSLTGRDYFKDPGLDRTLTGDGLAQIIAGFFGAPPVTSYGENIGVMALSKVYSVYVIAGAAVIAVLMSFIGKVSALLSSIPTAVLGGISIALFGVIAASGLKILVEHKIDFDNKKNILIASVILVSGIGGLMIDLGGFQITGVASSTILGIVLYQILPDPNKGSKN

SEQ ID NO: 24118 - protein, 708 aa, Dehalococcoides sp. BAV1
MDLSWLVWTAGLIAVLFALYLIRDVMRRDSGTPAMQDIAGRILEGAVAFLRRQYRTIAILAVVAAVAVGAVVGLLGGERGLEAYGITGIGIAWRTALAFLAGALCSGISGVIGMYISVKSNLRCAAAAAKGGLSEAVTVAIRGGAVSGFLIVALSLLGVAGIYYMYGGNPEVTPHLIIGFGFGASFVALFAQLGGGIYTKAADMGADLVGKVEAGIPEDDPRNAAVIADLVGDNVGDCAGRGADLFESTAAENIGAMILGITLYLATGNAAWVLFPLVVRAFGILASIVGIMFVRGKDNESPMNALNRGYFTAVGLSIIGIFIANQTIGGDLWLFGAGVIGILTSVAMVFITQYYTEFRYKPVQEIANASRTGAATNIVSGTAVGLETAMPTAITIGAALLLSYWMGGQTGIAGGAVFGTAAATMGMLMTCPFILAMDTFGPITDNANGVIEMAGVGGKVRKITDRLDAVGNTTKALTKGYALASAGLAAFLLFEAYLERVAFLRGETEMMAVDLSRIEVFVGGLLAVALVFFFSAVAIKAVGRTASKIIEEVRRQFKADPGILAGTSRPDYARAVDITAAAGLREMIFPGLLPVLSPIVLGVFLKLTGYDSAMAIAGFLMVGTIGGIMMAAYLNNSGGAWDNAKKYIETGEMLEKDGSPVLKHTVTHAATVVGDTVGDPFKDTAGPSIHVLIKLLSTITLVLAPLFI

SEQ ID NO: 24119 - protein, 1059 aa, Streptococcus thermophilus LMG 18311
MPKRSDIKKIMVIGSGPIIIGQAAEFDYAGTQACLALKEEGYSVVLVNSNPATIMTDKEIADKVYIEPITLEFVTRILRKERPDALLPTLGGQTGLNMAMELSKAGILDELGVELLGTKLSAIDQAEDRDLFKQLMEELEQPIPESEIVNTVEEAVAFATEIGYPVIVRPAFTLGGTGGGMCANEEELREIAENGLKLSPVTQCLIERSIAGFKEIEYEVMRDAEDNALVVCNMENFDPVGIHTGDSIVFAPTQTLSDIENQMLRDASLKIIRALKIEGGCNVQLALDPHSFKYYVIEVNPRVSRSSALASKATGYPIAKLAAKIAVGLTLDEMINPVTGTTYAMFEPALDYVVAKIPRFPFDKFEHGERRLGTQMKATGEVMAIGRNIEESLLKACRSLEIGVYHNEMSELAEVTDDALVEKVVKAQDDRLFYISEAIRRGYTIEELSELTKIDIFFLDKLLHIFELEQELAAHVGDVDVLKEAKRNGFSDRKIADLWNQTANQVRATRLENNIVPVYKMVDTCAAEFESSTPYFYSTYEWENESIKSDKESVIVLGSGPIRIGQGVEFDYATVHSVKAIQAAGYEAIIMNSNPETVSTDFSVSDKLYFEPLTFEDVMNVIELEQPKGVVVQFGGQTAINLAEPLSKAGVKILGTQVADLDRAEDRDLFEQALKDLDIPQPPGQTATNEEEAVEAARKIGFPVLVRPSYVLGGRAMEIVENEDDLRSYMRTAVKASPDHPVLVDSYIIGRECEVDAISDGKDVLIPGIMEHIERAGVHSGDSMAVYPPQTLSKKIQETIADYTKRLAIGLNCIGMMNIQFVIKDETVYVIEVNPRASRTVPFLSKVTDIPMAQVATNLILGKSLAEQGYKDGLYPESNHVHVKAPVFSFTKLAQVDSLLGPEMKSTGEVMGTDVTLEKALYKAFEASYLHLPTFGNVIFTIHDDTKEEALDLARRFDAIGYGIYATEGTAKFLNEHGVHATLVNKLGENDDNDIPALVRTGKAQAIINTVGNKRTYDEDGAAIRSSAIEAGIPLFTALDTADAMVRVLESRSFTTEAI

SEQ ID NO: 24120 - protein, 442 aa, Burkholderia pseudomallei K96243
MTEHVSQTPDLSAFWMPFTANRQFKEAPRLLVAAKGMYYTSHDGRRILDGTAGLWCVNAGHGRDEIVAAVQAQAEEMDFAPTFQMGHPKAFEAATKIARHTPGDLKHIFFTNSGSEAVDTALKIALAYHRARGEGQRTRFIGRERGYHGVGFGGISVGGIAPNRNAYSGALLPSVDHLPHTLNLKEAAFSKGQPAWGAQLADELERLVALHDASTIAAVIVEPVAGSTGVLIPPRGYLERLRELCDKHGILLIFDEVITGWGRLGAPFAAQFFGVTPDLLTMAKGTNNAAVPMGAVAASGAIHDAIVGGAPAGIELFHGYTYSGHPLAAAAAVATIDLYEREGLLTRAARIAPIFEREIHKLKDARHVIDVRNLGIVGGVELTPRDGKPGARAYEVFVKCFEKGAMIRYTGDILAFSPPLIVEEAQIVELFSIVAQALKETE

SEQ ID NO: 24121 - protein, 277 aa, Oryza sativa (indica cultivar-group)
MSELAYSPTQEVKVISLFCNGITERSSRFSPSIWLAPDITEGYRKCQRQVFWYSFLKLHVTLEVFQQEGWKDSLPVDFPKPSDNENSVEVAHPNIKPFSVHPLPLTKNSDVLLESSNGSDSLKEEKNHYYPGKEIKRRKRHRRKQYVDQEPCIMRGVYFKNMKWQAAIKVDKKQIHLGTVGTQEEAARLYDRAAFMCGREPNFELSEEEKKELQNYTWKDFLDMTRDTITSKKQRKVGLIRRNKTDSLVGQSDGDTEMINGGGSSHSEDGDAETSAS

SEQ ID NO: 24122 - protein, 481 aa, Streptomyces coelicolor A3(2)
MRSGDPRAGEWRSRQTAPEPQKGMNTVTRPRILVVGAGFAGVECVRRLERRLSPDEADVTLVTPFSYQLYLPLLPHVAAGVLTPQSIALSLRRSSRYRTRIIPGGAIGVDLEAKVCVVRTITDRIVNEPYDYIVLAPGSITRTFDIPGLTDNAFGMKTLAEAAYIRDHVISQLDLADASQDPVERASRLQFVVVGGGYAGTETAACLQRLTHAAVKRYNRLDPALIKWHLIDIAPKLMPELGEKLGRDAQQILTRRGIDISLGVSIAKAAPEEVTFTDGRVVPTRTLIWTAGVVASPLMATLGAETVKGRLAVTAEMCLPNHDGVFALGDSAAVPDLAKGQEGAVCPPTAQHAQRQGRHVAENLIATLRNQPMRPYVHKDLGLVVDLGGADAVSKPLGVELTGLPAQAVARGYHWSALRTGVAKARVAANWALNAVAGDDFVRTGFQARKPAKLKDFEYTDAYLTPEQVRERVAEADRAKP

SEQ ID NO: 24123 - protein, 482 aa, Yarrowia lipolytica CLIB122
MVKNVDQVDLSQVDTIASGRDVNYKVKYTSGVKMSQGAYDDKGRHISEQPFTWANWHQHINWLNFILVIALPLSSFAAAPFVSFNWKTAAFAVGYYMCTGLGITAGYHRMWAHRAYKAALPVRIILALFGGGAVEGSIRWWASSHRVHHRWTDSNKDPYDARKGFWFSHFGWMLLVPNPKNKGRTDISDLNNDWVVRLQHKYYVYVLVFMAIVLPTLVCGFGWGDWKGGLVYAGIMRYTFVQQVTFCVNSLAHWIGEQPFDDRRTPRDHALTALVTFGEGYHNFHHEFPSDYRNALIWYQYDPTKWLIWTLKQVGLAWDLQTFSQNAIEQGLVQQRQKKLDKWRNNLNWGIPIEQLPVIEFEEFQEQAKTRDLVLISGIVHDVSAFVEHHPGGKALIMSAVGKDGTAVFNGGVYRHSNAGHNLLATMRVSVIRGGMEVEVWKTAQNEKKDQNIVSDESGNRIHRAGLQATRVENPGMSGMAA

SEQ ID NO: 24124 - protein, 505 aa, Oryza sativa (indica cultivar-group)
MAASLAWLLLALLLASLYTATHRIAAARRRLPPGPTPLPLVGNLLSVSRTSPHRSLARLAARYGPLMRVRLGVVDYVVVSSPAVADDIYHSRHNAHLSSRPPYDAWWGEKHRLNSVIALPPHAVWRAQRRLAMEEVMSPGRLDALAPLRREKVRELLVRVRRVAAARGDGDGELVPVEVGQAAFEGFLSILSSTMVSVDLADSDLRDVVREAAILAATPNVSDIFPAIAAADLQGYRRRMGELVARGYGIFEELLARRKGGREAGERRKDDLLDVVLDREDELKKESNPVLDRNAIKGLITDLMVAGTDTSSSTIEWAMAELLQNSESMQKVKDELRRVIGTRTQIEESDISHLPYLQAIIKETLRLHSNVPMSYYMAEATVEVQGYTIPKGTNIIVNIWAIHHQPNVWVDPDKFMPERFIGKDTNFFGKHPELIPFGGGRRICLGLPLAYRMVHVVLASLLFHFDWKLPEGAKKDGIDMSEKFGLVLSMATPLKALATRSCNDM

SEQ ID NO: 24125 - protein, 259 aa, Corynebacterium glutamicum
MARKPLIAGNWKMNLDHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEALPKLAANAASVA

SEQ ID NO: 24126 - protein, 159 aa, Zea mays
QAIDHIINSAAKSNYMSAGQISVPIVFRGPNGAAAGVGAQHSQIGILLYYDGITNCLSMQCYAAWYAHVPGLKVLAPYSAEDARGLLKAAIRDPDPVVFLENELLYGESFPVSAEVLDSSFCLPIGKAKIERQGKDVTITAFSKMVGYALQFTSQHLYL

SEQ ID NO: 24127 - protein, 599 aa, Vibrio cholerae O1 biovar eltor str. N16961
MRANVFLTIFTALDEGFMLPDIEICRATPLAPIDTIAQKAGLHANEYESHGQHKAKVSLHCLERLANKPKGKFILVTAITPTPLGEGKTVTTIGLAQGLAKLNHSVMACIRQPSMGPIFGVKGGAAGGGYSQVAPMEELNLHLTGDIHAVTAAHNLAAAAIDARIYHEQRLGYADFERRTGMPALRIDPKQVIWKRVMDHNDRALRMVTVGRNEPGKNINGYEREDGFDISAASELMAILALASDLRDLRRRIGNVVLAYDLDGNPVTTEDLKVAGAMAVSMKEAIEPTLMQTLEGVPTLIHAGPFANIAHGNSSIIADEIATRLADYTVTEGGFGSDMGFEKACNIKAKASGKTPDCAVIVATLRGLKANSGLYDLRPGQAVPDALFAPDSAALQAGFANLKWHIDNVNQYGVPAVVAINRFPQDCAEELEQLVKLIEALPNRVSVAISEGFAKGGEGTKLLAEKVVEQCQHPTKFTPLYDSGIPLDEKLKAVAVKGYGAAEIALSDKAAQQLAKLQTQGFDHLAVCLAKTPLSISTDPAIKGAPRDFIVPIRELRLCAGAEFVYALCGSVMTMPGLPEKPSFMALDIDQHGNIVGLS

SEQ ID NO: 24128 - protein, 281 aa, Arabidopsis thaliana
MAVSYNALAQSLARSSCFIPKPYSFRDTKLRSRSNVVFACNDNKNIALQAKVDNLLDRIKWDDKGLAVAIAQNVDTGAVLMQGFVNREALSTTISSRKATFFSRSRSTLWTKGETSNNFINILDVYVDCDRDSIIYLGTPDGPTCHTGEETCYYTSVFDQLNNDEASGNKLALTTLYSLESIISKRKEESTVPQEGKPSWTRRLLTDDALLCSKIREEADELCRTLEDNEEVSRTPSEMADVLYHAMVLLSKRGVKMEDVLEVLRKRFSQSGIEEKQNRTK

SEQ ID NO: 24129 - protein, 887 aa, Zea mays
  misc_feature (588)..(588): Xaa can be any naturally occurring amino acid
  misc_feature (598)..(598): Xaa can be any naturally occurring amino acid
  unsure (1)..(887): unsure at all Xaa locations
MDWGRTEQALTGKNKEAWSEGKIRGTVRLVKKEVLDVGDFNASLLDGVHRILGWDDGVAFQLVSATAADPSNGGRGKVGKAAHLEEAVVSLKSTADGETVYRVSFEWDESQGIPGAVLVRNLQHAEFFLKTLTLEGVPGKGTVVFVANSWVYPHKLYSQERIFFANDIYLPSKMPAALVPYRQDELKILRGDDNPGPYQEHDRVYRYDYYNDLGDPDKGEEHARPVLGGSQEHPYPRRCRTGRHPTKKDPNSESRLFLLNLNIYVPRDERFGHLKMSDFLGYSLKAIIEAVLPTLGTFVDDTPKEFDSFEDILGLYELGPEAPNNPLIAEIRKKIPSEFLRSILPNGSHDHPLKMPLPNVIKSDVLKKAPEFKFGWRTDEEFARETLAGVNPVIIKRLTEFPAKSTLDPRQYGDHTSKITEAHIRHNMGGLSVQNALRNKRLFILDHHDHFMPYLDEINELEGNFIYASRTLLFLKDDGTLKPLAIELSLPHPDGQQRGAVSKVYTPAHTGVEGHVWQLAKAYACVNDSAWHQLISHWLNTHAVIEPFVIATNRQLSVVHPVHKLLSPHYRDTLNINALARQTLINAXGVFERTVFPXKYALGMSADVYKTWNFNDQSLPADLVKRGVAVPDQSSPYGVRLLIKDYPYAVDGLVIWWAIERWVKEYLDIYYPNDGELQRDVELQAWWKEVREEAHGDLKDRDWWPRMDTVQQLARACTTIIWVASALHAAVNFGQYPYAGYLPNRPTVSRRPMPEPGSHDYKKLGAGQKEADMVFIRTITSQFQTILGISLIEILSKHSSDEVYLGQRDEPERWTSDAKALDAFKRFGSRLVQIENRIKTMNDSPDLKNRKGPVEMPYMLLYPNTSDVTGEKAEGLTAMGIPNSISI

SEQ ID NO: 24130 - protein, 674 aa, Triticum aestivum
  misc_feature (45)..(45): Xaa can be any naturally occurring amino acid
  misc_feature (77)..(77): Xaa can be any naturally occurring amino acid
  misc_feature (392)..(392): Xaa can be any naturally occurring amino acid
  unsure (1)..(674): unsure at all Xaa locations
PNPDRIHAVYAAFKKGMRVEDIHEISFIDKWFLTELKELVDVEQXLISNNLDQLSKDDFYQVKRRGFSDKQIAFATXRQKVTVRARRSALGVTPTYKRVDTCAAEFEANTPYMYSSYEYECESAPTNRKKVLILGGGPNRIGQGIEFDYCCCHASFALREAGYETIMMNSNPETVSTDYDTSDRLYFEPLTVEDVTNVIDLERPDGIIVQYGGQTPLKLALPIQRHLEEKKLRSASGTGFVKIWGTSPDSIDAAEDRKRFNAILEELGIEQPKGGIARSESDALSIASEVGYPVVVRPSYVLGGRAMEIVYNDEKLIKYLATAVQVDPERPVLVDKYLNDAIEIDIDALADSVGNVVIGGIMEHIEQAGIHSGDSACSLPTRTVSKHQVETXIKRAGNMQNAKRLYVCGLMNCQYAITPTGEVYLLEANPRASRTVPFVSKAIGHPLAKYASLIMSGVTLPELGFTKEVIPKHVSVKEAVLPFEKFQGCDILLGPEMRSTGEVMGIDYEFSGAFAKAQIAAGQILPISGTVFVSLNDLTKRHLAEIGRGFRELGFNIIATSGTAKVLQLEGIPVEPVLKIHEGRPNARDMLKNGQIQVMVITSSGDDLDSRDGLQLRRLALAYKVPIITTVDGARATMDAIKSMKNKSIEILALQDYFQPADAPQKLPAAQVAP

SEQ ID NO: 24131 - protein, 521 aa, Solanum lycopersicum
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGEYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDAERKLLAAKGSVPIGIGKNCLYKRAIIDKNARIGDNVKIINKDNVQEAARETDGYFIKSGIVTVIKDALIPSGIVI

SEQ ID NO: 24132 - protein, 494 aa, Sphingobium yanoikuyae
MAHENIPAVTDTILNFIGGDYRRGSTGKTFDNFAPATGLRIGTVHEASEADVADAVAAAKAALNGPWGKMTTAERVKLISAVATEIERRADDFLAAEVADTGKPRHVASHIDIPRGAANFRMFADVISTTPTESFATATPDGGQALNYVVRKPKGVIAVICPWNFPLLLMTWKVGPALACGNTVVVKPSEETPRTAALLGEVMNAVGMPEGVYNVVHGFGAGSAGEFLTSNPDIDAITFTGETGTGQAIMQKAAVGVRDISFELGGKNPAVVFADADLDKVVEGLSRSVFLNTGQVCLGTERVYVERPVFDEFVKRMTVAAKAFKPGATGDPAYLGPLISAEHQEKVLGYYARAVAEGATVVTGGGVPALSGDETGGFYVEPTLWTGLAHDSSVMREEIFGPCCGVIPFDSEDEVIGLANDTDYGLCATIWTENLSRAHRVAASMQVGVCWVNCWFLRDLRTAFGGSGHSGIGREGGVHSLEFYTETENICVKL

SEQ ID NO: 24133 - protein, 531 aa, Oryza sativa (japonica cultivar-group)
MMSTQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 24134 - protein, 360 aa, Mycobacterium sp. MCS
MATEDPLRLGVVAGDGIGPEIVSAAVQISERALAAVSVPVDWRRLRMGAEAITAEGTPLPEATLAELDRLDAWLLGPHDNAGYPAPFRDALSPGGTIRKRYGLYANIRPARRLSGAIPAVCPTLDVVVVRENTEGFYSDRNMYDGPGEFMPTADVAMAVAVFTREACERIAHQAFRLARTRRRSVTVAHKANVLSKTTGLFRDSCVRVAEQYPDVTVRLEHIDALAALLVARPAEFDVIVAENMFGDILSDLTGQLAGSLGMAPSVNLSDTKAMAQAAHGSAPDIAGHNIANPVAMILSTAMLLEWLAERHHRGALAGAATRIRDAVCRSLDDGVHTPDLGGAATTTGFTEHVLSVLASA

SEQ ID NO: 24135 - protein, 454 aa, Oryza sativa (japonica cultivar-group)
MSSNLAASRRSSSSSSVAAAAAAKRPAVGEGGGGGGGKAAAGAAAAKKRVALSNISNVAAGGGAPGKAGNAVRDGSLVGGLGSFFFLFSKALFFARFGFEIFRSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKIYAADVIDLNMMIQRDS

SEQ ID NO: 24136 - protein, 384 aa, Gibberella zeae PH-1
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGRSQLNDLVADYKKGDLKVDEFITHRKTLGEINNAFDTMKQGDCIRAVVDMQKLEPKI

SEQ ID NO: 24137 - protein, 569 aa, Buchnera aphidicola str. APS (Acyrthosiphon pisum)
MNKKFKKIVTEKKLTDAERIKENSNYLRGTITDDLKNEITNGFTGDNFSLIRFHGMYQQDDRDLRIERNEQKLEPRYAMMLRCRLPGGVIKAKKWLKIDYFASKYTLYGTIRLTNRQTFQFHGILKKNLKDVHKMLHSIGLDSLATANDVNRNVLCTSNPMESLIHQEAYEWARKISNFLLPHTKAYAEIWLDQKKIVTTEKEPILGKTYLPRKFKTTVVIPPYNDVDLYANDMNFVAITKNEKIIGFNILIGGGLSFIHGNKNTWPFLATEIGYISVENTLSIAKAIVTTQRDWGNRTDRANAKTRYTINNFGLNEFKKEIEKRANVNLKPVREYSFISRGDRFGWIKDINNNWSLTLFIQNGRIYDDNDKLFKSGLLKIANIHDGNFRITSNQNIIISEVSEKNKNKIEKIALSSGLINKSTNLRKNSMACVSFPTCPLAMAEAERMLSFFITQLENIMLKYGVEDEVIILRVSGCPNGCGRSLLAEIGLIGKSIGRYNLYIGGNRIGNRIPKIYKENITEQEILIHLKYLIKTWSNERKNKEDFGDFIVRKEFVKEVINPVYDFWS

SEQ ID NO: 24138 - protein, 325 aa, marine gamma proteobacterium HTCC2143
MPMSKLSLKDSALRTITMERDAITELLDRIDANFEHACELILACSGRVVVTGMGKSGHIGTKIAATLASTGTPAMFVHPGEASHGDLGMITPDDVVIALSNSGNTTEVLTILPLLKRMGTPLISMTGNPASTLSSAADANIDVTVSQEACSLDLAPTSSTTATLVMGDALAISLMEAKGFSAEDFAFSHPGGALGRRLLLKVEDVMHSGPLLPVVFVGTKLSEALMEITRKGLGMTTIVDNNNTLVGVFTDGDLRRALDQNIDIHQTAISDIMTRDCKTVNADMLAAEALGIMDHGKISALAVVDEANKPVGAVHLHDLLNAGVA

SEQ ID NO: 24139 - protein, 327 aa, Zea mays
HDRQVVASSSHMPRGAVSANSVATPVDGGYGDDNQKLTLIKLASMIEVAAKKGARDLNLQGKLMNQIEWLPDSIGKLTGLVTLDISENRILALPEAIGMLSSLAKLDLHANRIAQLPESIGDLSNLIYLDLRGNQLASLPASLGRLVKLEELDVSANHLTSLPDSIGSLTRLKKLIAETNDLDELPYTIGNCVSLVELRVGYNHLKALPEAVGKLESLEVLSVRYNTIRGLPTTMASLTKLKEVDASFNELESIPENFCFVTSLIKLNVGNNFADLQSLPRSIGNLEMLEELDISNNQIRVLPDSFGNLQRLRVLRAEENPLQVPPR

SEQ ID NO: 24140 - protein, 843 aa, Clostridium thermocellum ATCC 27405
MKIAFSTLGCPDFSWTDIYSMAKDFGFNGIEIRGLGKEIFAVKAQPFTESELPKTLKKLSELRLEIPCFSSGCCLKFSENAEKNYEEIVEYITLASKTGTPFVRVLGDLEPEPQGEVDDNVVIEALKKLAPIAEEKGVTLLVETNGVYSDTKRLCELLDNVASDAVAALWDVHHPYRFAGETPGKTVQNLGAYIKYVHIKDSVVENGKIHYRMLGEGDLPIDDIMMALRSINYEGYISLEWVKRWAADLDDAGVVFPNFANYMSRYIKKSEVRGRLFDNARKTGKYIWEKDTLIDLTFPQLLDRVVEEFPDQYAFKYTTTDYTRTYAQFRDDVDTFARSLIALGVKPGDHVAIWATNVPQWFITFWATTKIGAVLVTVNTAYKIYEVEYLLRQSDTHTLVMIDGFKDSNYVEIIKELCPELETAEPGKPLHIKRLPFLRNIITIESKQKGCISWDEAIALAEKVPIEEVQRRALAVNRHDVCNMQYTSGTTGFPKGVMLTHYNVINNGKCIGDCMDLSTADRMLIQVPMFHCFGMVLSMIACVTHGSTMCPIPYFSPKVALDCINREKITVCNGVPTMFIAMLEHEDFKKTDFSHMRTGIMAGSPCPVKVMQDVVDKMNMKEITIVYGQTEASPGCTQSRVDDPIEVRVNTVGRPLPGIECKIVDPQTGEELPDNTDGEFVARGYNIMKGYYKMPEATAAAIDKDGWLHTGDMARRDENGNYKITGRIKDMIIRGGENIYPKEIEDFIYTHPKVKDVQVIGVPDKQYGEEIMAWVILKDGETMTAEELQEYVRSNMAKHKTPRYVKFVTEFPMNAAGKVLKYKMREMAVDMLSLHEANSIVTA

SEQ ID NO: 24141 - protein, 1077 aa, Acinetobacter sp. ADP1
MPKRTDIKSILIIGAGPIVIGQACEFDYSGAQACKALREEGYRVILVNSNPATIMTDPSMADATYIEPITWQTVAQIIEKERPDAVLPTMGGQTALNCALALDENGVLEKYGVELIGASKDAIEKAEDRKLFDQAMRKIGLECPKAAIAENIQEALEIQSKFGFPVIIRPSFTMGGSGGGIAYNREEFLEICERGFDLSPTHQLLIDESLIGWKEYEMEVVRDKNDNCIIVCAIENFDPMGVHTGDSITVAPAQTLTDKEYQIMRNASIAVLREIGVETGGSNVQFGINPKDGRMVVIEMNPRVSRSSALASKATGFPIAKIAAKLAVGYTLDELKNDITGGTTPASFEPSIDYVVTKIPRFNFEKFPQAEPVLTTQMKSVGEVMAIGRNFQESVQKALRGLEVGVCGFDEKIEVGTEGAREKIQHELNVPGPERIWYVADAFRHGFTLDEVFNATKIDRWFLIQIQDIIKTEEQVKTLGFGDLNADNIRAFKRKGLSDLRIANLMGISQKQFRKQRWNLGVYPVYKRVDTCAAEFESSTAYMYSTYDEECEANPSNRDKIMVIGGGPNRIGQGIEFDYCCVHAALAMREDGYETIMVNCNPETVSTDYDTSDRLYFEPVTLEDVLEIVRTEKPKGVIVQYGGQTPLKLARALEEAGTPIIGTSPDAIDRAEDRERFQQMIQRLQLRQPNNSIVKSAEEGMAEASKVGYPLVVRPSYVLGGRAMEIVYNDDELKRYLRDAVQASNEAPVLLDHFLDDATEVDVDCVSDGKDVVIGGIMQHIEQAGIHSGDSACSIPPYSLSDTIQNEMRRQTIAMAKELGVVGLMNVQFAVKGDDVYVLEVNPRASRTVPFVSKCIGDSLAKVAARCMAGQTLASQGFTKEIIPTRFAVKEAVFPFAKFQGVDPMLGPEMKSTGEVMGVGKTFGEAFYKAVLGSNERLPGLPTEGEVKHAFLSVRESDKKHIADIAKKLTAFGFKLIATGGTYQVLKAAGLACEHVNKVTEGRPHIVDRLKNGEIHLIVNTTEGKQAQYDSAMIRRAALQGKVYYTTTINGAEAVCQAFAIQLPMDVYRLQDLQTVG

SEQ ID NO: 24142 - protein, 498 aa, Burkholderia sp. 383
MAERIHELLDRWLTDAPERPFIHLADRTLSYADVGALADALARELRDDGVRAGDRVLVVAENCPEHAALLIACSRVGAWSCGVNARMAPGEVDAFAAKADARVLYFTSEVSPAAGAHAARHDARPSCVGGLARSAVRAAAQVEPEPLASDVAAIIFTSGTTGAPKGVMMTHRGVLHFARVSAQSRALGPDDKVYAYAPMTHIFGLGTVLLASLHAGAALEMRSRFEPAELFDALAHRRVSQVQGPPMLFARLLQHGEEQHIAHPDAPHLRYLYAGAGPLDSALKQKVEAMFGQTLHHGYGLSEYAGSLHATRLGETRHDTSAGYAFPGAELRIVDPASGRTLPAGERGEVWLRGTGLMPGYFRDAAATADVMRDGGWYASGDLGELHDDGALFIVGRLKDMIIRSGFNVYPGEVEQALNGFPGIRNSAVVGQKEADGNEAVVAFVELDAGHPLDEAALRRYLRERLAAYKHPARIIPIDALPFNGNGKLMRRELLARL

SEQ ID NO: 24143 - protein, 524 aa, Phytophthora infestans
MKLLQVITFVSAAVSLSTSAYGHSSNALAGETAASVVESSADPTADQRSRRTSIRADINTYPYGAKKSDVAVDDGDAPRRFRRRLTLKEEEEIEEDLEKVEKKKKAAKKRVDEATEEIEEGLENSNDDEVDDGLKEKREAEKDVEDAEVEEKVDEDLEEIQVEEEVEKMEEDEEKASSKKSKKAKTDDEDTDDDTEDDDDDQEAQTTKKSSKKTKSDEETDEDDNGDGDDEEAPAKKSKKSSTKSKTDEDEDEEDEAQRRRLTESDEKELEEDMKQVKKKEKAAKKKMEEATEEIEEGLENSNDDEVDEGLEEKLEAEKEEEEAEVEEKMDEDLEKIQKKEAAEKQKSADDEEEDEEEDEDEDETPAKKKSSKSATKSKSVDDDEERDDDKTFKKSSKKSKADEEAEEEAEEELEEELEEIEEEIEEEEEAEKAKKAKKSTHKSKTDEEEEEDDKTRRRHLRGLSTINEQEVETDMDKAKKAEKEAKAKEAEADEDIQEGLENSNDDEVDEAMATKLAAEKKKK

SEQ ID NO: 24144 - protein, 296 aa, Chlorobium tepidum TLS
MSNRLISGSAVALVTPFHQDGSIDFEAMRRLVRFHREAGTDIVLPCGTTGESPTLTNEEEAEIIRVVCEEAGESMMVAAGAGNNDTRHAIELARNAEKAGAQAILSVAPYYNKPSQEGYYQHFRHVAEAVSIPVIIYNVPGRTGSNVNAQTILRLARDIENVVAVKEASDNFEQIMTLIDERPENFSVMTGEDGLMLPFMALGGDGVISVAANQVPKVVKGLIDAMKAGNLEEARAINRKYRKLFRLNFIESNPVPVKYALSLMGMIEEVYRLPLVPMADANKAILRAELEKLSLV

SEQ ID NO: 24145 - protein, 945 aa, Polaromonas sp. JS666
MNAITRQELAELDVPLVSFSLNGREVTGRATETLLQVAKREGVEIPHLCYKEGMEAVGNCRSCMVEINGERVLAPSCCRAPTAGMKVVTDSERAVASQKMVLELLLSDMPEKAYTRNNEVDQWASKIGVGKPRFEARQQVRQDLSHPAIAVNLDACIQCTRCLRACRDEQVNDVIGLAFRGDQAKIVFDMDDAMGASTCVACGECVQACPTGALMPAREAALAVPDKQVASVCPYCGVGCQLTYNVKDDKILFVEGRDGPANHNRLCVKGRYGFDYAHHPQRLTKPLIRREGVPKTGDFTMDPDRVMDVFREASWEEALAFAGGKLAAIRDQYGKKSLAGFGSAKGSNEEAYLFQKLVRTGFGSNNVDHCTRLCHASSVVALLEGIGSGAVSNPVMDVTKADVVIIIGANPTVNHPVAATWIKNAVKNGTRLVMLDPRRSDLTRMAHRHLQFKPDTDVPMLNAMMNVIVTEGLVDEEFIASRTIGYEELRKNVEGYTPELMAPICGIDADTLRYVARLYATSKASMILWGMGVSQHVHGTDNARCLIALSLMTGQIGRPGTGLHPLRGQNNVQGASDAGLIPMMFPDYQHVSDPKVRATFEKAWDVPAGTLDDQPGLTVVEVMHAIKKGGIRGMYVQGENPAMSDPDANHAREALAALDHLVVQDIFLTETAYLADVILPASAFPEKDGSFTNTDRLVQMGRKAINPPGDARQDLWIIQEIAKRMGLDWHYNHVSEVFDEMRHTMPSIGGITWDRLDREHSVTYPCMKEGDPGESVVFVEDFPREGGRARFVPADIIPAAERPDTEYPMVLITGRQLEHWHTGSMTRRATVLDAIEPDPVALVHPLDLADLGGKPGDVVTIASRRGEVTLYARADESSPRGAVFVPFCYYEAAINKLTNAALDPFAKIPEFKYCAIKVSLGGTPPLQASYGGGQALENAIALASA

SEQ ID NO: 24146 - protein, 216 aa, Burkholderia pseudomallei K96243
MNAPRFAAPARRTKKLPPLRVGIGGPVGSGKTTLLEMLCKGMRERYDLVAITNDIYTKEDQRLLTIAGALPEARIMGVETGGCPHTAIREDASINLEAVERMLARFPDADIVFIESGGDNLAATFSPELSDLTIYVIDVAGGEKIPRKGGPGITKSDLLVINKTDLAPLVGANLEVMASDTRKMRGERPYVMCNLKALDGVADVIAFIENKGLLTV

SEQ ID NO: 24147 - protein, 496 aa, Triticum aestivum
MAGTGVFADVLDGEVYKYYADGEWRASASGKTVAIVNPTTRQTQYRVQACTQEEVNKVMDAAKVAQKSWARTPLWKRAELLHKAAAILKEHKTPIAESLVKEIAKPAKDAVSEVVRSGDLVSYTAEEGVRILGEGKLLVSDSFPGNERNKYCLSSKVPLGVVLAIPPFNYPVNLAVSKIGPALIAGNSLVLKPPTQGAVAALHMVHCFHLAGFPKGLISCVTGKGSEIGDFLTMHPGVNCISFTGGDTGIAISKKAGMVPLQMELGGKDACIVLEDADLDLVAANIVKGGFSYSGQRCTAVKVVLIMEAVADTVVEKVNAKLAKLKVGPPEDDSDITPVVTESSANFIEGLVMDAKEKGATFCQEYRREGNLIWPLLLDHVRPDMRIAWEEPFGPVLPVIRINSVEEGIHHCNASNFGLQGCVFTRDINKAIMISDAMESGTVQINSAPARGPDHFPFQGLKDSGIGSQGITNSINMMTKVKSTVINLPSPSYTMG

SEQ ID NO: 24148 - protein, 512 aa, Dehalococcoides sp. BAV1
MEIISSVQMRQIEDACLKQGISTETLMENAGRAVAVFARHLLEEQNGCRVLILAGAGNNGGDGLVAGRYLRSWGEKVSIFVPFIDTPKGKTVQGCLEASGDIFAGLAELEEHLADADLVIDALLGTGVNRPLEGIYKEALQMTANVRNTRPEMQVLAVDLPSGLNADTGQADDACLKADFTLSLGIAKQGLFTHRGLELSGAVSVADIGIPPELTTDIQAVLIEKDWAKSVLPVRSPHANKGNFGRVMIVAGSDRYIGAAILAGSAAMRVGAGLVTLALPESLTGAVASRIPEATYLPLPEVSSGTADNSAARFVLSELGKYDVLLIGPGLGQTGYSARLVTEVLSNLPVGLKVIIDADALNILSAITDWWLEYKFDAVLTPHPGEMARLAKTTTEAVQSDRFGLCQKFACKWGKTLILKGAGTIVTSPQGETLCNPAANPVLASAGTGDVLAGIIGGLLGQGVSLFEAAGLGVYLHSLAAEALRSEIGDAGVLASDLLLKLPVIIKGLKQG

SEQ ID NO: 24149 - protein, 475 aa, Ashbya gossypii ATCC 10895
MIRSGSVRLLRETSAAGRCYTSRRSKSTFETAMDAVTRLVTPASWLNRSPTFLVSDEMKTLSKNIARLIGSGHPVLNRVTSYYFDSGGKKVRPMLVLLLSRALSEIPLDQRDRMRIDYTDVPEDPVYSQVPKSILFEHPVNNISPLHILHGIKPLNPLTKGPEPLPQEFDRERGILPKQRRLAEIVLMIHTASLLHDDVIDHSGTRRGKPSGNVAFTNKMAVLAGDFLLGRATVSISRLRNPEVVELVSNCIANLVEGEFMQLKNTVVDGDLETINNGTQQIPPASKTIPLPVHDYRVNTTLASGISHEVMIETAFDYYLHKTYLKTAALISKSCRAAAVLSGARDPILDECYHFGKNLGICFQLVDDMLDFTTSGELGKPVGADFELGIATAPVLFAWKEDPSLGPIIQRNFSQPGDVARALEAVHQHDGIKKTAEVAREYRDKALHNLRAALPESDSRAALEFLTNSILTRRK

SEQ ID NO: 24150 - protein, 529 aa, Oryza sativa (indica cultivar-group)
MDTSTLLIALTLVLLLLLLLLLTARRRRSGRPRLRLPPEPAGLPLVGHLHLFRKPLHRTLARLAARHGAVFRLRLGSRRVAVVVSSAPAAEECLGAHDVAFAGRPRLPSAGILSYGWSTMGTAAYGPYWRHVRRVAVAEILSAHRVRQFAGAHDREARATARRLCRAASRQRHHGAGAAAGRVRVELKSRLFELLMNTMMAMICDKTYYGADDDGEVSEEARWFREMVEETMALSGASTVWDFLPAVLRWVDVGGVGRRLWRLRESRTRFLQGLIDDQRKEMEHDGDGRELPAAAARPRSMIGVLLSVQRQDPEECPDQLISSLCISSLEAGTGTSTDTIEWAMSLLLNNPDVMRKARDEIDAFIGQPVRLLEADDLPKLQYLRCIIMETLRLYPPAPLLVPHESSSDCTVAGFHIPRGTMLLVNTFDIHRDPHIWDEPTSFIPERFEDGRSEGKMAIPFGMGRRKCPAENLGMQMVGLGLGTMIQCFEWERVGEELVDMTEGSGLTMPKKVPLEAFYQPRASVMHLLS

SEQ ID NO: 24151 - protein, 316 aa, Vibrio cholerae O1 biovar eltor str. N16961
MSNKLAQLRKLTTVVADTGEIDAIKKYQPEDATTNPSLILKAAQIAEYAPLIDQAIAYAKTQSNDKAQQVQDTCDMLAVNIGKEILKTIPGRISTEVDARLSYDTERSVAKARQLVKMYNDAGISNDRILIKLASTWEGIRAAEILEKEGINCNLTLLFSFAQARACAEAGVFLISPFVGRIMDWYKAKEGRDFAASEDPGVLSVTKIYNYYKEHGYKTVVMGASFRNIGEILELAGCDRLTIAPSLLAELEAAEGELVAKLVDSKGSKARPAPMTHSEFLWEHNLDAMAVEKLAEGIRNFAVDQGKLEAMIAAKL

SEQ ID NO: 24152 - protein, 495 aa, Ashbya gossypii ATCC 10895
MGFQSFKPTFRNEDLVRRGAYINGEWITSAKESFNVTDPATDQVIAELPDFDSGEAEAALKAAHASFQSYKKTSPTQRSEWLRNLYDLIMENAEDLAAIVTWENGKSLREALVEIRYGATFFKWFSEEALRLYGTTIQPSNPGNRAFTIRQPVGVCALICPWNFPNAMISRKAAPALAAGCTVIIKPDPQTPLSSLALAHLAEKAGFPPGVINVVPTSKYTKDIGVLLCESSLVRKVSFTGSTAVGKILMQQAASTVKKVSFELGGNAPVIIMGDADMEKTVEEVLATKFRGMGQTCICANRLYVHRSIIDDFSSRLVKKVEGLKLGNGFQEGVTHGSLINNAAIEKVERHAKDAIERGAKVLLPGGRAPELGPHFYSPTVLSDVKPDSVLTREETFGPLCAMIPFDTVEEVVGYANDTQYGLASYVFSENIKTVYSIAEALDFGMVACNTGLFSDSMVPFGGIKESGFGIEGSLHGINDYTVLKTVTIGNVPTL

SEQ ID NO: 24153 - protein, 525 aa, Oryza sativa (indica cultivar-group)
MDALLIALFLLLLIALMETARVRRSGTQRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGDDDDGEVSKEARWFREMVEETMALSGASTVWNFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPVRLLEASDLTKLQYLQCIIMETLRLYPPAPLLVPHEASTDCSIAGFHITRGTMLLVNTFAIHRDPQVWNEPTSFIPERFENGRSEGKMAIPFGMGRRKCPAENLGMQMVGLALGTMIQCFEWERVGEELVDMTEGSGLTMPKEVPLQAFYQPRASLMHLLY

SEQ ID NO: 24154 - protein, 680 aa, Vibrio cholerae O1 biovar eltor str. N16961
MLNALRSTSFIEMSNTMNRKQLANAIRALSMDGVQKANSGHPGAPMGMADIAEVLWRSHLNHNPQNPNWADRDRFVLSNGHGSMLIYSLLHLSGYELSIDDLKNFRQLHSKTPGHPEYGYAPGIETTTGPLGQGITNAVGMAIAEKALAAQFNKPGHDIVDHFTYVFMGDGCLMEGISHEACSLAGTLGLGKLIAFWDDNGISIDGHVEGWFSDDTPKRFEAYGWHVIPAVDGHDADAINAAIEAAKAETSRPTLICTKTIIGFGSPNKAGSHDCHGAPLGNDEIKAAREFLGWEYAPFEIPTDIYAAWDAKQAGASKEAAWDEKFAAYAKAYPAEAAEYKRRVAGELPANWEAATSEIIANLQANPANIASRKASQNALEAFGKLLPEFMGGSADLAPSNLTMWSGSKSLTAEDASGNYIHYGVREFGMTAIINGIALHGGFVPYGATFLMFMEYARNAMRMAALMKVQNIQVYTHDSIGLGEDGPTHQPVEQIASLRMTPNMSTWRPCDQVESAVAWKLAIERKDAPSALIFSRQNLAQQPRSAEQVANIAKGGYILKDCAGQPELILIATGSEVELAVAAYEQLSAEGKAVRVVSMPSTDAFDKQDAAYREAVLPAAVTKRIAIEAGIADFWYKYVGFGGRIIGMTSFGESAPAGELFKLFGFTTENVVKQAKELLA

SEQ ID NO: 24155 - protein, 451 aa, Oryza sativa (indica cultivar-group)
MGLRFGSRRVAVVSSAPAAEECLGPHDLAFANRPRLPSGEILAYEWSTMGTASYGPYWRHIRRIAVTELLSAHRVQHFADVNVREVRALARRLYRRAAAAAAAGARTRVELKSRLFELLMNTMMSMICERTFYGADDDEVSEEARWFRSVVKETMELSGASTVWDFLPAPARWLDAGRMTRRMRELSDSRTRFLQRLIDDQRKDMDADSDEHAPAKRRTMIGVLLSLQSKDPDSCPDQLIRSLCIGSLQAGTDTSAATVEWAMSLLLNNPGAMARARGEIDACVGQPAARLLEAADLPKLHYLRCVVMETLRLYPPVPLLAPHESSADCVVAGFHVPQGTMLLVNTFAIHRDPQVWDEPEAFIPDRFADGKNEGKMVIPFGMGRRRCPGENLGMQMVGLALGTLIQCFDWERVGEELVDMRECSGLTMPKELPLEALYQPRASMVDLLTKI

SEQ ID NO: 24156 - protein, 350 aa, Mycobacterium sp. MCS
MSAHRIAVIPGDGIGTEATASARTVLDAVAERHGIDLSYEEFDWSCRRFERDGAMMPADGLETLSGFDAILLGAVGWPGVPDHVSLWGLLIPIRRAFRQYVNLRPIRVFDGVASPLRDATDVDFVVVRENVEGEYSEIGGRINRGFPDEMAVQESVFTRVGVTRIADYAFDLAETRRRYVTSATKSNGIVHTLPFWDEVVAERAANHPGVRFDSEHIDALAAKFVLQPGRFDVVVGSNLFGDILSDLAAAVAGSIGIAPSANLDPTKQYPSMFEPVHGSAPDIAGRGVANPIGAVWSAALMLEHLGHASAAADVMTAVERTLAQPQTRTVDLGGHASTADVTDALVAQLR

SEQ ID NO: 24157 - protein, 254 aa, Bacillus anthracis str. A2012
MQSMRKPIIAGNWKMNKTLSEAVSFVEEVKGQIPAASAVDAVVCSPALFLERLVAATEGTDLQVGAQNMHFEKNGAFTGEISPVALSDLKVGYVVLGHSERREMFAETDESVNKKTIAAFEHGLTPIVCCGETLEERESGKTFDLVAGQVTKALAGLTEEQVKATVIAYEPIWAIGTGKSSSSADANEVCAHIRKVVAEVVSPAAAEAVRIQYGGSVKPENIKEYMAQSDIDGALVGGASLEPASFLGLLGAVK

SEQ ID NO: 24158 - protein, 103 aa, Ashbya gossypii ATCC 10895
MSGRGKGGKGLGKGGAKRHRKILRDNIQGITKPAILRLARRGGVKRISGLIYEDVRAVLKSVLESVIRDAVTYTEHAKRKTVTSLDVVYALKRQGRTLYGFGG

SEQ ID NO: 24159 - protein, 499 aa, Sphingobium yanoikuyae
MATQLKSAENEYGIKPEYGHFIGGEWVSGDSGKTIDLINPATGAVLTKIQAGNAKDIQRAVAAAKAAFPKWSESSPAERQEILIEVARRLKARHQHYATLETLNNGKPIRESMYFDMPQAISQFEVFAGAAYGLHGQTLDYPDAIGIVHREPLGVCAQIIPWNVPILMMACKIAPALASGNTVVLKPAETVCLSVIEFFVEMADLLPPGVINVVTGYGADVGEALVTHEDVRKVAFTGSVATARRIIQYASSNIIPQTLELGGKSAHIVCADADIDAAVESATMSTVLNKGEVCLAGSRLFLHQSIQDEFLAKFKVALEGIRQGDPLDFGTQLGAQASQMQMDKVQSYLQLATEEGATVLTGGSRNESLADGHFIKPTVFTNVSNSMRIAREEIFGPVTSVLTWNDEDDMMALANDTTYGLAGGVWTRDISRAHRIARKLETGTVWVNRYYNLKPNMPLGGYKQSGFGREFSHEVLHHYTQTKSVVINLQEGRVGMFDQ

SEQ ID NO: 24160 - protein, 205 aa, Buchnera aphidicola str. APS (Acyrthosiphon pisum)
MNSLDYNKTNFLKSYSKITDIDIQNGIEIAFIGYSNTGKSSAINALTNQKKLARFSKTPGRTQLINFFEVVSGFRIVDLPGYGYSQAPLLVRSKWQKKVYDYLEKREQIKLFVLLMDIRYPLKKLDQKIISIAVQKKISILVLLTKCDKIKINHQKNQADMVFKKLNVLLDSFEIILFSSYKKIGIEKLKLSLNSSYKKHFILNR

SEQ ID NO: 24161 - protein, 476 aa, Solibacter usitatus Ellin6076
MANELQDFLKLSYTELEELNLEAKADRMGRKPMHEIQEKRLKYLTDEKRIKAVTVLFSDLEGRLHMLDYDKKFLVKSWDNLTFDGSSIRGFTAQRESDLRLNMDWSAFYWAPSDIFGAGKVLVFGEVIDKDGTPYSADIRGVLKAYAQSLFDKQGYTLNAANEIEGFLFNGSDAERRYHETTKFDYVNTGGYYHSLPGDPLRKFIDTCAEVQRAMGFQNEKDHPEVAPSQFEINYSYAEVVAAADQIQLYKLICRQVATGMGLTASFLPKPVVGVNGSGMHTNVSITKNGKNLFWDPSGQEKMSKFAWQFVDRILTHGNDLCLLLNASVNAYRRLDPHFEAPNQIKASATDRGSMIRIPIGNERSSRVEVRSVGPDANPYMVMLSVFRTGLDGETAKIKNLRSAERYLPDNVYDALANFKNAEWTTKLLGEDVKGRYADLKQSSADRCPRLLGTFVKAPEVQYHHEVYNQFLWNMF

SEQ ID NO: 24162 - protein, 132 aa, Brassica napus
  misc_feature (82)..(82): Xaa can be any naturally occurring amino acid
  misc_feature (103)..(103): Xaa can be any naturally occurring amino acid
  unsure (1)..(132): unsure at all Xaa locations
IGQIICRFEQKGFTLKGLKLITVDRPFAEKHYQDLSAKPFFSGLVDYIISGPVVAMIWEGKNVVLTGRKIIGATNPAASEPXTIRGDFAIDIGRNIIHGSDSXVESANKECALWFPDGPVNWQSSLHSWIYE

SEQ ID NO: 24163 - protein, 700 aa, delta proteobacterium MLMS-1
MKVWPGTPYPLGATYDGTGTNFSLFSSIAEAVELCLFDADDNETRINLPEVTGYCWHGYLPEVEPGQRYGFRVHGPWQPEAGHRCNPAKLLLDPYVKAIAGDIAWDEALFPYRFADGPDSRDDRDSAPFMPRCVVHQPYFDWSGDRRPLRPWHKTVIYETHVKGFSKLHPEIPEELRGTYAGLAHPVAVAYLQELGITAVELLPIHQFIHDKHLIDKGLRNYWGYNTLAFFAPHHEYAADRRPAAAVAEFKQMVKSLHQAGIEVILDVVYNHTGEGNHLGPIISLKGIDNAHYYRTMADDPRYYMDYTGTGNSLNMRHPHVLQLLMDSLRYWVLEMHVDGFRFDLASTLARELHDVDKLSAFFDLIQQDPVISQVKLIAEPWDIGEGGYQVGNFPPGWSEWNGKYRDCLRDFWAGRDKTLGEFAYRFTGSSDLYANDSRLPFASINFITAHDGFTLRDLVSYDHKHNEANGEDSLDGNDHEGSWNCGAEGPTDDPGILALRARQQRNFLATLLFSQGIPMLLGGDEFGRSQQGNNNAYCQDNEISWYDWENIDEELLAFSRRLLAYFHEHPVFRRRRWFQGRAIHGPEVTDIAWFNHLGEQMAEEHWGEDHAKSVGIFLNGRTIPNPNPKGEPVTDDSFYLLFNAHYEDLPCQLPAAAWGEQWLLELDTARGWLAKPEPLAAGADFTVAARALVVLRLPV

SEQ ID NO: 24164 - protein, 887 aa, Neisseria meningitidis MC58
MSTQLHDVDPIETQEWLDALSSVLEYEGGERAQYLLENLVKYCRDKGVRMPHGTTTPYLNTVSVENEKGIPGDQNIEHRIRAFVRWNAAAIVLRAGKKDLELGGHIASFQSAATMYEVGFNHFWKAKGEGEEGDLVFFQGHVAPGIYARAFVEGRLTEDQLNNFRQEVDGHGLPSYPHPHLLPDFWQFPTVSMGLGPIMAIYQARFLKYLESRGLAKTKGRKVWCFCGDGEMDEPESQGAIALAAREGLDNLIFVINCNLQRLDGPVRGNGKIIQELEGNFAGAGWNVVKVIWGRRWDRLLAKDKDGILRQRMEECLDGDYQTYKSKDGAYVREHFFNTPELKALVADMTDEQLWALNRGGHDPQKVYNAYDRAANHADGKPTVILAKTIKGYGMGASGEGQNVAHQAKKMDKASLKQFRDRFDIPVTDEQIESGDLPYLTFAPDTEEYKYLHARRDALGGYLPQRKPTQEVLEVPELSAFDAQLKSSGEREFSTTMAFVRILSTLLKDKKIGKRVVPIVPDESRTFGMEGMFRQYGIWNPKGQQYTPQDKDQLMFYKESVDGQILQEGINEPGAMADWIAAATSYANSNFAMIPFYIYYSMFGFQRIGDLAWAAGDMHARGFLLGGTAGRTTLNGEGLQHEDGHSHIQADLIPNCVSYDPTFQYEVAVIVQDGLRRMYANNEDVFYYITLMNENYTHPDMPEGAEQDILKGMYLLKAGGKGDKKVQLMGSGTILQEVIAGAELLKADFGVEADIWSCPSFNLLHRDAVEVERFNRLHPLEAEKVPFVTSQLQGHDGPVIAATDYIRSYADRIRAYIPNDYHVLGTDGFGRSDSRANLRRFFEVDRYNVAVAALAALAEQGKVSKETVQQAIEKYGIKADSAPSWKR

SEQ ID NO: 24165 - protein, 535 aa, Neisseria meningitidis MC58
MSIVEIKVPDIGGHENVDIIAVEVKAGDTIAVDDTLITLETDKATMDVPADAAGVVKEVKVKVGDKISEGGVILTVETGAAAAEAAPAAAEAQPAPAAAPAAAGGATVQVAVPDIGGHTDVDVIAVEIKVGDTVAEDDTLITLETDKATMDVPCTAAGVVKAVFLKVGDKVSEGSAIIEVETVGSAAAAPAQAAQAAAPAAAPPPTAAAAPAAAPAPSAPAAAKIDEAAFAKAHAGPSARKLARELGVDLGQVKGTGLKGRIMGDDIKAFVKSVMQGGAAKPAAASASLGGGLDLLPWPKVDFSKFGNVEVKELSRIKKISGQNLSRNWVVIPHVTVHEEADMTELEEFRKQLNKEWEREGVKLSPLAFIIKASVSALKAFPEFNASLDGDNLVLKNYFNIGFAADTPNGLVVPVIKDVDQKGLKQISQELTELSKKAREGKLKPQEMQGACFTISSLGGIGGTGFTPIVNAPEVAILGVCKSQIKPVWNGKEFAPRLMCPLSLSFDHRVIDGAAGMRFTVFLAKLLKDFRRITL

SEQ ID NO: 24166 - protein, 415 aa, Buchnera aphidicola str. APS (Acyrthosiphon pisum)
MPKPLNNTENNLNTNRIKDLIKKYSPPFWVYDADIIYKKINLLRKFDVIRFAQKSCSNINILRLMKNKNVKIDAVSLGEIERALLSGFKPSTNEIIFTADILDEETLLKVAKYKIPVNAGSLDMLKQLGKISPGHHVWLRINPRFGYGHSKKTNTGGENSKHGIWHPEQAIPIIKKYKLKLIGLHMHIGSGVNYLHLKKVSQAMIKYAFQLNQKISSISVGGGLPIPYKFNDQPIDIKKYFMLWDIARKKISKFLGEKIELEIEPGRFLVAESGILISKVWATKKMGNKNFVLVDVGFNDLMRPTMYGSYHHISVIYGDDRKMNEKETIDTVVAGPLCESGDIFTQKEGGTVQTRKLPTIKVGDYLIFHDTGAYGAAMSSNYNTRPLIPEILLKNNDSIVIRRRQTIEEILNLEK

SEQ ID NO: 24167 - protein, 261 aa, Crocosphaera watsonii WH 8501
MVMKTALITGASSGIGKAFAEELAARGSNLILVARSQDKLDQLAKQLQERTSIDVEVIVQDLTEPQAAQKVYKQVQDKGLTVDGLINNAGFADYGPFAERELSKQLEMIQLNVTVLVELTHLFLSQMQTHRQGSIINVASIAGFQALPYLSTYAATKAFVLSFTESLWAENKDKGINCLALCPGPTESNFFEVADFPQSFENKNNGSLTSAKTVVKDGLNALEKNQANVVTGSITNKLIVNSSRFFPREFLLQAVEKVFRA

SEQ ID NO: 24168 - protein, 264 aa, Candida albicans SC5314
MPASREDSVYLAKLAEQAERYEEMVENMKAVASSGQELSVEERNLLSVAYKNVIGARRASWRIVSSIEQKEEAKGNESQVALIRDYRAKIEAELSKICEDILSVLSDHLITSAQTGESKVFYYKMKGDYHRYLAEFAIAEKRKEAADLSLEAYKAASDVAVTELPPTHPIRLGLALNFSVFYYEILNSPDRACHLAKQAFDDAVADLETLSEDSYKDSTLIMQLLRDNLTLWTDLSEAPAATEEQQQSSQAPAAQPTEGKADQE

SEQ ID NO: 24169 - protein, 633 aa, Methanococcus maripaludis S2
MTLKQIYVNKFKELVKKERDHEINFHKEEIKKLGTKRENVGRAILNLNGKVIREFFGEYIVRYGRSEKFKKTDISVGDIVLISKGNPLQSDLLGTVIEIGSNHVDVSMEIVPKWALNDIRIDLYVNDVTFKRMLNALDKFNSTDNRLIDIILSVDSPQKSKTTEVRFLDYRLNEYQKEAVLEALAARDLYLIHGPPGTGKTSTISEVILQEALRKNKVIATADSNIAVDNILSNISKHESFKIVRIGHPSRISKKLIKYSLQTKITEHPNYSTLVKLKTELQKNYDLRKNFQRPDPKWRRGMSNDDIIIFSKLNKDIRGIPKETIKQMADWVICSENIAKTKENVQKFEKKLIDDIISTSDVVVATNSMAGSEILEDYKFDIAVIDEGSQSTEPSSLIPIVRSRKLIIAGDHKQLPPTVLSDELELKKTLFERMIQEHPEFSKILQVQYRMNEKIMEFSNEMFYENKLIAHESVKSQNLLEIVENVSNEDKDIINEKPLQFINVDGEEKQNSFKSSYNVEEAEKVLEIVSKLQKYEIPVSVITPYDAQVKYISKMLNTDKIDVKSVDGFQGRENEVIVISFVRTSKMGFLKDLKRLNVAVTRAKRKLIVVGSKNLLIKDDAYSKFLNCFNDNQ

SEQ ID NO: 24170 - protein, 518 aa, Burkholderia sp. 383
MRTRRPSRSCCACDFHPSIQNRTKSKETPVSVNIPGFIEGNKKLLIGGQWVEPAGGEHIEAINPATGEVLCHIAKGGTQDVERAVAAARRAFEGPWSRFTPHERRKLLLRVHDVILDHFDELALIETLDMGAPLARTRGYKEWLSQLLQFYASQTGAGTVQAAPMSIAPGFTALKHLMPVGVVGGIIPWNGPLMGLWWIYGPALATGCTAVLKPAEDASLSSLRVSELMMEAGVPDGVINVVTGYGKDVGQALAEHPDVDRVAFTGSVGTAQAIVRASAGNLKRLQLELGGKSPDIVFADADLDKAVPGAAMGVFTNTGQVCVAGTRIFVQRAIHDEFVQRIAAFAKTIRIGDGLSPDTQIGPLISQRQLERVMHYVDIGGKEATLVHGGQRPGGELARGYFVEPTVFANVRNDMTIAREEIFGPVASVIPFDTMEEALQLANDTPYGLAGGVWTSSLSTAHKVSQGIRSGTVWVNCYGVIDPAVGFGGTKMSGYGWKGGKEHVESFLYPKATYINLG

SEQ ID NO: 24171 - protein, 280 aa, Methanococcus maripaludis S2
MKFDAWYTEPQTENLSLSTKLKDILYVGQSEYQEIQVLDTYEFGRVLILENTYQTTERDEFIYHELISHPALFTHGNPKKVLVIGGGDGGSVREVLKHKSVEKIDFVELDGQVVEVAKKFLPTLSCEIDNEKVNTIITDGIKYVAETSEKYDVILVDCPDPVGPAAGLFEKEFYNNLYKCLNDDGIMVQQTESPLLHEKLINKIKGHLKDAGFSTIRPLVCSIPTYPSGFWSFTLASKKNDPLNSDVSEIENKLKDMTTKYYDQDVHKGVFLATPRYLKE

SEQ ID NO: 24172 - protein, 477 aa, Acinetobacter sp. ADP1
MSQQFDLVVIGGGPGGYEAAIRAAQLGFKVACIEKRVHKGKPSLGGTCLNVGCIPSKALLDSSHHYEDTIHHLGDHGITTGEVNIDIAKMLARKDKVVENLTGGVAQLLKGNGIEWLQGTGKLLAGKKVEFVPFEGETQVLEPKYVILASGSVPVNIPVAPVDQDLIVDSTGALEFAEVPKRLGVIGAGVIGLELGSVWRRLGSEVVVFEALDAFLPMADKALSKEFQKILTKQGLDIRIGAKVSGTEVNGREVTVKYNQAGEDKEQVFDKLIVCVGRKPYAEGLLAEDAGIKLTDRGFIEVNDHCATSLEGVYAIGDLVRGPMLAHKAMEEGVMAVERIHGHAAQVNYDTIISVIYTHPEAAWVGLTEEQAVANGHEVKTGQFPFAVNGRALAAGEAAGFVKFVADAKTDRLLGMHVIGPGASDIVHQGMIALEFVSSVEDLQLMTFGHPTYSEVVHEAALAVDGRAIHAIQRKRK

SEQ ID NO: 24173 - protein, 496 aa, Burkholderia sp. 383
MTIVTEAAQAARTQALAWINRGPKRLLIGGRWVDAASGNTFETINPATEQVLCRVAEADSADVDAAVIAARRAFDAPSWGGLSPHARTRALLKIADAIEQHVDELAAIESLDNGMPLWFALAAVTATIDIVRYYAGWCSKVLGTTIPSDGSTLIYTLREPLGVCGQIIPWNVPILMAAIKFANALCCGNTVILKPAELACLTSIRLAELIQETDLPPGVINVLPGYGPTAGAALAQHPGVDKIAFTGSTPVGKQITRDATLNLKKVTLELGGKAPNVIFADADIEKAVQAAVKTFCGNSGQVCSAGTRLFVQEGIHEQVAERVAQIAATWKAGDPFASDTKLGPLISAKQRDRVWSYIGVGQEGGATLRLGGDPWRGAGYFVEPTVFDNVRNGMRIAQEEIFGPVLSIIPFKDEGDAVLQANDTTYGLSAAVWTRDVARAHKVVRALKAGRLWINTFGESDPAMAFGGYKQSGWGREFGQESIDAYTQTKSIMLRM

SEQ ID NO: 24174 - protein, 442 aa, Arabidopsis thaliana
MNCDRICELPDSLLTQVLSYLPTIDSVKTSVLSKRWEFLWLRVPVLDLKVSDFPDENYASFIDNFLEFNRKSRMRKFKLKYDEYTYDDDRLAGWVVTTVDRGIQHLDAKGFETNMCVREFMPQNIYKCNTLVSLMLVTVGIENPEFVVSLPSLKIMHLEDVWYYDDPLIMEKIISGCPVLEDFVLIRPIDFCNLDVLQFLRVRSLSLRSFRLTFEYSVSCTYFSVEIDAPRLEYLNFNDDQSDTIVVKNMTSLSMIDIDSEFNVKFGGSRLEPGDLRKRDIIRDFLTAISCVRHMIISRRTLEVLDRYSKLVPIPKFDNLYRLQAAVSRSMLQLLLVFLESCPNLENLILDFTVSTEPEQDGLTYVPQCLLSSLECVEIRELIMGEETGEKLVRYFLKNSVVLKKLILRLEDSSIANQDSDIFKELSTFTKRSRSCEVIIIH

SEQ ID NO: 24175 - protein, 529 aa, Oryza sativa (japonica cultivar-group)
MEIERESSERGSISWRASAAHDQDAKKLDADDQLLMKEPAWKRFLAHVGPGFMVSLAYLDPGNLETDLQAGANHRYELLWVILIGLIFALIIQSLAANLGVVTGRHLAEICKSEYPKFVKIFLWLLAELAVIAADIPEVIGTAFAFNILFHIPVWVGVLITGTSTLLLLGLQKYGVRKLEFLISMLVFVMAACFFGELSIVKPPAKEVMKGLFIPRLNGDGATADAIALLGALVMPHNLFLHSALVLSRKTPASVRGIKDGCRFFLYESGFALFVALLINIAVVSVSGTACSSANLSQEDADKCANLSLDTSSFLLKNVLGKSSAIVYGVALLASGQSSTITGTYAGQYIMQGFLDIRMRKWLRNLMTRTIAIAPSLIVSIIGGSRGAGRLIIIASMILSFELPFALIPLLKFSSTNVQIIVFSWFLGLLIIGINMYFLSTSFVGWLIHNDLPKYANVLVGAAVFPFMLVYIVAVVYLTIRKDSVVTFVADSSLAAVVDAEKADAGDLAVDDDEPLPYRDDLADIPLPR

SEQ ID NO: 24176 - protein, 340 aa, Yarrowia lipolytica CLIB122
MSYTRVTLQQHPKTTIEPSTFKDETVPIPTKDDLKDGDYLIKVKLVSLDPTLRGQMSGQKSYIEPVKLGDVMRAWGLGEVVESKNPEYKVGDIVSGVVGFSEYAIGHNQDHRKIPNIPGIPLEDNLGVLGLTGLTAWWGINGVAGGIKSGETVLVSGAAGATGSVAGQLAKIAGAKVIGIAGGKDKCDFITKELGFDVALDYKSADFKKDFKEATKGGVDVYYDNVGGEILDMALMAANDFARFIMCGGISQYNLDKPQPLYNVLQVVPKRIKMQGFIVMDHGDRFPEIIKDLAGLISQGKLKAKTHLIEGPVTGLPNALKSLFEGANTGKMIYKLDSKL

SEQ ID NO: 24177 - protein, 292 aa, Ashbya gossypii ATCC 10895
MSSIYKALSGKNQKKKDGNAGAEKQYMNKQRVLLISSRGVTYRHRHLIQDLHSLMPHSRKEPKLDTKKDLGQLNEIAELYNCNNVAFFEARKHQDLYMWLSKPPNGPTVKFYLQNLHTMDELNFTGNCLKGSRPVLSFDKRFDTQPQYRLFKEMFIHTFGVPPQARKSKPFIDHVMSFSIVDDKIWVRNYEISHAARNNSEYEDKQDEDISLVEIGPRFVMTPILILEGAFGGPKIYENKQYVSPNVVRAQLKQEAAKEARARADAAVQRKIKRRDNVLAMDPLSNDALFKN

SEQ ID NO: 24178 - protein, 97 aa, Bordetella parapertussis 12822
MPAIPSPPGATMQKVVMYSKDYCPYCARAQALLKQRGVADLEIIRIDQDPSQRDIMIERTGRRTVPQIFIGETHVGGSDDLQALDRSGGLLPLLNGG

SEQ ID NO: 24179 - protein, 66 aa, Glycine soja
ETRHPVYRGVRRRDSGKWVCEVREPNKKSRIWLGTFPTAEMAARAHDVAAIALRGRSACLNFADSA

SEQ ID NO: 24180 - protein, 324 aa, Cicer arietinum
KNGISVAVKRSEPGSGQGLPEFQTEIMVLSKIRHRHLVSLIGYCDERYEMILVYEYMEKGTLRDNLYNSTNMPCLTWKQRLEICIGAARGLHYLHKGATGGIIHRDVKSTNILLDENLVAKVADFGLSRTGPLHQHSYVITGVKGTFGYLDPEYFRSHSSTEKSDVYSFGVVLLEVLWSRPAIDPSLPRKQVNLAEWGLLCKDKGMLEDIIDNSIKGQIDPNSLRKFSETVEKCLQDDGCDSHKMGDVLWDLEYALQLQRGAIHREPHEDSSSSASVSIQLPNIRRLPSLSTLSEVDDMSIGRLDESDSAADSVFSQLKIDDAR

SEQ ID NO: 24181 - protein, 250 aa, Bordetella parapertussis 12822
MYKLVLIRHGESQWNLENRFTGWTDVDLTETGREQARKAGELLKREGYAFDLAYTSVLKRAIRTLWIALDALDAMYTPVGINWRLNERHYGQLQGLNKAETAAKYGDEQVLIWRRAYAIAPEPLDLEDPRHPRFDGRYAKIPADQLPATECLKDTVARVLPFWNESIAPAIRAGRRVLVAAHGNSLRALIKHLDNVSDDDIVGVNIPTGQPLVYELDEDLKPIRHYYLGDAAEIEAAMAAVAAQGKAKKD

SEQ ID NO: 24182 - protein, 427 aa, Herbaspirillum seropedicae
MSAIVDIIGREVIDSRGNPTVECDVLLESGVLGRAAVPSGASTGSREAIELRDGDKSRYFGKGVLQACENINTEISEAIMGLDANEQAFLDRTLIDLDGTENKSRLGANAMLAVSMAVAKAAAEESGLPLYRYFGGSGSMQMPVPMMNVINGGAHADNNLDIQEFMIIPVGAPSFREALRYGAEVFHTLKKILHDRGLATSVGDEGGFAPNVSSHEEAIKLIIEAIEKAGYEPGTQIALGLDCAASEYYKDGNYHLAGENMVLTPAQKTGLLASWCDKYPIISIEDGMAENDWAGWKLLTETLGKKVQLVGDDLFVTNTKILKEGIDKGIANSILIKINQIGTLTETFAAIEMAKRAGYTAVISHRSGETEDSTIADIAVGMNALQIKTGSMSRSDRMAKYNQLLRIEEDLGDIASYPGRAAFYNLK

SEQ ID NO: 24183 - protein, 594 aa, Neisseria meningitidis MC58
MALVELKVPDIGGHENVDIIAVEVNVGDTIAVDDTLITLETDKATMDVPAEVAGVVKEVKVKVGDKISEGGLIVVVEAEGTAAAPKAEAAAAPAQEAPKAAAPAPQAAQFGGSADAEYDVVVLGGGPGGYSAAFAAADEGLKVAIVERYKTLGGVCLNVGCIPSKALLHNAAVIDEVRHLAANGIKYPEPELDIDMLRAYKDGVVSRLTGGLAGMAKSRKVDVIQGDGQFLDPHHLEVSLTAGDAYEQAAPTGEKKIVAFKNCIIAAGSRVTKLPFIPEDPRIIDSSGALALKEVPGKLLIIGGGIIGLEMGTVYSTLGSRLDVVEMMDGLMQGADRDLVKVWQKQNEYRFDNIMVNTKTVAVEPKEDGVYVTFEGANAPKEPQRYDAVLVAAGRAPNGKLISAEKAGVAVTDRGFIEVDKQMRTNVPHIYAIGDIVGQPMLAHKAVHEGHVAAENCAGHKAYFDARVIPGVAYTSPEVAWVGETELSAKASGRKITKANFPWAASGRAIANGCDNGFTKLIFDAETGRIIGGGIVGPNGGDMIGEVCLAIEMGCDAADIGKTIHPHPTLGESIGMAAEVALGTCTDLPPQKKK

SEQ ID NO: 24184 - protein, 407 aa, Sphingobium yanoikuyae
MRSIAIVGANLAGGRAVEALRQAGFDGRITLIGEEPWRPYERPPLSKEVLWDPANVPDNFFLQDEAWYDDNRIDMRLGTRAEAIDLAGGGFACRAANGSGGPDSARTGAMPASSTLPGPIAPTSLYLRTRDDATRMALDLREGTSIVIVGMGVIGAEVAASAVKLGCKVTVVEPMPVPMERALGRRFGQWLGEEHRKRGVATHFNCGVTGFRFSDNRVSAVEADDGTVIPCDAVIVGVGIVPATSLARDAGIEVNNGIIVDRRCQTSNLAVFAAGDVAEQDGFFGGRFRQETYQNAADQAQAAALAMLGQEVSYCKPMWYWSDQFDLNIQFCGQIPVEAEVAIRGEMDSNAFVAFFLAGEAIEGVLTVNRAPDMGVGKRLVERRARASAASLADAGMSLRDLLKQAG

SEQ ID NO: 24185 - protein, 588 aa, Oryza sativa (japonica cultivar-group)
MAMKSLKLPKTAVLPGFGGIARPQDVQDRSANFTCSRPRAASVTDQEIVHEESGHVLKIPFRRIHLTGDEKHFDTYDTSGPQNISPRIGLPKIRKEWIDRREKLGGPRYTQMYYAKQGIITEEMLYCATRENLSPEFVRSEVARGRAIIPSNKRHLELEPMIVGRNFLVKVNANIGNSAVVSSIEEEVHKLQWATMWGADTVMDLSTGRHIHETREWILRNSSVPIGTVPIYQALEKVNGIAENLSWEVFRDTLIEQAEQGVDYFTIHAGVLLRYIPLTAKRMTGIVSRGGSIHAKWCLTYHKENFAYEHWDEILDICNQYDVALSIGDGLRPGSIYDANDSAQFAELLTQGELTRRAWAKDVQVMNEGPGHIPMHKIPENMEKQLEWCNEAPFYTLGPLTTDIAPGYDHITSAIGAANIGALGTALLCYVTPKEHLGLPNRDDVKTGVISYKISAHAADLAKGHPYAQAWDDTLSKARFEFRWLDQFALSLDPVTAMSFHDETLPSEGAKVAHFCSMCGPKFCSMKITEDIRKYADEHGYGTVEEAVIQGMNAMSAEFSAARKTISGEQHGEAGGEIYVPESYTARK

SEQ ID NO: 24186 - protein, 238 aa, Cicer arietinum
FDKGARTALAFVTLRADGEREFMFYRNPSADMLLTPEDLNLELIRSAKVFHYGSISLIVEPCRSAHLKAMEVAKDAGCLLSYDPNLRLPLWPSPEEARNQILSIWDKADLIKVSDVELEFLTGSDKIDDASALSLWHPNLKLLLVTLGENGSRYYTKNFHGSVDAFHVNTVDTTGAGDSFVGALLGKIVDDQSILEDEARLREVLKFANACGAITTTKKGAIPALPTEADVLSLIKGE

SEQ ID NO: 24187 - protein, 418 aa, Neisseria meningitidis MC58
MNAAQLDHTAKVLAEMLTFKQPADAVLSAYFREHKKLGSQDRHEIAETAFAALRHYQKISTALRRPHAQPRKAALAALVLGRSTNISQIKDLLDEEETAFLGNLKARKTEFSDSLNTAAELPQWLVEQLKQHWREEEILAFGRSINQPAPLDIRVNTLKGKRDKVLPLLQAESADAEATPYSPWGIRLKNKIALNKHELFLDGTLEVQDEGSQLLALLVGAKRGEIIVDFCAGAGGKTLAVGAQMANKGRIYAFDIAEKRLANLKPRMTRAGLTNIHPERIGSEHDARIARLAGKADRVLVDAPCSGLGTLRRNPDLKYRQSAETVANLLEQQHSILDAASKLVKPQGRLVYATCSILPEENELQVERFLSEHPEFEPVNCAELLAGLKIDLDTGKYLRLNSARHQTDGFFAAVLQRK

SEQ ID NO: 24188 - protein, 302 aa, Oryza sativa (japonica cultivar-group)
MSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEDPALHLEFLANYVAELSLLEYNLLSYPPSLVAASAIFLAKFILQPAKHPWNSTLAHYTQYKSSELSDCVKALHRLFCVGPGSNLPAIREKYTQHKIYAADVIDLNMMIQRDS

SEQ ID NO: 24189 - protein, 390 aa, Buchnera aphidicola str. APS (Acyrthosiphon pisum)
MTIRKMTELNITEKRILIRSDLNVPIENGIIQSDARILAALPTIELALQKKAKVIIMSHLGRPKEGYYTKKYSLFPIFEYFKKKFNNTKIYFSNNFLDGIKLNPGEIALLENTRFNKGELNNDEQLSKKYSDLCDIFVMDAFGSAHRMQSSTYGIGKFVKIACAGLLLISEIDALKKALKKPKRPMVAIVGGSKVSTKFNVLNKLSKIADTIIVGGGIANTFLAIDYKIGKSLYEPDFVFEAKKLRDKYNIIVPIDSRVGKNFCKNEQAIIKSPDNIKEDEEIMDFGDESIKKIISIITQSQTIMWNGPVGVFEFPNFRKGTEMIAKTIANSNAFSIAGGGDTLSVIDMFNIKNNISYISTGGGAFLEFIEGKKLPAIQMLEENFKNKSK

SEQ ID NO: 24190 - protein, 218 aa, Oryza sativa (indica cultivar-group)
MEVEEAAYRTVWSEPPKRPAGRTKFRETRHPVYRGVRRRGGRPGAAGRWVCEVRVPGARGSRLWLGTFATAEAAARAHDAAALALRGRAACLNFADSAWRMPPVPASAALAGARGVRDAVAVAVEAFQRQSAAPSSPAETFADDGDEEEDNKDVLPVAAAEVFDAGAFELDDGFRFGGMDAGSYYASLAQGLLVEPPAAGAWWEDGELAGSDMPLWSY

SEQ ID NO: 24191 - protein, 143 aa, Glycine max
GAFTEKQDALVSSSFEAFKANIPQYSVVFYNSILEKAPAAKDLFSFLANGVDPTNPKLTGHAEKLFALVRDSAGQLKASGTVVADAALGSIHAQKAVTNPEFVVKEALLKTIKEAVGDKWSDELSSAWEVAYDELAAAIKKAF

SEQ ID NO: 24192 - protein, 424 aa, Acinetobacter sp. ADP1
MSEATGKKAVLKLDGKEIELPIYSGTLGPDVIDVKDVLAAGHFTFDPGFMATASCESKITFIDGNEGVLLHRGYPIDQLATQADYLETCYLLLNGELPTPEQKQEFDAKVRNHTMVHDQVSRFFNGFRRDAHPMAIMVGVVGALSAFYHNQLNIEDVNHREITAIRLIAKIPTLAAWSYKYTVGQPFIYPRNDLGYAENFLHMMFATPADRDYKVNPILAKAMDRIFTLHADHEQNASTSTVRLAGSTGANPYACIAAGISALWGPAHGGANEAVLKMLDEIGTVENVAGFMEKVKTKEVKLMGFGHRVYKNFDPRAKVMKETCDEVLAALGINDPQLELAMELERIALSDEYFIKRNLYPNVDFYSGIILKAIGIPTEMFTVIFALARTVGWISHWLEMHSAPYKIGRPRQLYTGETKRDIKR

SEQ ID NO: 24193 - protein, 237 aa, Arabidopsis thaliana
MSSQICRSASRAARSLLSSAKNARFFSEGRAIGAASVVHATGKVPQYASNFGKSGSGFVSNSWITGLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 24194 - protein, 193 aa, Methanothermobacter thermautotrophicus str. Delta H
MLDKLKESLRNSPVIKKGEYDYFVNPVTDGIPLTEPELLEEVAEEIVRRFRPEADKIICIEAMGIHHATVLSLKTGIPFVVVRKRRYGLPGEVAVHQMTGYSEGELYINGVDSGDRVVVIDDVVSTGGTLLAVLEALREMDVDVRDVITVIDKGEGSRVVRERTGFTVKSLVKVDVIDGRVKVEDIPAGGPHD

SEQ ID NO: 24195 - protein, 496 aa, Porphyridium purpureum
VKLAAGMGVMSDLEKKFIELEAKLVAQPAGQAMPGKSNIFANNEAWRQEMLKQDPEFFNRLANGQSPEYLWIGCADSRVPANQLLDLPAGEVFVHRNIANQCIHSDISFLSVLQYAVQYLKVKHILVCGHYGCGGAKAALGDSRLGLIDNWLRHIRDVRRMNAKYLDKCKDGDEELNRLIELNVLEQVHNVCATSIVQDAWDAGQELTVQGVVYGVGDGKLRDLGVVVNSSDDISKFYRTKSDSGALKAGNPNAPLVQVTKGGESELDSTMEKLTAELVQQTPGKLKEGANRVFVNNENWRQKMLKQDPQFFSNLAHTQTPEILWIGCADSRVPANQIINLPAGEVFVHRNIANQCIHSDMSFLSVLQYAVQYLKVKRVVVCGHYACGGCAAALGDSRLGLIDNWLRHIRDVRRHNQAELSRITDPKDSLNRLIEINVLEQMHNVCATSIVQDAWDAGQELEVQGVVYGVGDGKLRDMGVVAKANDDIGQIFRTKQ

SEQ ID NO: 24196 - protein, 320 aa, Ralstonia metallidurans CH34
MPESISLAKQVVATEIRALEAMNARVSEDFGRTVKCILSMKGRLVVVGMGKSGLIGRKIAATMASTGTPAFSVHAGEAFHGDLGMIRPTDVVLMISNSGETEELVRLLPFLRHQNNYVIAMTGKPASTLGKAANTILDISVEREACNNNLAPTSSTTAALVMGDALAVVLASKRGFQPEDFARFHPGGSLGRRLLTRVADVMHKGTLPVCTAQTSFKDVVHVVNRGRMGLALVMQGERLLGIITDGDIRRGFDTVHDYRSILAEDLMTTRPKAIAPDARVGDAEALLRQEKIGALVVQDIDGRVIGIFQMHGAEEAPGVH

SEQ ID NO: 24197 - protein, 603 aa, Lolium perenne
MGIAEVALHTMPGAFASHSPASSLPLRTDTRSMRKRGTNSFYRTLGGPPKFPELRPVECQCQRIDDLAGVIEAGNGTWANDMVNKASQVLGDVAVPGQAIGGNASLSGNPEKVLPRRRNLSSVEDEAWDLLRESVVNYCGSPVGTIAANDPNDSNPANYDQVFIRDFIPSGIAFLLKGEYEIVRNFILHTLQLQSWEKTMDCHSPGQGLMPASFKVRTIPLDGDENATEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLSAREMLTPEDGSADLIRALNNRLVALSFHIREYYWVDMQKLNEIYRYKTEEYSYDAVNKFNIYPDQVSPWLVEWIPPKGGYFIGNLQPAHMDFRFFSLGNLWSIVSSLATTQQSHAILDLIESKWSDLVAEMPLKICYPALENLEWKIITGSDPKNTPWSYHNGGSWPTLLWQLTVASLKMNRPEIAAKAVEIAERRIATDKWPEYYDTKRARFIGKQSRLYQTWSIAGYLVAKQLLDKPDAARILWNDEDTEILNAFSTNRKRGKKVLKKTYIV

SEQ ID NO: 24198 - protein, 196 aa, Medicago sativa
IPEDDPRNPATIADNVGDNVGDVAGMGADLFGSYVATVLAAMVLGNYVLRDILAANPSWTDAFGGIGPILLPMAIAGFGILFSIIGTLLVRIKDNDAREAQVQGALNVGNWVSIILVAISCFFLVQYMLPETMQMEFYGEGAKDISSMRVFYATLVGLFVGGVISSVTEYYTGLGKKPILAIVQKSSTGAGTNIIA

SEQ ID NO: 24199 - protein, 293 aa, Oryza sativa (indica cultivar-group)
MRGAVFWEPGRPLTLEDFRMPRPKAGELLIKTKACGVCHSDLHVLKGELPFSSPCVVGHEITGEVVDHGTHTPAAIINRFPVGSHVVGAFIMPCGNCFYCVKHPFYVFPGKPVYMYSMGGLAEYCVVPANALAVLPNSLPYTESAILGCAVFTAYGALRHAAEMRAGDSLAVIGVGGVGSSCLQIAKAFGASEVIAVDVLDEKLQNARTLGATHTVNAAKEDAVEKIKEITDGRGVDVAVEALEVLKDCLQIRVDIVDESLVKLIRESIGSGALVIWRTMDDFYNFFLGERCT

SEQ ID NO: 24200 - protein, 637 aa, Bordetella parapertussis 12822
MNANPKFLAATAEVDAAAVAPLPKSRKVYETGSRPDIRVPFREIEQADTPTMFGGEKNPPLTVYDTSGPYTDPQASIDIRRGLPALRRAWIEERGDTEVLDGPTSDYGKERLTDPKLTAMRFDLQRPPRRARAGANVTQMHYARRGIVTPEMEFIALRENLRREHYLETLRASGPDGEKLAKRLLRQHPGQSFGAALPSAITPEFVREEVARGRAIIPANINHPEIEPMIIGRNFLVKINANIGNSAVSSGIGEEVEKMTWAIRWGGDTVMDLSTGKHIHETREWIIRNSPVPIGTVPIYQALEKVDGKAEELTWEIFRDTLIEQAEQGVDYFTIHAGVRLPFIPMTADRMTGIVSRGGSIMAKWCLAHHKESFLYERFEEICEIMKAYDVSFSLGDGLRPGSGYDANDEAQFAELKTLGELTQVAWKHDVQVMIEGPGHVPMQMIKENMELQLKHCDEAPFYTLGPLTTDIAPGYDHITSGIGAALIGWYGTAMLCYVTPKEHLGLPNKKDVKDGIITYKIAAHAADLAKGHPGAAIRDNALSKARFEFRWDDQFNLGLDPDTAKEFHDETLPKDSMKVAHFCSMCGPHFCSMKITQDVRDYAAAQGVSEKDALQQGMQEKAVEFVKKGAEVYHRT

SEQ ID NO: 24201 - protein, 331 aa, Ashbya gossypii ATCC 10895
MVKVAINGLGKIGRLVMRIALSRANVEVVAINDPFITVDYAAYMFKYDSTHGKYAGDVQYEGNTLVIDGKKIKVFQERDPAQLPWGEEGIDIAIDSTGVFKELDSAQKHIDAGAKKVVITAPSSTAPMFVMGVNEEKYAGETIVSNASCTTNCLAPLAKVIDEQFGIEEGLMTTVHSLTATQKTVDGPSMKDWRGGRTASGNIIPSSTGAAKAVGKVLPQLNGKLTGMAFRVPTVDVSVVDLTVKLNKETTYDEIKAAIKAASEGKLKGILGYTEDAVVSTDFLGDNNSSIFDASAGIMLSPKFVKLVSWYDNEYGYSTRVVDLVEHVAAN

SEQ ID NO: 24202 - protein, 395 aa, Enterobacter cloacae
ISTTIAFVRALNVMLKNKSIKDRLVPIIADEARTFGMEGLFRQIGIYSPNGQQYTPQDREQVAYYKEDEKGQILQEGINELGAGASWLAAATSYSTNNLPMIPFYIYYSMFGFQRIGDLCWQAGDQQARGFLVGGTSGRTTLNGEGLQHEDGHSHIQSLTIPNCISYDPSYAYEVAVIMHDGLQRMYGEAQENIYYYITTLNENYHMPAMPAGAEEGIRKGIYKLETIEGSKGKVQLLGSGSILRHVREAAQILAKDYGVGSDVYSVTSFTELARDGQDCERWNMLHPLETPRVPYIAQVMNDAPAVASTDYMKLFAEQVRTYVPADDYRVLGTDGFGRSDSRENLRHHFEVDASYVVVAALGELAKRGEIDKKVVADAITKFNIDAEKVNPRLA

SEQ ID NO: 24203 - protein, 353 aa, Arabidopsis thaliana
MANIGVVTTATNNQVILRNYVSGFPKESDLYIAATTVDLRVPPGSMAVLVKNLYLSCDPFSRIRMEKPDPSSPASLARAYSIGKPISGYGVAKAIDSGHPNYKTGDLLWGRVGWEEYSVINPTPSSHFKIHHADVPLSFYTGLLGIPGLTAYVGFYEICSPKKGETVFVSAASGAVGQLVGQFAKMAGCYVVGSASSKEKVDLLKTKFGYDDAFNYKEEHDLSAALKRCFPEGIDIYFENVGGKMLEAVLENMRTHGRIAACGMISQYNLKEPEGVHNLASIVYKRIRVQGFAAVEFFDKYSKFLDFILPYVREGKITYVEDIAQGLENGPSALIGLFHGKNVGKQLVAVARE

SEQ ID NO: 24204 - protein, 172 aa, Cucumis sativus
QQCPDKVKWPVEEMGNPPPLYFNAGFFVYEPDLFTYKDLLETCKATTPTLFAEQDFLNMYFNDIYKPIPPIYNLVMAMLWRHPENIDVDKVKVVHYCAAGSKPWRYTGKEENMEREDIKMLVKKWWEVYEDESLDYQNVLKSETKQETNLTPLISVLSEAEVVNHITAPSAA

SEQ ID NO: 24205 - protein, 486 aa, Mycobacterium smegmatis str. MC2 155
MTEHENRVVSGVQKRLFIDGKWVDATDGATFDVLDPATGEVLCAVADASPQDGRAALDAAVAAQPEFAALPPRERADMLTGAFELLHERIDDLALLMTLEMGKPLAEARGEITYAAEFFRHFAAEAVRIDGGYQTAPAGGSRFLIARQPVGPCLLITPWNFPMAMGTRKLGPAIAAGCTSVIKPAHQTPLSMLALMDILSEVGVPAGAVNCVTAMDAGGVMEPLIRSGLARKLSFTGSTKVGRMLLEQCAEKILRTSLELGGNAPLIVFEDADLDEAVEGAILAKMRNMGEACTAANRLFVHSSVIDEFGRRLAERMAEMPVGRGTEDGVRVGPLIDEAALQKVTSLVDDAVKRGATVLTGGSAPSGPGFFYPPTVLSGVPRDAEMVGQEIFGPVAPLTPFDTEEEAVAAANDTEYGLVSYVFTNDLRRALRVAEALETGMVGLNQGIVSNPAAPFGGIKESGLGREGGAVGIDEFLETKYVGIKM

SEQ ID NO: 24206 - protein, 211 aa, Magnaporthe grisea 70-15
MAVASEDSLPTLKVLLVGSSNVGKSALLTRYCHDKFEPEDAAATIGIDYKRKRLAVYGKAYQLNLFDTAGQERFRTLSTSYYRGAHGVIIAYDISNRRSFAELGRWFDEVKSNTVAEIALFLVGTKLDIAPTNRAVSYEEGLALAQANGAQFCEASSKTRENVRKPFVDIVNRIVQEPVLLKKVNASRNSLGTVKVNKASAEDASWLSCAC

SEQ ID NO: 24207 - protein, 566 aa, Gibberella zeae PH-1
MSRRNNREQEASLLQGRDRVSLDSDSDSDSSTSSSDDTTCEPASSSTARPRTVGVRGTANHPSNASAPDTKRHDRNKNTKSKSNLDSEGLELDDMNPNDLRRPNYHRHGDGKSGEPLLFKEDDPERGRAGYSPTSDSGRRSSQGSRASSEDDIPYHPNEMMARPSMSRRSTMRSRSPQTAAETAADSTKQRYTYAGFFLIVSLIAFCVQTELSAHIQHDLGWDKAYCMMYFTHGSWVVLWPIQLLILRFQKRDVPWPVFWKRHKHQLRTTAIMIEKQTLDVFHISIQHRARPVRYFVRFTAIITCALTVAGLSWYIAVSLTTPSDLTAIYNCSAFFAYVFSVPLLHEPLRLDKSVAVLIAIAGVLVVAYGDTKEGAESVEAGNRFFGNLVIGIGSVLYGLYEVLYKRYACPPEGCSPGRGMIFANTFGSLIGLFTLTVLWIPLPLLDFLNIEKFEIPEASTCWLILLAVLSNATFSGSFLVLISLTSPVLSSVAALLTIFLVAIVDWMITGEPLSFAAIVGGAMIIIAFLALTWSTYREMKEHAAREPVADFTDSDKDGDIDSDDD

SEQ ID NO: 24208 - protein, 210 aa, Triticum aestivum
  misc_feature (166)..(166): Xaa can be any naturally occurring amino acid
  unsure (1)..(210): unsure at all Xaa locations
MAADAASAAVKKLTLKSSDGEDFEVEVAVAMASQTIKHMVEDGCADNIIPLPNVTAKILSKVIEYCTQHAPKADDAAAADSATAVKPDEEKLKAYDVEFFVKVDQATLFDLILAANYLNIKGLLDLTCQTVADMIKGTTPEEIRKTFNIKNDFTPEEEEEIRRENXWAFEEEHLRRCHRPLKDQRLVFVMSVFQALFFMSVGNVVIILSL

SEQ ID NO: 24209 - protein, 567 aa, Cytophaga hutchinsonii ATCC 33406
METLFLYIWQENERIKIHEPHMTNTSDFTSWKKLNEHYSKSSNLQMRDLFAADKDRFSKYSVQFNDILVDYSKNRITDETISLLIALAEEAGLKQAIEDMFAGKKINNTEKRSVLHVALRNRSNTPILSDGKDVMPEVNAVLEKMKGFCEKVRSGAWKGYTGKSITDIVNIGIGGSDLGPVMVTEALKPYGSPTLHVHFVSNVDGTHIVETTKKLNPETTLFIIASKTFTTQETITNAESAKAWFLQTAKDEAAVAKHFVALSTNAKSVAAFGIDTENMFEFWDWVGGRYSLWSAIGLSIALYIGYDNYIELLSGAHAMDKHFKETPFAKNIPVLLALIGIWYNNFYKAESHAILPYDQYMHRFAAYFQQGDMESNGKRVTKDGTAVTYSTGPIIWGEPGTNGQHAFYQLIHQGTKLIPCDFLAPVISQNPIGDHHPKLLANFFAQTEALMKGKTAAEAKAELEKAGLSAEDVAALVNHKVFEGNRPTNSIFFKKLTPFTLGSLIAMYEHKIYTQSVVWQINAFDQWGVELGKQLANAILPELKDNAAVTSHDSSTNGLINFYKANK

SEQ ID NO: 24210 - protein, 359 aa, Dehalococcoides sp. BAV1
MYHNVTLIPGDGIGPEISEATRRVLEATGVKFNWEVVNAGADVVAEYGTPLPDIVLESIRKNKVAIKGPVTTPVGSGFRSVNVGMRKALNLYTCLRPCKTYPGVPSRYDNVDIVIVRENMEDLYAGIEFEKGSAEALRLIEFIKENKKVEIRTDSGISIKPISVFGTERIFRWAFKYAKDNNRKKVTAVHKANIMKYSDGLFLAVGRKVAEEYPEIEFEDRIVDNMTMQLVKTPTQFDILVCPNLYGDILSDLCAGLVGGLGVAPGANIGDEYALFEPTHGSAPKYKGLNKVNPMAMMLSGVLMLRYLKEEKAADKLENAIAAVIAEGKSVTYDMLSPDKQAVAVGTSQVADAIIAKMK

SEQ ID NO: 24211 - protein, 256 aa, Zea mays
  misc_feature (199)..(199): Xaa can be any naturally occurring amino acid
  unsure (1)..(256): unsure at all Xaa locations
MDLATTPARRAMEPGVARRVWHVVLAVCHMLRRGLSPKRIMMDVHLLLGRGKLAGRTLRGHLAHPSSHHRHGHGHGHLTTYGGGASRASSSSSSSTLASFYGHPREVEFSCTTTPSYPQQHYGLFPFKGLRGGGGGGGRGGARCGGEYGGLDAAAVARAFEMLSAEVDAGGGGGTPAVAATTATPSPMLAWILGRSPAXGVRPLRVTDSPFPAVPEDGCCNDRVDADADDFIRKFYEQLRLQPTAATPDAYLRRRG

SEQ ID NO: 24212 - protein, 106 aa, Arabidopsis thaliana
MGRKKGLPEFEESAPDGFDPENPYKDPVAMVEMREHIVREKWIQIEKAKILREKVKWCYRVEGVNHYQKCRHLVQQYLDSTRGVGWGKDHRPISLHGPKPEAVEAE

SEQ ID NO: 24213 - protein, 338 aa, Yarrowia lipolytica CLIB122
MAIKVGINGFGRIGRIVLRNALKNPEVEVVAVNDPFIDTEYAAYMFKYDSTHGRFKGKVEAKDGGLIIDGKHIQVFGERDPSNIPWGKAGADYVVESTGVFTGKEAASAHLKGGAKKVIISAPSGDAPMFVVGVNLDAYKPDMTVISNASCTTNCLAPLAKVVNDKYGIIEGLMTTVHSITATQKTVDGPSHKDWRGGRTASGNIIPSSTGAAKAVGKVIPELNGKLTGMSLRVPTVDVSVVDLTVRIKNGASYEDIKATMKAASESPELKGILGYTDEDVVSTDFIGDTHSSIFDAKAGIGLNDNFVKLISWYDNEYGYSARVVDLIVAVAKKDASA

SEQ ID NO: 24214 - protein, 314 aa, Photobacterium sp. SKA34
MSCCKKDVAAVMQQAFDLHKDNKDGANASYIPFLASVPSDLCGLAFVSVTGEIVKIQDVDYKYAIESISKIMTLGLALEQSGADAIHSKVGAEPTGLPFNSVMALELHNGKPLTPLVNAGAMATVSLIEADDKEQRWQKILAFQSALAGTNIEFSEDVNQSEQTTNAHNRAIALLLESSNRIYSDPLEACDVYTRQCSTLFNTVELATVGATYANGGKNPISGQQLVSPENASHILAEMMIEGLYDTSGDWAYDVGLPGKSGVGGGLVTIIPNVGALASFSPRIDQFGNSVRGQLMIKYVAQTMSWNLFNSKQH

SEQ ID NO: 24215 - protein, 515 aa, Yarrowia lipolytica CLIB122
MGLANIINRGEKPEGSAFMAAFVAVFVAFGGILFGYDTGTISGVMAMPFVKKTFTDDGLEFTSEQTSLITSILSAGTFTGAISAPWASDTLGRRLGLILFCVVFSVGAILQTAATGRTLLIVGRVVAGLGVGGVSSIVPLYQSEVAPKWIRGAVVSIYQFAITIGLLLAAIVNNATKNKDNSASYRIPLGLQLLWAVILSGGLILLPETPRFWIKKGEYDKAADSLRRLRRLPVEHEAVQKELLEIQSSHDHEMQIGSATWAACFSPKGSQLKRMLTGIAIQALQQLTGINFIFYYGTEFFKKSNISNPFLIQMITNIVNVVMTIPGIMFVDRVGRRKLLLIGAIVMCSSEFIVAAVGTAIDNETSSKVLIAFTCTFIAGFAATWGPIAWVVIGEIFPLRIRAKGVALCAASNWLFNFAIAFATPYLVDEAPGSAGLKTKVFFIWGGCNFLCIAFTYFFIYETKGLTLEEVDQMYAEIKIASRSHQFVPTTRVAAYDEHASDDKKDGQHVYIESV

SEQ ID NO: 24216 - protein, 466 aa, Photobacterium sp. SKA34
MALHEVTRKIGNDPIYGSDTIHNVAATTKLPQQEQAPNVIYQMIRDELYLDGNARQNLATFCQTWEEDEVHKLMDLSIDKNMIDKDEYPQSAEIEGRCVHILADLWNSPESVTTVGTSTTGSSEACMLGGLAALWRWREKRRALGQPTDKPNMVCGPVQVCWEKFARYWDIEMRETKMADGHYCMTPEDMLELVDANTIMVVPTFGQTFTGLYETVKPLSDALDTYEHDTGNAIDIHVDGASGAMLAPFCATEIDPWDFRLERVKSISTSGHKFGLAPLGCGWVVWRSKEDLPDGLVFHVNYLGGDMPTFALNFSRPAGQIIAQYYNFLRLGYEGYKRIHDASYDVCEYLVKELNKFNLFEFLFDGNREKGIPAISWRLKNNADVSFSLYDLADRLRTRGWLVPAYSLPANAQDIVVQRILVKQGLTIDLANLLIEDFKRSMDFLNTHAQAKCTAEDVKTFDHSGR

SEQ ID NO: 24217 - protein, 223 aa, Oryza sativa (japonica cultivar-group)
MAALLARQAAQALRARQMAQLGPSATAMQGHIRTYMGAGKPTRFKEDEEKEKLAKEIAKDWNAVFERSINTLFLTEMVRGLMLTLKYFFEKNVTINYPFEKGPLSPRFRGEHALRRYPTGEERCIACKLCEAICPAQAITIEAEEREDGSRRTTRYDIDMTKCIYCGFCQEACPVDAIVEGPNFEFATETHEELLYDKEKLLENGDRWETEIAANLESESLYR

SEQ ID NO: 24218 - protein, 436 aa, Ashbya gossypii ATCC 10895
MTQTAAPGRVQTLTKEQEKVLKQVWVHLFQFWGIDVDGSAVLTAKEPEPAAPSGKGRKLLGLFGKRKDATGAARKESNGKAAAKVYDAEKVEDSDAEKEKPTPQKVEGLEEMYELLKELDGAAVSKEFWSMLRCDYPDNLLLRFVRARKWDINKAMIMMAHSLRWRLNEGKPEDIVFGGERGAQKADKKGIVKQLELGKATVRGFDKNGCPIVYVRPRLHHAADQTEAETSEYSLFIIEQARLFLKEPCDTATILFDLSGFSMANMDYAPVKFLITCFEAHYPECLGKLFIHKAPWIFPPIWNIIKNWLDPVVAAKIAFTKTAADLEEFIPAEQIPLELGGKDEYNFDGFVMPDGSADTKLSDEKGKAAVLEEREAIIKRFIDATISWIESTSDEESAKWLEKKIDLSKELSENYSKLDPYIRSRSFYDVNGTLKV

SEQ ID NO: 24219 - protein, 321 aa, Bordetella parapertussis 12822
MNLPELIAPIADDMKAVDAVIRDRLNSDVVLIRTIGDYIIGAGGKRMRPAMVLMVARALGYQGTHHQLLAAVVEFIHTATLLHDDVVDESDLRRGRDTANAVFGNAASVLVGDYLYSRSFEMMVEADSMRIMQILSQATTVIAEGEVLQLLNVHDPDVSQERYLQVVRYKTAKLFEAAAQVGAVLAGASPEQETAAAAYGRRVGTAFQLVDDVLDYSGDAHALGKNVGDDLREGKPTLPLIRVMETGTPEQRELIREAIKTGQADFAAVAQAIQATDALAHARQAAENEAELARQALSAFPVSLYQKSLLEFCAFAVNRDR

SEQ ID NO: 24220 - protein, 303 aa, Triticum aestivum
  misc_feature (104)..(104): Xaa can be any naturally occurring amino acid
  misc_feature (166)..(166): Xaa can be any naturally occurring amino acid
  unsure (1)..(303): unsure at all Xaa locations
STQGRKEYAAEVRIISQLRHRHLVRLVGWCHEHRGDFLLVYELMPNGSVDQHLYGKGVHLTWPTRYDIALGLASALLYLHEECLQCIVHRDIKPSNVMLDATFXSAKLGDFGLAKLVEHGSQPYTTVLAGTLGYLAPECLTTGKSSRESDVYSFGVVALEIACGRXPSEPTAEPSKARLVPWVWELYGKKALLEAADWRLKVEFDEKQMEHLMVVGLWCAHPDYTRTRGIRQALNALKFEAALPVLAPKMPVPTFFPLPDLAALVSSVGGASDTQNPGGVTECESSGANAGKGSSVRDRLLEP

SEQ ID NO: 24221 - protein, 323 aa, Triticum aestivum
MSGGHGDAGMASGKMAKLKELLQKSENRICADCSAPDPNWASANIGVFICVKCSGVHRSVGTHISKVMSVTLDKWSDDEIDSMVEVGGNSQANAIYEAFLPEGYRKPHPDSAQEERQKFIKSKYELQEFLEPSLRIVSNHPSDAGKQASNSHSASSKSEIGMVEFIGILNVKVIGGTKLAIRDMSSSDPYVVLTLGQQKAQTSVIKGNLNPVWNEELKLSVPQKYGPLKLQVLDHDMVSKDDLMGEAEIDLQPMINAAASFGDPELLGDIQIGRWLKSGDNALTADSAVMVTGGKVKQEVTLKLQHTESGEVTVEMEWMALNI

SEQ ID NO: 24222 - protein, 398 aa, Neisseria meningitidis MC58
MQNYLTPNFAFAPMIPERASGSRVWDTKGREYIDFSGGIAVNALGHCHPALVDALNAQMHKLWHISNIYTTRPAQELAQKLVANSFADKVFFCNSGSEANEAALKLARKYARDRFGGGKSEIVACINSFHGRTLFTVSVGGQPKYSKDYAPLPQGITHVPFNDIAALEAAVGEQTCAVIIEPIQGESGILPATAEYLQTARRLCDRHNALLILDEVQTGMGHTGRLFAYEHYGIVPDILSSAKALGCGFPIGAMLATEKIAAAFQPGTHGSTFGGNPMACAVGSRAFDIINTPETLNHVREQGQKLQTALLDLCRKTGLFSQVRGMGLLLGCVLDEAYRGRASEITAAALKHGVMILVAGADVLRFAPSLLLNDEDMAEGLRRLEHALTEFAATSDNP

SEQ ID NO: 24223 - protein, 992 aa, Oryza sativa (japonica cultivar-group)
MGSGSLLLSLLLVLVVVNVGVAVNQDGLSLLDARRALAAPDGALADWNARDATPCSWTGVSCDAGVGGGAVTGISLAGLNLTGSFPAALCRLPRVASIDLSYNYIGPNLSSDAVAPCKALRRLDLSMNALVGPLPDALAALPELVYLKLDSNNFSGPIPESFGRFKKLESLSLVYNLLGGEVPPFLGGVSTLRELNLSYNPFVAGPVPAELGNLSALRVLWLAGCNLIGAIPASLGRLGNLTDLDLSTNALTGSIPPIELYNNSLTGPIPVGFGKLAELQGVDLAMNRLNGAIPDDFFEAPKLESVHLYANSLTGPVPESVAKAASLVELRLFANRLNGTLPADLGKNSPLVCVDMSDNSISGEIPPAICDRGELEELLMLDNKLSGRIPDGLGRCRRLRRVRLSNNRLDGDVPAAVWGLPHMSLLELNDNQLTGVISPVIGGAANLSKLVLSNNRLTGSIPPEIGSASKLYELSADGNMLSGPLPGSLGGLEELGRLVLRNNSLSGQLLRGINSWKKLSELNLADNGFTGAIPAELGDLPVLNYLDLSGNRLTGEVPMQLENLKLNQFNVSNNQLSGALPPQYATAAYRSSFLGNPGLCGDNAGLCANSQGGPRSRAGFAWMMRSIFIFAAVVLVAGVAWFYWRYRSFNNSKLSADRSKWSLTSFHKLSFSEYEILDCLDEDNVIGSGASGKVYKAVLSNGEVVAVKKLWGLKKGTDVENGGEGSTADNSFEAEVKTLGKIRHKNIVKLWCSCTHNDTKLLVYEYMPNGSLGDVLHSSKAGLLDWSTRYKIALDAAEGLSYLHHDYVPAIVHRDVKSNNILLDAEFGARVADFGVAKVVEATVRGPKSMSVIAGSCGYIAPEYAYTLRVNEKSDIYSFGVVLLELVTGKPPVDPEFGEKDLVKWVCSTIDQKGVEHVLDSKLDMTFKDEINRVLNIALLCSSSLPINRPAMRRVVKMLQEVRAEATRPRLEKDGKLSPYYYEDTSDQGSSV

SEQ ID NO: 24224 - protein, 428 aa, Candida albicans SC5314
MTYTAPAVVIDNGSYTTKAGFSSEDLPSLVFNSNYMKHDKTQQVIIGDESMENNSEQQVMKLLDDGLIYDFDNIVHNWQYVFDNVDNNNPINSSEFPLVVTEQPWNTSKNKVNSCQVAFETLQVPIFSLVKTPLAQLYRCGKSTGLVIDIGSSVTSVTPILDGVIQSKCSYHSKYAGDFVNLHVLNYLESKTAINSLLPSKFANSSESFKQYYISRNILQEYKNLSLNYQIKDYQLYNHEFINVSDQQNYLENLFDPTLNKLPNIHIPEPSIDKPGSHGLTNLVFLALKNLESTLLPQNTNDNTSQNRYQKFIEIFKLLLSNVLITGGTSAANGLPDHIINDLRALTQKYFPNYPFSYAVQQIRPSNTENAEIWDRQFGAWFGACNLASMLNDNDEKSNSAKIALDNWFITKADYEELGEDLVAEKFK

SEQ ID NO: 24225 - protein, 292 aa, Vibrio sp. Ex25
MFSGSIVALITPFKADGEVDFDSLQKLVEYHVEAGTDGIVAVGTTGESATLTIEEHVKVVNKTVEFADGRIPVIAGTGANATHEAVTFSKLLADSGIAGFLSVTPYYNKPTQEGLFLHYKAIAEASDVPLILYNVPGRTAVDMQPETVARLSKLDNIVALKDATGDLDRIAIHRELCGEDFILLSGDDATGLDFVKLGGNGVISVTNNIAAKDMADMFHLASEGKYEEAEAINQRLMTLHKNLFIEASPIPVKWAAQKLGLIEEGGLRLPLTTLSEKSQPIVEQALTDAGIY

SEQ ID NO: 24226 - protein, 227 aa, Glycine soja
GVCYGGNGDNLPTKQAVVDLYKSNRIDKIRLYYPDEGALQALRGSNIEVILTVPNDQLQSLTNAGAANDWVNKYVKGYSQNVKFKYIAVGNEVHPSDAAAGSVLPALKNIQNAISSANLQGQIKVSTAIDTTLLGNSYPPKDGVFSNSASSYIGPIVSFLAGNGAPLLANVYPYFAYVGNQQNIGLDYALFTKQGKNEVGYQNLFDALLDSLYAALEKVGAPNVKVV

SEQ ID NO: 24227 - protein, 226 aa, Glycine soja
GVCYGGNGNNLPTKQAVVDLYKSNRIGKIRLYYPDEGVLQALRGSNIEVILGVPNDQLQSLTNTGAATNWVNKYVKTYSQNVKFKYIAVGNEIHPGDSLAGSVLPALENIQKAISAANLQGQIKVSTAIDTTLLGNSYPPKVGVFTDSASPYITPIVNFLVKNDAPLLANLYPYYSNANNQNIGIDYVLFTKQSKNEIGYQNMFDAMLDSVYAALEKVGAPNVKVV

SEQ ID NO: 24228 - protein, 447 aa, Arabidopsis thaliana
MALIQFGSSCVAQWGILRPRFAVKAFYPSRLESHHDNCISQINCLGASRSSMFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 24229 - protein, 941 aa, Oryza sativa (japonica cultivar-group)
MKRSGDIASLFGNHEAKTMEIPESSSSSNVFIGDEAPVPEEEPRQVPTDAFPRAPPVRRNASSVSATMDRRPGRHKLRRVKAHVRAARMDRISGLPDKILHHIMSFLNTRQAVQTCVLSRRWRNLWRTMPCINADFDEFDFIAYQGDDEDYNDEVAFKRFVNQMLELRDPTAMIDTFWLSYIIWDGYNEYKDSNVDANRWISHALQKQARVIEVVVFAFPLELDHSVFTSCYLRKIGFSCVSLHQGFFKQLDTGCPALEELFLHDCIIADEEILSQSLKVLTIDGTEFSMANKASISIPSVTSLTLSIEDSTPMLKDMELLTTASVSVKFNTFIFSYGFDANDLRQCLWSLSGVTNLEFNYEGTELTFENNLQWCPEFIDVVNLTLGQWCLDANFYALIVFLQNSPRLEKLTLNLAKCIADKSPRIVGELMERSFTCEHLKIVEVKCLEDDPQVISVEDFFASNGMASVQFDIKHWGQYKDELPAFIRRGALETRPPLELEFPTRTTCSTKRLCVLGRHGGAFLQLHAGRVKTPAHAAGMDWISDLPDEILHRIMSFLNARQAVQTCVLSRRWRNLWRTVPCINADCKEFDFFGFRRSEVEFKRFVNRLLELRDPIAMMDAFWFRYHKLDTDTTSSADTNRWISHALQKQARVLEAVMYPCHLLDLDHSSFTSRYLRRIGFSGVRLDQGFFKQLEAGCPALEDLFLHHCTIEDDKISSQTLKVLTIDRTYFLIAINATDVQKKSISAPSVTSLTMYSPEGSLHILKDMTSLVTASVSFSEFRVHFDANDFYQYLWSLSGVTNLEFNYQGPKLKIENNLQWCPEFVNVVNLTLGKWCLDANFYALTVFLQNSPKLQKLTLKLAKCTSEIHQRIIGELTERSFTCEHLKIIEVICLENDPQVIRVKDFFASSGITSVQFHIKHWSQLKEDKLPAFTRIPIPSH

SEQ ID NO: 24230 - protein, 179 aa, Fagus sylvatica
FFISMATFFETSNRSLMATIVFLMGFLMANLATTGAQSVGVCYGMLGNNLPSVQEVISLYKSNNIKRMRIYDPNQAVLQALRGSNIEVMIGVPNSDLQSLANPSNAQAWVQRNVLNFWPSVRFRYIAVGNEVSPVNGGTSGLAQFVLPALVNVFNAVRSAGLQDQIKGSIAIDMTLIGN

SEQ ID NO: 24231 - protein, 493 aa, Bordetella parapertussis 12822
MSLSVGNAALLPGRNLIGSEWREAALGARFAVADPATGKVIAHVPDSGARDAGAAVTAAHQAFADWRRTPAKVRAQIIKRWNALLHENAEDLARLISSEQGKPLAEARGEVSYAASYVEWFAEEATRADGDLIPSPAQGRRMFALREPVGVVAAITPWNFPAAMIARKIAPALAAGCTVVCKPAEDTPLTSLALTALAQQAGVPPGVLNIVTASRGRAAEVADAWLDDPRVRKITFTGSTPVGKHLARRSADTLKRVSLELGGNAPFIVFDDADLDAAVEGLMVSKFRNGGQTCVCPNRIFVQAGVHDAFVRKLAARVEGLVVGPASDPASQIGPMINARAVEKIEHHVADALERGARLAVGGKRIHSARCAGDHYYAPTVLTGVDETMACFREETFGPVAPITVFASEADVVAAANATAFGLAAYFYSTDVRRIWRLADALETGIVGVNEGALAAEAAPFGGVKDSGYGREGSRHGLAEYMQIKYVCQGQLD

SEQ ID NO: 24232 - protein, 271 aa, Zea mays
PTWFGKYLCRSSRFGRLQGVKCAIAGRNLYMRFSCSTGDAMGMNMVSKGVQNVLDYLQADFPDMDVISISGNFCSDKKSAAVNWIDGRGKSVVCEAVIKEEVVKKVLKTNVQALVELNVIKNLAGSAVAGALGGFNAHASNIVAAIFIATGQDPAQNVESSQCITMLEAINDGKDLHVSVTMPSIEVGTVGGGTQLASQSACLDLLGVKGANRESPGSNARLLATVVAGAVLAAELSLISAQAAGHLVQSHMKYNRSSKALAEETDKPKKC

SEQ ID NO: 24233 - protein, 500 aa, Mycobacterium sp. MCS
MTANRRPEGVPQRIQHFIGGKLVDSLADTWFDVIDPVTNQPYAQAAAGQADDVDRAVAAAKVAFRTGPWPNMQARSRSRVLNRIADAIESRDARLAELESFDSGLPITQALGQARRAAENFRFFADLVVAQADDAYKVPGSQINYVNRKPKGVAGLITPWNTPFMLESWKLAPALASGCTVVLKPAEFTPLSAGLWADIFRDAGVPDGVFNLVNGIGEEAGDALVKHPDVRVISFTGESATGEIIFRNCATGLKGMSMELGGKSPAVVFADADLDAALDSTLFGVFSLNGERCTAGSRILVEEEIYDEFVERFAARAAGIVVGDPQDPRTEVGALVHPEHFAKVMSYIDVGKTEGRLLCGGGRPAHLPQGNFVAPTAFADVEPNARIFQEEIFGPVVALSRFQTEEQALALANGVKYGLAAYIWTNDLKRAHRFAQNVDSGMVWVNSHNVRDLRTPFGGVKASGLGHEGGYRSLDFYTDQQAVHITLGDVHTPRFGITAR

SEQ ID NO: 24234 - protein, 316 aa, Mycobacterium sp. MCS
MTARRDPHSIRGSITPLMTPFTDDGAVDHRSLANLVNWQLASGSHGISIGGSTGEPGAQSVAERLAAIATVMKSVSGRAPVVAGTGTAQLDETIELTGRAAELGIDAALVITPYYARPTQEALYRWYKTVAEEYPDLPILAYNVPVRTAVDLAPETIARLYRDVENFVGVKETTKDFEHFSRVMHLCGPDIIVWSGIELLCLPLLALGGTGFLSATANIAPAAHARMYELWIAGAHEEARAIHYGLHPLVDLLFVETNPAPGKWLLKDLGLIASDHVRPPLITPTPGALERIAVLRRAGEKFLTPVGDFALEGAFA

SEQ ID NO: 24235 - protein, 277 aa, Brassica oleracea
MNTFPASTEMVGSENESPVTTVVGGDYYPMLAASCPKKPAGRKKFQETRHPIYRGVRLRKSGKWVCEVREPNKKSRIWLGTFKTAEMAARAHDVAALALRGRGACLNYADSAWRLRIPETTCHKDIQKAAAEAALAFEAEKSDVTMEETMAVASQAEVNDTTTDHGMNMEEATAVASQAEVNDTTTDHGVDMEETMVEAVFTEEQSEGFNMAEESTVEAAVVTDELSKGFYMDEEWTYEMPTLLADMAAGMLLPPPSVQWGHNDDLEGDADMNLWSY

SEQ ID NO: 24236 - protein, 421 aa, Blastopirellula marina DSM 3645
MSSESGHPIGGETPFKIEYAQRVYRLPPYMFGRINALLYEKRVAGHDVIDLGMGNPSDPPQEFVMEKMCEAVKDERNHGYSKSNGIRNLRREVAGKYLKKYGVRLDPESEVIACLGSKEGFSHMCLAMMGPGDTAIVPAPYFPVHTYAVALASGNVIALEVGDSEKFLENIAYTCEHLYPKPKLLIICYPHNPSTVTVEPEFFVEIVKLAKRYGFMVISDFAYADIAFDGYKPPSFLSAPGASSVGVEFTTMSKGYNMAGWRVGFCAGNAEMIKGLATIKGYYDYGMFQAIQIAAIIALREGDAAVEEQSRIYESRRDVLVDGLTRLGWGVTPPKAGMFVWAKVPDVWMQRMNTMDFAMMLLEKGDVAVSPGSGFGPCGEGYVRMAMVENEERLRQAVRQIGRCLKHEEKELVTAETTLES

SEQ ID NO: 24237 - protein, 250 aa, Brassica oleracea
MNSVSTFSELLGSENESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDHGMNMASQAEVNDTTDHGLDMEETMVEAVFTEEQRDGFYMAEETTVEGVVPEEQMSKGFYMDEEWMFGMPTLLADMAAGMLLPPPSVQWGHNDDFEGDADMNLWNY

SEQ ID NO: 24238 - protein, 720 aa, Xanthomonas campestris pv. vesicatoria str. 85-10
MATRKFTQRSRIREGRPNPLGATWDGLGVNFALYSRNATRVELCLFDERGREQERIALPEYTDEVWHGYLPDARPGQLYGYRVHGPYAPDAGHRFNHNKLLLDPYAKQIVGELKWAPHLFGYIIGHRDKDLSFDRRDSAAFMPKSAVIDPAFTWGQDRPPQTPWNRTVIYEAHVRGLSMLHPAVPPEERGTFSALKTDELIDHISSLGVTAVELLPVHAFVDDQYLLEKGLRNYWGYNTLGFFAPQARYMSTRTVAEFKQMVARLHHAGLEVLLDVVYNHTAEGNELGPTLSFKGIDNASYYRLADDRRFYINDTGTGNTFDLTNVGALRMVMDSLRYWVQEMHVDGFRFDLASILGRERYGFDPSGSFLDAVRQDPVLSQTKLIAEPWDIGPGGYQVGNFPPGWVEWNDKFRDNVRAFWRGDSGQLAELATRLTGSADLFNHSGRRPTASVNFVTAHDGFTLRDLVSYETKHNLANGEDGRDGSDHNISSNYGVEGETNDPAIKQLRRQQMRNLLATLLLSQGTPMLLAGDEFGHSQNGNNNAYCQDNELTWIDWTAATKAAAADQAAFVRRLIRIRQRYPLLHRARFFDGKFDEALGLKDLTWLAPNGTEMDEAAWHDPEARALMLRLDGRSPTTGLREIAANVTLLMLINAASTAVSFTLPAMHDEHWRVLVDTARHGGRVVAGGSEWKAPAHSLTLLAVERDRIVSSARIVSEGAR

SEQ ID NO: 24239 - protein, 264 aa, Triticum aestivum
  misc_feature (234)..(234): Xaa can be any naturally occurring amino acid
  unsure (1)..(264): unsure at all Xaa locations
HYRTSLYKKAGWYRSGIPGISSTHASASAPAGAGALVKLGLLGGAALYLGNKTLYNVEGGHRAIVFNRLEGIKDKVYPEGTHIVIPWFERPIIYDVRARPNLVESTSGSRDLQMVRIGLRVLTRPMPERLPTMYRTLGENYNERVLPSIIHETLKAVVAQYNASQLITQREAVSREIRKILTERAKNFNIALDDVSITSLSFGKEFTHAIEAKQVAAQEAERAKFIVEKAEQDXKSAIIRAQGEAKSAELIGNAIANNPAFVAL

SEQ ID NO: 24240 - protein, 278 aa, Glycine max
MGVFSEDPNPNPNPIVIREVWASNLESEFELIRELIDRYPFISMDTEFPGVIFRPHVDPTKPFNHRNRPSDHYRLLKSNVDALNLIQVGLTLTDAAGNLPDLAGNRSIWEFNFRDFDVARDAYAPDSIDLLRRQGIDFARNTADGVDSTCFAELMMSSGLVCNDAVSWVTFHSAYDFGYLVKILTRRNLPTRLEEFLKTVKVFFGDNVYDVKHMMRFCDTLYGGLDRVARTLNVDRAVGKCHQAGSDSLLTWHAFQKIVDIYFVKEEHRKHAGVLFGL

SEQ ID NO: 24241 - protein, 278 aa, Zea mays
  misc_feature (95)..(95): Xaa can be any naturally occurring amino acid
  unsure (1)..(278): unsure at all Xaa locations
MQMQVGGGAADSPGAAAAAGAEAPRPSRYESQKRRDWHTFGQYLRNHRPPLELARCSGAHVLEFLRYLDQFGKTKVHAPGCPFFGHPSPPAPCPXCPLRQAWGSLDALIGRLRAAFEEHGGRPEANPFGARAVRLYLREVRDSQAKARGIAYEKKRRKRPSASSQSSPQAATTPPLQAPPVSTPALSDAAAERADVRAHVPDAGHGHQHHFFMPHPQFLHGFRLLPGNPEAVAGNGNGDGSSSSASVAAGSGDEIALAMAAAAEAHAAGCMLPLSVFN

SEQ ID NO: 24242 - protein, 199 aa, Streptococcus thermophilus LMG 18311
MTEEQVLNTHNAEILLSAANKSHYPQDDLPEVALAGRSNVGKSSFINTLLGRKNLARTSGKPGKTQLLNFYNIDDKLRFVDVPGYGYARVSKKERAKWGKMIEEYLVTRDNLRVVVSLVDLRHEPTQDDIQMYEFLKYYEIPVIVVATKADKIPRGKWNKHESIIKKKLNFDKNDHFIVFSSVTRDGYDEAWDTILAEL

SEQ ID NO: 24243 - protein, 548 aa, Neisseria meningitidis MC58
MKHLHDLPAWSKLWNHFDDSKTLHMREMFEQDPQRAERYWLQVGGLTLDYSKNRINDETMSLLFELAREAGVPERMRQMFHGEKINTTENRAVLHVALRNRTNSPIVVDGEDVMPKVNRVLQRMGEFAHEVRSGSWLGYTNQVITDVVNIGIGGSDLGPLMMCTALKPFGHPRLNMHFVSNVDGSQLRDVLSKVHPETTLFIIASKTFTTQETLTNALTAREWFLNHAGDEEAVAKHFAAVSTNQKAVAEFGIDTANMFEFWDWVGGRYSLWSAIGLPIMLYLGEENFIEMLNGAHLMDQHFINTPLERNLPVILALIGIWYINYYGGGSHVIAPYDQHLHRLPKFIQQLDMESNGKQVTLDGKAVGHETSPIIWGETGINGQHAFFQLLHQGTHITPIDLIASLEKRSNLPGHHEILLANVFAQAEAFMRGKTPDEVRAELKAQGMDEVRIEELVPHKTFSGNRPTNLILMDKVNPRNMGSLIAMYEHKTFVQGIIWGINSFDQWGVELGKQLAKTILGELTGETGPQKHDSSTERLINLYLQTNRK

SEQ ID NO: 24244 - protein, 354 aa, Magnaporthe grisea 70-15
MAIPSNPAKRRRIALGCEGSANKLGIGIIAHPPEGEVGDPVVLSNVRDTFVSPPGTGFLPKDTAAHHRSFFVRVAQQAIRDAGVTVAEVDCICYTKGPGMGAPLTSTAIGARTLALLWDKPLVGVNHCVGHIEMGRAITGADNPVVLYVSGGNTQVIAYAEQRYRIFGETLDIAVGNCLDRFARTLKISNDPAPGYNIEQLAKQGSVLLDLPYAVKGMDCSFSGILTRADELAAQMVAKPDLFTPADLCFTLQETVFAMLVEITERAMAHVGSTQVLIVGGVGSNERLQQMMGAMAKDRGGSVYATDERFCIDNGIMIAHAGLLAYETGFRTPLEESTCTQRFRTDEVHVKWRD

SEQ ID NO: 24245 - protein, 483 aa, Streptococcus thermophilus LMG 18311
MIVSTYYPKIFYCDKLVLLHLLEESMENHNYENEGQFQRKMTSRHLFMLSLGGVIGTGLFLSSGYTIAQAGPLGVILSYLVGAVVVYLVMLSLGELAVAMPVTGSFHTYATKFISPGTGFTVAWLYWICWTVALGTEFLGAAMLMQRWFPSVPAWIFAAFFALVILGINALSVRSFAEAESVFSSIKVIAIFVFIILGLGAMFGLVSFEGHHEAIMFKHLTANGLFPNGGLAIVSVMLAVNYAFSGTELIGIAAGETDNPKEAVPRAIKTTIGRLVIFFVLTIVVLASLLPMKEAGVSSAPFVDVFDKMGIPFAADIMNFVILTAILSAGNSGLYASSRMLWSLANEGMLNKKLVTINKHGVPMTALLISMAGAVLSLFSSIYAADTVYLALVSIAGFAVVVVWLSIPMAQINFRKQWKLEHSEDELDYKTPFNPILPYITIVLLAISVLGIAWDSSQRAGLYFGIPFMIFCYLYHYLCFNKW

SEQ ID NO: 24246 - protein, 1082 aa, Arabidopsis thaliana
MTEPERLGGISLSFPVNEEDTVTTTSPKTLPRRLRRRLLEPKSPVSAAEIDSKLREADLRRQQYYESLSSKARPKMRSPRSGSIEELSQRLESKLNAAEQKRLSILEKELARLAKMDEARQAAKNGLEQRVEKERDELESKVEERVLKAEKNRMLLFKAMAQRRAAKRQRAAQSLMKKAIQETRYKESVRAAIYQKRAAAESKRMGILEAERRRANARLTRVFGAASSVRSQKEAERRKMKDRLEERLQRAKKLKAQYMRRRRGMDSCSSSRSETMRKNQVHLVRMLVRCWRRFAKYKKSTFVLARAYHELGINEKSIESVPFEQFAIQMNSVSVIQTVKALLDRLEIRLTLSKASNVENINHLLKHIFPPVRRGKSPSPMSKGEQNSPNSKMGYQKLKKIARYPARIFLCAYMIKQHPGAIFRGRGEHEIALVESATCLIREFELLVKVILEGPESTLPGNVSFVAQRPKKFRSQLEAFDKAWCSYLEGFVVWKINDAKLLEKDLARTQESELSEVSKHTSSPKIIDSGLNQKTVKASSPTNRALFSETDGARESKAPADSHLPSSSSPSPGSSNLSPSLNSGSEAISTPNVVANSFDAALASENEVIVNEIVHDNSSSFVRVKETMEKAFWDGVMESMKQSQPDFSWVIKLMKEVRDELCEISPKDWRQEIVQTIDTDVLSQLLASGNVDMGYLGNILEFSLGILLKLSAPANEEEIRVTHHKLMTELGEIVPTDGHSNSSYAVLMVKGLRFVLQQIQILKKEISKSRLKLLEPLLKGPAGLEYLKKSFSSRHGSPDQASSSLPLTKRWLLSVRGEAEREWKEHKDALSAVINNHSGSSGLPSTTMRTGGNVSSVSKVNTPSSPFPGIELSECKGETVDLLVRIGLLKMVSEIGGLTLETVPETFQLNLSRLRDVQSQIQKITLVSISVLILQQTLVSENSSSIDMEAITRTCINRLYEMLDAKPDAGLSEIMETLSELLDSNDAETKKQVIANMLVKSLQAGDAVFTHVSQTIYLAIRAAVLAGNNTKRKQLVETMLRKIGAASLSDKVIEVSDILVLVATVSRSVHGLWYEELLKKPN

SEQ ID NO: 24247 - protein, 151 aa, Magnaporthe grisea 70-15
MGNTTSNVLDGIDNSGTIERDEFLSLPQISSNPLATRMIAIFDEDGGGDVDFQEFVSGLSAFSSKGNKEQKLRFAFKVYDIDRDGYISNGELFIVLKMMVGSNLKDQQLQQIVDKTIMEADLDGDGKISFEEFTKMVENTDVSISMTLDQF

SEQ ID NO: 24248 - protein, 176 aa, Fagus sylvatica
KLELHRGGGRSRTSGSPGLQEFGTRSELSKICDGILGLLETHLIPSASSAESKVFYLKMKGDYHRYLAEFKTGAERKEAAESTLLAYKSAQDIALADLPPTHPIRLGLALNFSVFYYEILNSPDRACNLAKQAFDEAISELDTLGEESYKDSTLIMQLLRDNLTLWTSDITDDAGD

SEQ ID NO: 24249 - protein, 605 aa, Dehalococcoides sp. BAV1
MKVLRGNILAVNDREFHLKELDPVLMKDWEIAEKAEDFLKPVKVLAMELGLTEDEIIPHGKYIAKVDFAGVLARLKDRPNGKYIDVTAITPTPLGEGKSTTTMGLVQGLGKLGKKVTGAIRQPSSGPTFNIKGSAAGGGLSQCLPLSPFSLGLTGDIDAVTNSHNLAMVALQARLQHEANNTDEFLSSRHLTRLDIDPSRVEMKWAMDFCAQSLREIIMGIGSKTDGYRMPSGFGISVSSEVMAILSVFTSLSDLRERMGKIIVAYRKNDEPVTTADLEVDGAMTALLLRAVNPNLLQTIEGQPVFVHAGPFANIAIGQSSIVADRLALKLADYHVTESGFGADIGFEKFWNIKCRLSGLKPDCAVIVVTARALKMHGGGPKVTPGTPLDPAYTTPNTKLVEKGCQNMLAHIQTVKTAGINPVVCINHFAADTHEEIDIIRRTAEQAEARVAVSHHWAKGGDGATELAEAVTDACNEPNNFHFLYPENMPLKKRIETIARKVYGANGVSYTPIAMEKLARIESMGDTQFMPTCMVKTHLSLSHDPALKGRPSGFTLPIRDILTYMGAGLVVPVAGDIKLMPGTSSDPNFRRIDIDTQTGKVKGLF

SEQ ID NO: 24250 - protein, 175 aa, Arabidopsis thaliana
MSINIRDPLIVSRVVGDVLDPFNRSITLKVTYGQREVTNGLDLRPSQVQNKPRVEIGGEDLRNFYTLVMVDPDVPSPSNPHLREYLHWLVTDIPATTGTTFGNEIVCYENPSPTAGIHRVVFILFRQLGRQTVYAPGWRQNFNTREFAEIYNLGLPVAAVFYNCQRESGCGGRRL

SEQ ID NO: 24251 - protein, 494 aa, Chlorobium tepidum TLS
MPKREDIKSILVIGAGPIVIGQACEFDYSGTQACRALKEDGYRVILVNSNPATIMTDIELADATYIEPITPYYVTKIIEKEKPDALLPTMGGQTALNTAVKLAESGVLERHGVELIGAKFRAIRKAENREFFGDAMRKLGLEMAKGFFVRNEKEAKEALEEIGLPIVIRPSFTLGGTGGGFAETKADYYDMVRRGLAESPIGEVLVEESLIGWKEYELEVIRDLADNVIIVCSIENVDPMGVHTGDSITVAPAQTLTDRQYQELRDASIKIIREIGVETGGSNIQFAINPKSGRIVVIEMNPRVSRSSALASKATGFPIAKVAAKLAVGYTLDEITNDITKTTPASFEPSIDYTVVKVPRWDFEKFKNVDSRLGVQMKSVGEVMAFGRNFREALQKSLRGLEIGRAGLGCDGKDIMNVIDMTQQQRKFAKEDLLEKIKIPKADRMFYLRYAFQAGATVEEIHQATGIDPWFLDNIRQIVEFEDELRQMAAGSAA

SEQ ID NO: 24252 - protein, 340 aa, Streptococcus thermophilus LMG 18311
MTVDLDWENLGFNYRKLPFRYISYYKDGKWDEGQLTEDATLHISESSPALHYGQEAFEGLKAYRTKDGSIQLFRPDENAKRLQRTADRLLMPQVPVEKFVDACKKVVRANEEYVPPYGTGATLYLRPLLIGVGDIIGVHPADEYIFTIFAMPVGNYFKGGLAPTNFLIQDEYDRAAPHGTGAAKVGGNYAASMLPGKIAHDSNFSDVIYLDPATHTKIEEVGSANFFGITADNEFITPLSPSILPSITKFSLLYLAENRFGMKAIQGDVKIAELDKFVEAGACGTAAVITPIGGVQHGDDFHVFYSETEVGPVTRKLYDELTGIQFGDVEAPEGWIVKVD

SEQ ID NO: 24253 - protein, 140 aa, Triticum aestivum
MEYQGQHGHATDKVEEYGQPVAGHGGATGGPTGTHGAAGAGGAQLQATRDEHKTDGVLRRSGSSSSSSSSEDDGVGGRRKKGMKEKIKEKLPGGAHKDATAGQQHTAVAGEYAGTHGTEATGEKKGVMDKIKEKLPGGQH

SEQ ID NO: 24254 - protein, 544 aa, Ralstonia metallidurans CH34
MPTDYDTGLARNPANYVPITPLDFIARAAEVYGDRLAIVHGTVRQNWRDTYARCRRLASALTRAGVGKGDTVAALLPNTPAMVEAHFGVPMAGAVLNALNIRLDAANLVFMLRHGEAKVLLADTEFADAARQMAREVRGLKVIAVEDVLGPDAERFGDTDYESFLASGDPEFDWKMPGDEWDAIALNYTSGTTGDPKGVVYHHRGAAMNAISNILEWDMAKHPVYLWTLPMFHCNGWCFPWTVAARAGVNVCLRKFEPKLVFDLMRDEGVTHYCAAPIVHTALVNAPPSWREGLRGPVRGMVAGAPPPAAVLAQMEAMGFDLSHVYGLTEVYGPAAVCAEQDAWHTVSQEERAVLKARQGVRYHLQSGVTVLDPDTMQPVPRDGETIGEIMFRGNICMKGYLKNDKATREAFAGGWFHTGDLGVCMPDGYIKIKDRSKDIIISGGENISSVEVEDALYRHPAVLAAAVVAQPDAKWGETPCAFVELKDGASVTAEELIAHCRTLLAGFKVPKAVYFGPLPKTSTGKIQKFELRKKMQSNAAIDV

SEQ ID NO: 24255 - protein, 183 aa, Glycine max
MKRPLSPSASGVNVEDRKMKKKAKAVENEDDNGERVEGLAHFDDNLLFEVLKHVDARTLAMSGCVNKQWHKTAQDERLWELICTKQWANTGCGEQQLRSVVLALGGFRRLHALYLFPLSKPQQTPSSSSSSTSSSSSSAWGPTIPQVIRSKPLRLGKDEVHLSLSLLSIRYYEKMNFNNRTTR

SEQ ID NO: 24256 - protein, 185 aa, Vitis amurensis
GDGGFGNVYRGAIHGGATPVAVKRLNPTSQQGTREFRTEIEMLSQLRHIHLVSLIGYCAEHGEMILVYDFMANGALRDHLYGTDNPPLPWKKRLDICIGAAKGLHHLHTGAKHTIIHRDVKTANILLDENWVAKVSDFGLSKLGPAGGSESHVSTVVKGSFGYIDPEYYLLQRLTDKSDVYSFGV

SEQ ID NO: 24257 - protein, 302 aa, Triticum aestivum
  misc_feature (21)..(21): Xaa can be any naturally occurring amino acid
  misc_feature (114)..(114): Xaa can be any naturally occurring amino acid
  misc_feature (194)..(194): Xaa can be any naturally occurring amino acid
  unsure (1)..(302): unsure at all Xaa locations
KDAAPPPRNKVSLFPTKFPQXFYTPCVPTFWSQTNLLGKIHPNNAMGYFMTVARWSFIGHLFWQKGPKIDPHQDLYNLPGPTYAAVFSFGATNCFTVQPCCVKLREQFSTREKXAGMYSPLSYALAQACLQITYNILQGMLYTILIYVMIGYDWKVDKFFYFMFFIIASFNYFTLFGMMLVSLTPSAMLASILXISFVLPLWNLFAGFLVVRTAIPIWWRWYYWANPVSWTIYGVVASQFGDHGGSLLVPGGSPMVVKQFLEDNLGVRHDFLGYVVLAHFAYIIAIFFVFGYSIKFLNFQKR

SEQ ID NO: 24258 - protein, 185 aa, Vitis amurensis
GEGGFGNVYKGFIKGGSTTVAVKRLNPSSKQGAREFETEIRMLSKLRHIHLVSLIGYCDEEGEMILVYDYMARGTLRDHLYKTKKPPLPWKQRLQVCIGAARGLHYLHTGAKHTIIHRDVKSTNILLDEKWVAKVSDFGLSRVGPTSMTQTHVSTAVKGSFGYVDPEYFRLRQLTEKSDVYSFGV

SEQ ID NO: 24259 - protein, 376 aa, Arabidopsis thaliana
MKIPAALVFIPVGVLFLISGLIVNIIQLVFFIIVRPFSRSLYRRINKNVAELLWLQLIWLFDWWACIKINLYVDAETLELIGKEHALVLSNHRSDIDWLIGWVMAQRVGCLGSSLAIMKKEAKYLPIIGWSMWFSDYIFLERSWAKDENTLKAGFKRLEDFPMTFWLALFVEGTRFTQEKLEAAQEYASIRSLPSPRNVLIPRTKGFVSAVSEIRSFVPAIYDCTLTVHNNQPTPTLLRMFSGQSSEINLQMRRHKMSELPETDDGIAQWCQDLFITKDAQLEKYFTKDVFSDLEVHQINRPIKPLIVVIIWLGFLVFGGFKLLQWLSIVASWKIILLFVFFLVIATITMQILIQSSESQRSTPAKRPLQEQLISA

SEQ ID NO: 24260 - protein, 359 aa, Herbaspirillum seropedicae
MSKTHRIAVIAGDGIGQEVMPEGLRAVQAASKKFGIDIEFTHFDWAHCNYYAEHGKMMPDDWFEQLKGFEAIYFGAVGWPATVPDHVSLWGSLLKFRRDFDLYVNLRPVRLMPGVPCPLANRKPGDIDFYVVRENTEGEYSSIGGRMYEGTERETVIQESVFSRKGTDRILKFAFDLAQSRPKKHLTSATKSNGIAITMPYWDERVEAMGAKYPDVRRDKYHIDILTAHFVLNPDRFDVVVASNLFGDILSDLGPACAGTIGIAPSANINPTRELPSLFEPVHGSAPDIFGKNIANPVAMIWSGAMMLDFLGDGQGKYRQAHDAMLAAIETVLVNGPTTPDLGGKSNTAEVGQAIAAAI

SEQ ID NO: 24261 - protein, 328 aa, Neisseria meningitidis MC58
MSSTPNKQAGYPRLVADIGGTNARFALETAPRVIEKAAVLPCKDYDTVTDAVRAYLNQSGATAVRHAAFAIANPILGDWVQMTNHHWAFSIETTRQTLGLDTLILLNDFTAQALAVTQTSSKDLMQVGGQKPVEFAPKAVIGPGTGLGVSGLVHSHAGWVALAGEGGHTSFPPFDDMEVLIWQYAKNKYGHVSAERFLSGAGLSLVYEALAAKQKAKPAKLMPSEITEKALSGASPLCRQTLDIFCAMLGTVASNLALTLGARGGVYLCGGIIPRVLEYFKTSPFRSRFENKGRFEAYLAAIPVYVVLSEFPGISGAAAALDNHLRNV

SEQ ID NO: 24262 - protein, 513 aa, Mesoplasma florum L1
MKNTQILILDFGSQYTQLLARRVREANIYTEVLPFDTSIEKIKEYPLLKGIILSGGPSSVYLQNAYKIDSEILNLDIAILGVCYGMQLLTQYFQGAVELADEQEFGKAIITIDDKKNPLFKNVTTESQVWMSHADHVTELPVDFKQIAHSNASIAAIAHNTKPIYGIQFHAEVTHSLQGKEMLENFLYDIAKCNKDWNLDDFIDQQIKEIKETVKDKQVILGLSGGVDSSVAAAIIGKAIGKQLTCIFVDTGLLRKNETIEVMKAYETNFDINIKLVEASDLFFSELKGIKEPEAKRKIIGKCFIDVFTDAARQHKDADFLAQGTIYPDVIESSSHGASSKTIKSHHNVGGLPEDLKFRLIEPLRNLFKDEVRQVGFKLGLPEEMINRHPFPGPGLGIRVIEEVTKDKVEILQEADAIFIKKLREWNLYNTVSQAFVTLLPVKTVGVMGDNRTYDYVVALRSVNTIDFMTATSTHLPWEFLDEVVNEIINKVDNVNRVVYDVTSKPPGTIEWE

SEQ ID NO: 24263 - protein, 336 aa, Archaeoglobus fulgidus DSM 4304
MKINLEELKFGTELIKRGFAKMQKGGVIMDVTNAEQAAIAEEAGAVAVMALHKVPADIRAAGGVARMADPKKIQEIIDAVTIPVMAKCRIGHIAEARALEALGVDMIDESEVLTPADVFFHIDKRKFVVPFVCGARSLGEAVRRIWEGAAMIRTKGEAGTGNVVEAVKHMRLINRAIFELQKMNEERIYGVAEKYASRYAELASRVREEMGLESVSRNDVVFEEYTLGEIIDGIYEILLEIRELGRLPVVNFAAGGVATPADAALMMQLGADGVFVGSGIFKSSNPPEYAKAIVEAVQHYDEPEVVAEVSKGLGEAMKGLDVFKLSEDERLQTRGL

SEQ ID NO: 24264 - protein, 346 aa, Neisseria meningitidis MC58
MKAMVYHGANDIRFEEKPRPQIIDPTDAVVKIVKTTICGTDLGIWKGKNPEVADGRILGHEGIGIVEEVGEAVKNIKVGDKVIISCVSKCCTCDNCKTQLYSHCRNGGWILGYMIDGTQAEYVRTPYADNSLVPLPDNVNEEIALLLSDALPTAHEIGVQYGDVKPGDTVFIAGAGPVGMSALLTAQLYSPAAIIVCDMDENRLKLAKELGATHTINPASGEVSKQVFAIVGEDGVDCAIEAVGIPATWNMCQDIVKPGGHIAVVGVHGQSVDFKLEKLWIKKLAITTGLVNANTTEMLMKAISSSSVDYTKMLTHHFKFSELEKAYDVFKHAAENQVMKVVLEAD

SEQ ID NO: 24265 - protein, 105 aa, Zea mays
  misc_feature (52)..(52): Xaa can be any naturally occurring amino acid
  misc_feature (88)..(88): Xaa can be any naturally occurring amino acid
  unsure (1)..(105): unsure at all Xaa locations
IRLEERYIASELCEALCPGQAPAIEAEERGDGTLRTTSIEFAMTRCMNCGFXREASPGYALDEGPNSECRPETHEELLSTRRIVEKAXRWETEIAHNLRPESLYR

SEQ ID NO: 24266 - protein, 149 aa, Brassica napus
  misc_feature (53)..(53): Xaa can be any naturally occurring amino acid
  unsure (1)..(149): unsure at all Xaa locations
MEQTFIMIKPDGVQRGLVGEIICRFEKKGFTLKGLKLITVDRPFAEKHYQDFXSPSPFFSSLVDYIISGPVVAMIWEGKNVVLTGRKIIGATNPAASEPGTIRGDYAIDIGRNVIHGSDSVESANKEAALWFPDGPVNWQSSLHSWIYE

SEQ ID NO: 24267 - protein, 325 aa, Acinetobacter sp. ADP1
MAIDFKQDILAPVASDFAAMDTFINEGITSKVALVMAVSKHVVEAGGKRMRPIMCLLAAKACGSTDLEQHRKLAAIIEMLHTATLVHDDVVDESGLRRGRPTANATWNNQTAVLVGDFLISRAFDLLVDLNDMVLLKDFSTGTCEIAEGEVLQLQSQHDPETTEQTYLNIIHGKTSRLFELATEGAAILSGTPEYREPLRHFAGHFGNAFQIIDDILDYTSDAETLGKNIGDDLMEGKPTLPLISALQHTQGEEHDIVRRSIATGGIHQLEQVIQIVQQSGALDYCRKRAEEETQAALAALQHLPESEARQALFNLTQLALHRIQ

SEQ ID NO: 24268 - protein, 469 aa, Rhizobium leguminosarum bv. viciae 3841
MATASEILKQIKENDVKFVDLRFTDPKGKLQHVTMDVVCVDEDMFADGVMFDGSSIGGWKAINESDMVLMPDTETVHMDPFFAQSTMVIVCDILDPVSGEAYNRDPRGTAKKAEAYLKASGIGDTVFVGPEAEFFVFDDVKYKADPYNTGFKLDSTELPSNDDTDYETGNLGHRPRVKGGYFPVPPVDSAQDMRSEMLTVLSEMGVVVEKHHHEVAAAQHELGIKFDTLVRNADKMQIYKYVVHQVANAYGKTATFMPKPIFGDNGSGMHVHQSIWKGGKPTFAGDEYAGLSESCLFYIGGIIKHAKAINAFTNPSTNSYKRLVPGYEAPVLLAYSARNRSASCRIPFGSNPKAKRVEVRFPDPTANPYLAFAAMLMAGLDGIKNKIHPGKAMDKDLYDLPPKELKKIPTVCGSLREALESLDKDRKFLTAGGVFDDDQIDAFIELKMAEVMRFEMTPHPVEYDMYYSA

SEQ ID NO: 24269 - protein, 490 aa, Rhizobium leguminosarum bv. viciae 3841
MSKHLFDLLLTPAEMAAVDAAAAASGIDSFGLMEKAGASVAAAALRLHPGALRFVILCGPGNNGGDAYVAARHLHESGARVALFHLGDPMRLKGDAARARIGCALEGQGLDLYRPETGDVVVDGLFGAGLGRAVSADVRALIERVTEAAIPVLAIDLPSGLDGRTGKVLGAAFRACNTITFMTRKPGHLLMPGRELCGELEVFDIGIPARIVRAEAGGIIAENTPDAWKSALPAGQLETHKYKRGHLVVFSGEADKTGAARMSAISGLKAGAGLVTIAAPRAAIAANAAHLTAVMLHAIDDEADLGDWLSDKRLQTFVLGPGFGIGARARGFVSALADRHLVLDADGISSFKDDPQQLFDLFRGEPRLVLTPHEGEFARLFPDIGGDDGLGKVDKAVAAARRANAAIIYKGADTVIAAPDGRALINTNAPVWLATAGSGDVLAGIIGGLLAQGLPAFEAAAAGVWLHGKAGQRAGKGLTAEELAAEVLPL

SEQ ID NO: 24270 - protein, 185 aa, Vitis amurensis
GEGGFGNVYKGYINGGTTLVAIKRLNPESQQGAHEFMTEIEMLSQLRHIHLVSLIGYCNHKREMILVYEYMANGNLRDHLYNTDNPPLPWTQRLQICIGAARGLHYLHAGVKKTIIHRDVKTTNILLDHKWVAKVSDFGLSKMSPTSVANAHISTVVKGSFGYLDPEYFRFQRLNEKSDVYSFGV

SEQ ID NO: 24271 - protein, 506 aa, Herbaspirillum seropedicae
MNLADISKLGVRDPFKQRYDNFIGGKFVPPVKGEYFENISPVIGRAFCEVARSSAEDVELALDAAHAAKKSWGKTSPTERANMLLKIADRMEANLELLATAETLDNGKPIRETMAADIPLAIDHFRYFAAAVRTQEGSICPIDNDTYAYHFHEPLGVVGQIIPWNFPILMAVWKLAPALAAGNCVVLKPAEQTPASIMVLIELIADLIPPGVVNIVQGFGVEAGKPLASNKRIAKIAFTGETTTGRLIMQYASQNLIPVTLELGGKSPNIFFADVLDKDDDFFDKALEGFAMFALNQGEVCTCPSRVLVQESIYERFIERALKRVAAIKQGNPLDKSTMIGAQASQEQLEKILSYIDIGKQEGAKVLAGGGREELGGDLASGYYVKPTVFQGNNKMRIFQEEIFGPVVSVTTFKDEEEALAIANDTLYGLGAGLWTRDGTRAFRMGREIQAGRVWTNCYHLYPAHAAFGGYKQSGIGRENHKMMLDHYQQTKNLLVSYSPKALGFF

SEQ ID NO: 24272 - protein, 337 aa, Pseudomonas syringae pv. syringae B728a
MTLHYVPIINLAPYFSEDPDGKAAVARAVNQACRDIGFLVITEHQIPGELIDSVSRLTRQFFDLPLAEKRKVDRPSPEMVRGYSAVAEESLSYSLEESAPGDLKESFSIGPSDVPDEDYYHNAQAGSHFAPNVWPAQDLLPGFKESYQAYFDAMSELAQSLMRLFALALELDECFFDDKIDRHISMFRSLSYPDIKTEVEAGQLRASAHTDYGSLTIVRPDNALGGLQVRNRQGEWVDVPYVENGFVVNIGDLMMQWTNDQWISTLHRVVNPPMTSEQDNRRQSLVFFHQPNYDTLIQCLPGCLQPGATPRHAPVTSGDHLLSKFVKQTTFGGSKVA

SEQ ID NO: 24273 - protein, 320 aa, Deinococcus radiodurans R1
MPDAAFETRMREVLRSDVEFIAIIGEDLVTAGGKRVRPLVTLLAAQALGAGPDALATSHSWDELLRLSVCVELLHSASLLHDDLIDDSDKRRGQETAFRRFGNVVSVMSGDFMLARLLGELSGMPGSPALTRAFGQAASVICEGEVLQFQVASYADYSFENYFQVIHGKTAALLELAAQAPAMLLGADDSARDALSTFGREYGMAFQMQDDLLDLLGEEAQIGKPVGGDLREGKATYPVLCLLGGPHDAEVRAILERRAGEDGDVARMIALARQERTDDCTREEIRRRARLAIAALDALPPSPARTALAALAERELNRTH

SEQ ID NO: 24274 - protein, 358 aa, Zea mays
MQSKHRVFAEDLLLAAAAEGEDHFDRVPDSLVLLIFNKLADARSLGRCSAVSRRFSALVPLVDDACLRIDRVIPADAADAGAPRPRAALSHLLKSVLLAVLKPFAHCDAKSASPQKHAHQQQQHHSPAQVLRNFSSIRSLRMELPVSDVGTDDGVVLRWKAVFGSTLQSCVILGGTRVDRAGPPHAPSSGSAPPAGDDDGGSIPESLYTNGGLKLRVVWTISSLIAAATRHYLLREIVKEHPTLERVALTDAGGQGTLSMGRDQLREFRDRPLAAAPAAAANRTQVPACNMKLRYAPLLELSDGTRIHGATLVVIKPVGDAGGKDLDELGAGAFDGPLREAVAALGKRRAYLLEMNGF

SEQ ID NO: 24275 - protein, 655 aa, Mesoplasma florum L1
MINKNNNNLNALRILGVSAINKANSGHPGIVLGAAPIVYTLFNKIMKHNPKNPKWFDRDRFVLSAGHGSALLYSALHLAGYNLSMDEIKNFRQWNSKTPGHPESHLTEGVDVTTGPLGQGIAMAVGLAIAESHTASVYNQSDLKLVDHHTFVLCGDGDLQEGVAQESISLAGRLKLNKLILIHDSNDIQLDDKVEKAQSENMHERFKAAQWNTLKINDGEDLVAIEKAINDAKVSDKPTYIEVKTIIGIGATKQGTSAVHGAPIGSDIETVKNVFDWKFDDFEIPTDIYKHWNENISKNLIIEKKWNETLNTLKTKNPELAKQFTDAINKEINFDFEALKGKTPEKAEATRVSSGNIWDSINSQVKFLIGGSADLVSSTRIKGADGQFDIDNRSGRNILYGVREFAMGAINNGIHQHGGLIPFSSGFFVFSDYMKPAMRLSSIMNTQQLFIFTHDSVAVGEDGPTHQPIEQLAMIRSIPNHITFRPADYAETLASYKIALQDLKKCPSTLVLTRQDLVQLPHNDVYEEVKKGAYIIFDQPNASVTLIATGSEVGLAIETAKRLKEDNIIAKVVSMPSTNLFDQQDQSYKDKIIDKSTLRVSIEMGTTYGWSKYTGDNGLNIGIDVFGASAPANTVISQYGFTSEQIFNKIKKVIK

SEQ ID NO: 24276 - protein, 574 aa, Lotus japonicus
MEGKGYTLDGTVDLAGRPVLSSLTGKQKACTYILVYRVLERFAYYGVGANLVNFMTTQLNKDVVSSITSFNNWSGLATLTPILGAYIADTYTGRFWTITFSLLIYAIGLVLLVLTTTLKSLRPACENGICREASNLQVALFYTSLYTIAVGSGAVKPNMSTFGADQFDDFRHEEKEQKVSFFNWWAFNGACGSLMATLFVVYIQEKNGWGLAYSLSAIGFLLSSIIFFWGSPVYRHKSRQARSPSMNFIRVPLVAFRNRKLQLPCNPSELHEFQLNYYISSGARKIHHTSHFSFLDRAAIRESNTDLSNPPCTVTQVEGTKLVLGMFQIWLLMLIPTNCWALESTIFVRQGTTMDRTLGPKFRLPAASLWCFIVLTTLICLPIYDHYFIPFMRRRTGNHRGIKLLQRVGIGMAIQVIAMAVTYAVETQRMSVIKKHHIAGPEETVPMSIFWLLPQNIILGVSFAFLATGMLEFFYDQSPEEMKGLGTTLCTSCVAAGSYINTFLVTMIDKLNWIGNNLNDSQSRITIMPFFSVISALNFGVFLWVSSGYIYKKENTSTTEVHDIEMSAEKTVKY

SEQ ID NO: 24277 - protein, 141 aa, Herbaspirillum seropedicae
MAIERTLSIIKPDAVAKNVIGQIYTRFENAGLKVIAARMAQLSRAEAEGFYAVHRERPFFKDLVDFMVSGPVMIQVLEGEGAILKNRDLMGATDPKKAEKGTIRADFADSIDANAVHGSDADETAKVEIAYFFPALNVYSR

SEQ ID NO: 24278 - protein, 356 aa, Xanthomonas campestris pv. vesicatoria str. 85-10
MDELTHVPADTSQHASAPYNAAATRGEIAMSSPITLIEAITQALAWELEHDPAVLVLGEDVGVNGGVFRATAGLQQRFGSDRVLDTPLDETTIAGLSVGLAAQGMKPVAEAQFDGFVYPMVDHLICHAARLRNRTRGRLHCPMVLRVPWGGGIRAPEHHSEANEAIFTNVPGLRVVLPSSPQRAYGLLLAAIRDPDPVIYMEPKRIYRQYKEVVANDGQALPLDVCFVLRDGTDVTLVTWGAQVKEALEAADKLAGEGISAEVIDVATLRPLDFDTIAESVAKTGRCVIVQEAPRTAGFGAEIAARLAEQSMYDLVAPVERVTGYDTHIPLFRLEMKFLPSVERIVAAARRAVAAG

SEQ ID NO: 24279 - protein, 132 aa, Zea mays
APVVSLHSVGVLSYSTYSPPSVPSPFPLELPHSAAHSFPPFSSLHHIIHSIHTFTPLNCSICIPLTTFIIQSATLPLLFNQFNATTKLISLNTHIQLIKDHMNNIDPKSLHYLQPNISTLFQKHGLNPLTPI

SEQ ID NO: 24280 - protein, 362 aa, Xanthomonas campestris pv. vesicatoria str. 85-10
MSVAAQFQIDYLQYMDADGQWVRDDLPADAANPQQLLALFKRMLFVRTFDTKSVALQRTGKLGTYAACIGHEATHVGIGASMRSGDVFAPSYREYGTMFERGVRPRDVLLYWGGDERGSDYPRDADAAIDFPICVPISTQCLHAAGSALSFKLQGKPQVAVACCGDGGSSKTDFYAALNSAGAYKLPLILCVINNGWAISVPRSAQTGAQTLAQKGLAGGLQCLQVDGNDLVAVLEAMRQARVRALAGDGGTVIEFLTYRLSDHTTADDARRYRGEEEVKQGWAREPLLRLRRYLTAQGLWDAAQEDAWKAECSARVDEEVNAYLNTPVQPVEAMFDYLYGDPPAELLAQRAEVMALESRHG

SEQ ID NO: 24281 - protein, 185 aa, Chromobacterium violaceum ATCC 12472
MPSSRPAPAILSLANVSANMKYGNIVVMGVAGCGKSSVGRLLAEAIGARFIEGDSFHPPENIQRMRAGIPLGDDDRAGWLANLAAQLRQGRDSGEPLVLACSALKRRYRDVLRDGDPGLRFVHLYGDKALIAERMRERSGHFMPESLLDSQFRDLEAPGADESAIPCDVSLPPEALLPRILAELG

SEQ ID NO: 24282 - protein, 435 aa, Chromobacterium violaceum ATCC 12472
MHAPSPQHNKIPARRWRIGWLLGIGILVNYFDRISLSVAAPQLQQEFGLSNGELGLLFSAFFWSYALLQIPTGVILDRFGTTRIGRLGALLWGVAATLTACAGGFAGIFAARMLLGVAEAPGFPVSSKATGYWFPRRERAMATAIFDAAAKFSNVIGVPLVALAVVHLGWRWGFGVSAILSVLYFIAFYLIYRDPSADTKLSEAERQYIVQGGAAEEGVSQQGSMAMLGYLLRQRKVWGLSIGFAAYGYVFYLFLTWLPGYLVQSMHMDILKSAWFSAIPWMFATLSDLFVGGWLIDKLIERGYDETKVRKAVLLCGMAMGMAVFGATTTSDPYVAIVWITIALSGLAAAAPVGWSLPSLIAPRGGTGTVGGIMNFANNMMGAVAPIVTGFIVGATHSFANAFLVAGFMLVIGILAFVFLLGRIEPLPEPGVSPD

SEQ ID NO: 24283 - protein, 413 aa, Erwinia carotovora subsp. atroseptica SCRI1043
MADSTSPRRFTRIDRLPPYVFNITAELKMAARRRGEDIIDFSMGNPDGPTPPHIVEKLCTVAQREDTHGYSTSRGIPRLRRAISRWYADRYEVDIDPESEAIVTIGSKEGLAHLMLATLDHGDTVLVPNPSYPIHIYGAVIAGAQVRSVPLVEGVDFFNELERAIRESIPKPKMMILGFPSNPTAQCVELDFFERVVELAKQYGVLVIHDLAYADIVYDGWKAPSIMQVPGAKDIAVEFFTLSKSYNMAGWRIGFMVGNSELVNALARIKSYHDYGTFTPLQVAAIAALEGDQQCVRDIAEQYRQRRNVLVRGLHEAGWMVDEPKASMYVWAKIPDAYAHLGSLEFAKRLLSEAKVCVSPGIGFGDYGDTHVRFALIENQDRIRQAVRGIKTMFRADGILPTTKPLAGKGPAA

SEQ ID NO: 24284 - protein, 610 aa, Arabidopsis thaliana
MVANNNTSSNRRKRIITEGDIATLLLRYDMEMILRMLQEISYCSETKMDWNALVKKTTTGITNAREYQLLWRHLSYRHPLLPVEDDALPLDDDSDMECELEASPAVSHEASVEAIAHVKVMAASYVLSESDILDDSTVEAPLTINIPYALPEGSQEPSESPWSSRGMNINFPVCLQKVTSTEGMNGNGSAGISMAFRRKRKRWSAEEDEELFAAVKRCGEGNWAHIVKGDFRGERTASQLSQRWALIRKRCHTSTSVSQCGLQGTEAKLAVNHALSLALGNRPPSNKLAIGLMPTTSSCTITETEANGGSSSQGQQQSKPIVQALPRAGTSLPAAKSRVVKKTTASSTSRSDLMVTANSVAAAACMGDVLTAASGRKVEPGKTDAPRVPKTKPVKHASTVCMPQPSGSLSMPKVEPGTSVAASIRSLANGKLKPVMASSSSNKPPLIAPRSEGSSMLSASAPLASLSRIVSNQRVFAGSVPATEIVTCKPDGGQKGQARGNEASSSAAIQPHQITSRNLEISQGKQATQAQSPNLLPRKVPVVRTAVHCATNQKLMDKPSDQTVVPIRGAGSQSKAKGEVNSKVGPVIKVSSVCGKPLEVATVAGTGQGV

SEQ ID NO: 24285 - protein, 346 aa, Deinococcus radiodurans R1
MPLLLDLHPDHYPLEGFRRKQLLEWVFVQGVGTFDAMTNLPAGLRAELESEYQLNPFRDIETVRSHDGSVKYLFTLNDGRQMEAVYMPYLDRKTICVSTMVGCPARCAFCATGKMGFGRNLTPGEIVGQVLAVAGGEGISPREIRNLVFMGMGEALLNYENSMAAARVLLHPDALGMSKRRVTLSTVGIAKGIRRLAEEDDLGIKLAISLHAPDEETRQQIIPTGAANSIEEIMAAARDYQAVTGRRVTMEYTMLRGVNDHLWQAELLADRLDGLVSHVNLIPMNPWDGSDFVSSSEEQIQAFYDALQDRGVDVSVRRSRGKDAGAACGQLALRRPGARTGEVGAA

SEQ ID NO: 24286 - protein, 163 aa, Vitis amurensis
GEGGFGRVYRGFLRERSSYIAVKRISRRSKQGMKEYASEVKIISRLRHRNLVQLMGWCHKKGELLMVYEFMPNNSLDSCLFEAKTLLRWAMRYKIAVGLALAVLYLHEEWEQCVVHRDIKSSNVMLDSDFNAKLGDFGLARFVDHGKGSQTTVLAGTLGYIAR

SEQ ID NO: 24287 - protein, 553 aa, Medicago truncatula
MNGLVGMRKIKSQCSISGMNGPVGIRKIRSQCLLSEMDAFDLSGLLDNPRLNIERQRSVDDSLLSELSIGARSFSSAQNSFEPQPMLADAWESLRKSLVYFNGKPVGTLAAVDHQSEEVLNYDQVFVRDFVPSALAFLMNGEPEIVKNFLLKTLRLQGWEKRVDQFKLGEGVMPASFKVLHDAVRKTDTLIADFGESAIGRVAPVDSGFWWIILLRAYTKSTGDLTLSESDDCQKGMKLILTLCLSEGFDTFPTLLCADGCCMIDRRMGVYGYPIEIQALFFMALRCALSMLKQDTADDKEYVELVVKRLHALSFHMRSYFWLDFQQLNNIYRYKTEEYSHTAVNKFNVNPDSIPDWLFDFMPKCGGYFIGNVSPARMDFRWFALGNCVAILSSLATPEQSTAIMDLIEARWDELVGEMPLKISYPAYEGKDWEINTGFDNKNVTWSYHNGGSWPVLMWLVTAACIKTGRPQIARRAIELAESRLLEDGWPEYYDGKLGRYVGRKARKYQTWSIAGYLVSKMMLEDPSHLGMISLEEDKQMKPVHKRSSSWTC

SEQ ID NO: 24288 - protein, 335 aa, Saccharomyces castellii
MSEPAQKKQKTTGSSLEQLKASGTVVVADTGDFASIAKFTPQDSTTNPSLILAAAKQPAYAKLIDVAVSYGKKNGKTTDEKVELAVDRLLVEFGKEILKIVPGRVSTEVDARLSFDKEATIAKALEIIKLYEDLGISRERVLIKIASTWEGIQAARELESKHKIHCNLTLLFSFSQAVACAEAKVTLISPFVGRIMDWYKAKTGETYNGRNDPGVLSVHKIYNYYKKHGYKTIVMGASFRNVDEIKNLAGVDYLTISPNLLDELLNSNDHVPRVLDVATAKKEGAEKISYIDDEATFRFSLNEDAMGTEKLAEGIRKFSADIVTLFDMIEKKVTA

SEQ ID NO: 24289 - protein, 263 aa, Haemophilus influenzae R2846
MARRPLVMGNWKLNGSKAFTKELIEGLKAELHDVTGCDVAIAPPVMYLGTAEAALSGCGCNCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 24290 - protein, 198 aa, Mesoplasma florum L1
MFKQSVFIKSAANKSGWIEDNIPEVCFVGRSNVGKSSFINTLANNKKLAKVANTPGKTRLLNFFDINNSSFRLVDAPGYGYAKISNSMKVEFGIMMEDYLTTRENLKLVCMLVDLRHKPTNDDVQMYDFLKANDIPVLMIGTKLDKLKRNEIAKNEKLIKETLEFDQNDVFVKVSNLDKINIKESYDALIRLLEVENG

SEQ ID NO: 24291 - protein, 366 aa, Brassica napus
MTMNSLPRRFGRDQGYLDRDRRRGRRSGSDSDEELKGLSHEEHRRLKRLKMRKSGKHCIWRNTPSPPRDPNEVESDENAADEEVPEKDEEDPKSESGKSESESDRSRKKRKSKSSRSKRSRRYSDSESEDSESDDSDEEDRRRKEKKKSSRKRRGHRRKRRYSDSDDESEISASSSSPARPSKSKSKRDTDSKGKLEEAVKEPELDEEEMKMIIESKKKALPEDEEEEAEVGPMPLPKAEGHISYGGALRPGEGDAIAQYVQQGKRIPRRGEVGLNADEIQRFEDLGYVMSGSRHQRMNAIRIRKENQVYSAEDKRALAMFNYEEKAKREAKVMSDLSRLVQRHMGEELGPNHDPFGAGKTDGADD

SEQ ID NO: 24292 - protein, 203 aa, Brassica napus
MGCFGPSKSSRTRNKERDTTRGSPPPQPQQQTVRAEEILLHIPRCRVHLIDESEAVELASGDFNLVKVSDNGVTLAMIVRIGHDLQWPVIKDEPVVKLDARDYLFTLPVKDGDPLSYGVTFSSDERDVAVANSLKLLDEFLKENSGFSCSASSKVDKGIDWKELAPRIEDYNNVVAKAIAGGTGHIIRGLFSCSNAYTNQVHK

SEQ ID NO: 24293 - protein, 648 aa, Nocardioides sp. JS614
MTETPTRTRRARADRPPPDWEQVYRRNFLERLKRDRPPVDVRAELPDLIARGYEAVPEEDMVRLHWWGIAHDKPKVGTFMVRVKVPGGVLTASQVRGLGRIAREHARDGVELTTRQGVQLHWVSMADLPTVVAEVEAIGLSTAGAEGDTVRNVTGCPVAGLSGHDVFDVTDVVREVAAFFGSHPDYKNLPRKHKYTISACPAQCNAPEISDVALVAVLQNGRRGFALRVGGGMANTPRISRDVGVFIPVEDTVEVLRAVTDAWQTDLRYRMSRARARIKFMIDDLGPEAFRARVEHQLGHALGDGVAPDPVGGADHLGVHPQRDGGRVYVGVPVPSGRLSGTTLTHLADLVDDIGGDLRLTRQQNFVLGHVPGARVEEVSARLAELGVPVDRSRAVGRSVACTSNRFCNYSVAETKDKLDGILTRLEATHGAERLSDLAIHLDGCPHACAQHWVGEIGLQGTTTHDPDTGERVEAYDLSVGGGLGRRTAIGRRLVRRVPTKDVEDVLDRLVGAWLAEQDRTGGRPSFGEFCDLLEDDELLAVSVGARGSVAGPGERVDAGVLVRVPGPLQRYVDGADELSVDGRTVGGVLAEVTRRHPQFGSTVLPDGEVAGAFLVTVGDQDIRGLQGLSTDVTPNDTITIVMAMAGG

SEQ ID NO: 24294 - protein, 781 aa, Arabidopsis thaliana
MTDEVDGDAWLSDLVDVSFLATKTAEQSEMIETGGDKQSSVEEGCGGRTILVGVKLDAPSRELLTWALVKVAEPGDTVIALHILGNEIVDRAGNSSLLSLVRTFDSVLDVYEGFCNLKQVDLKLKLCRGSSARKILVREAKSFSATKVLVGISKSHHAIRSSASVAKYIAKKLSKDCWVIAVNNGKILFQKEGSPSSTINQSQGKEDVRRITLLNVLQRSVTLNKTTKVVSHSEEDSNSKEEEEDQACGQNLRQVLAAARLENCSVCGFDSLSPNDTTTPGKLSGASDFDRSEDDDECNKAMEIVPVNGSEDSGGSVTMLVRKLPEPRPGWPLLRRAVSTLGQSVTPHKIPVVQWALKLPPRDTKQLGYDSSEDNLSTLNALRFSSTCRFFKYKELVSVTSNFSADNFIGKGGSSRVFRGCLSNGRVVAVKILKQTEDVLNDFVAEIEIITTLHHKNIISLLGFCFEDHNLLLVYNYLSRGSLEENLHGNKKDPLAFCWSERYKVAVGVAEALDYLHNTASQPVIHRDVKSSNILLSDDFEPQLSDFGLARWASISTTHIICSDVAGTFGYLAPEYFMYGKVNDKIDVYAFGVVLLELLSGRKPISSGCPKGQESLVMWVCTTANQLSQNQAFSILLLKTSMYDVHIQAKPILDDGKYSQLLDPSLRDNNNNNDDQMQRMALAATLCIRRSPQARPKMSIVLKLLKGDEDTLEWAMQQVNSSSEESEMLKDEQCQRSNLQSHLNLALLDVEDDSISMGSIEQGVSVEDYLKGRTSRSSSFD

SEQ ID NO: 24295 - protein, 193 aa, Mycoplasma pneumoniae M129
MEARFLKSASDLESCPQDSVKEVCFMGRSNVGKSSLINAFFQKKLAKTSATPGRTQLLNFFEYNRKRFVDLPGYGFAKLSKVQKEAITNLLTQFLNFRQNLTGVVLVIDSGVVTVQDQEVVKTILQTGLNFLVIANKFDKLNQSERFHTQNKLAHFLKVNPNKCLFVSAKTGYNLQVMHKQIFELFKADGQAI

SEQ ID NO: 24296 - protein, 271 aa, Haemophilus influenzae Rd KW20
MINKDTQLCMSLSGRPSNFGTTFHNYLYDKLGLNFIYKAFTTQDIEHAIKGVRALGIRGCAVSMPFKETCMPFLDEIHPSAQAIESVNTIVNDNGFLRAYNTDYIAIVKLIEKYHLNKNAKVIVHGSGGMAKAVVAAFKNSGFEKLKIYARNVKTGQYLAALYGYAYINSLENQQADILVNVTSIGMKGGKEEMDLAFPKAFIDNASVAFDVVAMPVETPFIRYAQARGKQTISGAAVIVLQAVEQFELYTHQRPSDELIAEAAAFARTKF

SEQ ID NO: 24297 - protein, 278 aa, Streptococcus thermophilus LMG 18311
MKVDEDLVRQVIRPRLRESHKGSYGRVLLVGGLYPYGGAIIMAAIACVNSGAGLVTVATDRENIIALHAHLPEAMAFDLRETERFLDKLRAADVILIGSGLGEEETADWALELVLANIRSNQNLVVDGSALNLLAKKNQSSLPKCHLILTPHQKEWERLSGLAISEQSVSNTQRALEEFQSGTILVAKSHKTAVYQGAEVTHLEVGGPYQATGGMGDTLAGMVAGFLAQFASTDSYKAVIVATWLHSAIADNIAENAYVVLPTRISKAIPSWMKKLSL

SEQ ID NO: 24298 - protein, 369 aa, Arabidopsis thaliana
MAENQNCARMTRAAAKRKASSMALDENPVSKKRVVLGELPNMSNVVAVPNQERETLKAKTSVNTSKRQMKKALMIPEASVLIESRSVDPQMCEPFASDICAYLREMEGKPKHRPLPDYIEKVQSDLTPHMRAVLVDWLVEVAEEYKLVSDTLYLTISYVDRFLSVKPINRQKLQLVGVSAMLIASKYEEIGPPKVEDFCYITDNTFTKQEVVSMEADILLALQFELGSPTIKTFLRRFTRVAQEDFKDSQLQIEFLCCYLSELSMLDYTCVKYLPSLLSASAVFLARFIIRPKQHPWNQMLEEYTKYKAADLQVCVGIIHDLYLSRRGNTLEAVRNKYKQHKYKCVATMPVSPELPLAFFEDITIRGMA

SEQ ID NO: 24299 - protein, 242 aa, Brassica napus
  misc_feature (145)..(145): Xaa can be any naturally occurring amino acid
  unsure (1)..(242): unsure at all Xaa locations
MDPIESIDYDGFETYNGNTTHVDHGWKKVVYPKRHRKQKPADQTATNGQNVDVANGDNVFRSLEEQAEDRRKRILAAKMAAVDVEDEPNGSRSYGYDESDDEIAAMNEKKKAEETKKPKPKKEKKPKVSLPEAAAKIDPSNLEAXFLIEASEAYATHPEIQLMRFADYFGRALSGVSSVQFPWVKMFKESPLSNSIDVPLAHVPEPVYKTSVDWINQRPVEALEGCVVGVDGILTDWQLIKE

SEQ ID NO: 24300 - protein, 358 aa, Medicago truncatula
MGTTLSIPKTEKFSEDGENDNLRYGLSSMQGWRATMEDAHAAHLDVDSSTSFFGVYDGHGGKAVAKFCAKHLHQQVLKSEEYIAGDVGTSLTKAFLRMDEMMRGQRGWRELAVLGDKVKGFNGIIEGLIRSPRSNDNKDQSDDWAFEKGPHSDFDGPNSGSTACVAIIRNNLLFVANAGDSRCVISRNGQAYNLSRDHKPELVIEKERIYKAGGFIHAGRINGSLNLARAIGDVDFKNNRFLSAEKQVVTANPDINIVDLHDEDEFIVIACDGIWDCLSSQQLVDFVRQELLLETKLSEVCERVLDRCLAPSLAVGDGCDNMTMILVQFKKPLQTSAPAQEQSSSNEQDASEPTLENS

SEQ ID NO: 24301 - protein, 469 aa, Candida albicans SC5314
MRIIKDKKQTVPLDSPYISSSSPSSGQSSNYVLSKCIGRGNFGDVYRAQQVSTNRLVAIKVVNLDESPDDIKQIIKEIHFLSRLRNPYIIRYIESFSQEYNMYIVMEYCGGGSCSDLLKYHKKLPEEIVGYIIHRVLLGLQYLHQEHKVHRDIKSANILLTELGQVKLGDFGVSTEITMTKMKKNTFVGTPFWMAPEVITRAKLIEGNVKNCANSNGNYNGGNTGYNEKADIWSTGITTIELVTGSPPLSQYDPLKILFDIPKKRPPSLSGIDFSDNIKSFVKHCLIKEPDKRSSATALLQHKFFKACVTEDVQARLINLISLKIANDDHRAGYKPRFRISGKLDNGKENLEAPIEWEFTNTLIQQQKTTPRSPLLEEVDEFIDDSSSNYPSNVLEQNNMTSLKLISTKQHVTSRKCELLFNCLHMVQLRGKDEYTRCQVEKFIDSVCDFEEKNPGFCNAIVEELEKHI

SEQ ID NO: 24302 - protein, 115 aa, Bixa orellana
LDAMGMNMVSKGVQNVLDFLQSDFPDMDVIGISGNFCSDKKPAAVNWIEGRGKSVVCEAIIKGDVVKKVLKTNVNALVELNMLKNPTGSAMAGALGGFNAHASNIVTAIYIATGQ

SEQ ID NO: 24303 - protein, 532 aa, Oryza sativa (japonica cultivar-group)
MAAVSAAAARLHHLLSLCVAVAGLLLMLLGGGEASVHEYRGLGFLNKGNAFILHAGSEGLYAPSSPANATTAEDDEDAAAAAVADAFIRFDKITFRRPKDAAKETGSAMVQILVFEIEDREMIGGSAYGGQKAICCTSDLAKLGACTEGSVIYRPSQVNPGWPQLLFSSFDGSDTIATLPSRIIPITKTGMYNMYFIHCDPSLAGLEIEGQTVWKNPTGYLPGRMAPLKNFFGIMSFAFVVLGIYWFYQYMKFWREVLPLQNCITLVITLGMLEMSLWYFEYAEFNETGVRPKGITFWAVTFGTVKRTVARVIILIVSMGYGVVRPSLGGLTSKVVMLGGTFFLATEILELVENLGAVNDLSGKARLFLVYPVAILDAAFVVWIFISLAKTLDKLQARRSMAKLDIYRKFTIALAVTVLVSIGWIGYEIYFKSTDVFNERWQYAWIIPAFWHVLSFSLLCVISYLWAPSQNSMRFTYDASENFDREDSLSLIRPGPIASKNGWSLSSSPDTKATKNVTVTSFDGDDEENKRE

SEQ ID NO: 24304 - protein, 339 aa, Saccharomyces castellii
MVGPKTKKQKVANAGGSTSLDLLKKTGTTVVADTGDFATIDKYKPQDATTNPSLILAASKKEDYSSLVDNAVAYGKENGETIDEQVECAIDKLLVEFGTEILKIVPGKVSTEVDARLSFDKDATIKKALQLIHLYEKAGISKDRVYIKVASTWEGIQAAKVLEQEHGITTNLTLLFSFTQAVACAEAGVSLISPFVARITDYYKAQTGKDYSPEDDPGIHSVKKIYNYYKKHGYHTIIMAASLRTTGQVKQLAGIDNLTLSPKVLDELVASTDEVPKLLDPKKAAKQGDEKISFLDDEPKFRYSLNDDAMATEKLADGIRKFAADAITLSNAIKEKLQK

SEQ ID NO: 24305 - protein, 367 aa, Aeromicrobium erythreum
MTEKQTTHRPLSDRVARRVVRTLGRLPQPLKRAIAGKPISIDGQTLDVEAQVGVRLLNLAVGETFETLPVEEGRRQIDGEAWVFGYEHPVHDVRDLVLPGPGGDLPARIYRPAGLPALSAGLVYFHGGGWVLGNLGSADSVCRYLADTAGITVVSVDYRLAPEHPFPAGVDDAVAAFRHVVAHASELGIDPSAVAVGGESAGGNLTAVASLVSTLEARTDPSVPVPAFQLMFMPVTDLTTKHRSYELFSDGFFLSDAQMDWYKAHYLTDPAQAHDPRVSPLLAPDLEGQPPAHVVVAGFDVLRDEGEAYATRLLEAGVPTTLTRQEGIVHGLVNATGVGTVARRVLDEAAGQLRKRLVPLASGETVR

SEQ ID NO: 24306 - protein, 351 aa, Rhodopirellula baltica SH 1
MVQANSRARTSLFLSLWLNLMTHDVYAVGNALVDIQTMVADDLLSELKLDKGIMTLVDDEKQATVLSRFDLPSLSRCAGGSAANTIAAVADFGGKAAFVGKIGDDETGQFFLKDLRALGVTIDVDPQPGTPSGTCAVLITEDAQRTMLTNLAASTALSEADIDEAVIAASKYVYIEGYLFTGEQTKAAAYKAIELAKKNDVKVAFTASDPFLVNMMKDEMWDLIRGPVDLFFCNEEEAKSLTGLEDPIACANKIHESAENVAMTLGPNGSILMHGGEAIPVEGVKVKAIDTTGAGDMYAGGILYGITNGLDWRQSGHLASHAAARVVAQMGARLQKPFTEDEVKQLTDLTV

SEQ ID NO: 24307 - protein, 506 aa, Burkholderia xenovorans LB400
MNHAEMQFLTTEFPYKKQYANFIGGEWVKPVGGEYFDNVSPITGEAFTSIPRSREADVELALDAAHRAKTAWGKTSAADRANILNRIADRMEANLQRLAVAETIDNGKPLRETTAADIPLAIDHFRYFAGAVRAQEGSLSEIDHDTVAYHFHEPLGVVGQIIPWNFPILMAVWKLAPALAAGNCVVLKPAEQTPASILVLVELIQDLLPPGVLNVVNGFGLEAGKPLASSKRIAKIAFTGETTTGRLIMQYASQNIIPVTLELGGKSPNIFFADVMNEDDSFFDKALEGFAMFALNQGEVCTCPSRVLIDEKIYDRFMERALKRVAAITQGHPLDTKTMIGAQASQEQLEKILSYVDLGKQEGAECLIGGERNALGGELSKGYYVKPTVFRGNNKMRIFQEEIFGPVVSVTTFRNEEEALEIANDTLYGLGAGVWTRDGTRAYRFGRQIQAGRVWTNCYHAYPAHAAFGGYKQSGIGRENHKMMLDHYQQTKNLLVSYSDKPLGFF

SEQ ID NO: 24308 - protein, 453 aa, Haemophilus influenzae R2846
MFAGIFFGYAAYYFVRANFDLAQKGLIEAGMYNKAELGIIGTGAGLAYGLSKFFMASISDRSNPKVFLPFGLLLSGLCMTMMGLMPWATSGIAVMFIMIFLNGWFQGMGWPPCGRTMVHWWSKSERGSIVSIWNTAHNLGGMVPGAMVLLASAVYFSIHGVEATAKDVWQQALYYPGIAAMIAAIPIYFMMKDTPQSCGLPPIEKWRNDYPDDYNEKTYEHDLSTKDIFVTYVLKNRLLWYIAIANVFVYLIRYGVLKWSPVYLGEVKHFNIKGTAWAYTIYELAAVPGTLLCGWVSDEVFKGKRGLTGFIFMTLTTAAVVALWLNPATPEAELAKYAGHAWYENPYQLMDFILMTTIGFLIYGPVMLIGLHALELAPKKAAGTSAGFTGLFGYLGGTVSASAVVGWAAEYYGWDGGFYVMIGGGVLAVLLLLIVMVEEGKHKAKLGDTYGTK

SEQ ID NO: 24309 - protein, 783 aa, Oryza sativa
MWRRRRRRTTACAATPALVKNLATTRRARRPSIVRRARDAFLHGAGDPHCALHLQVYATPAGLDGWRLATVAAGRWWLTVAVGRWWLTVAAGRGWRWRWRWWLAVVAVDGGARPSSGADGVSSSAAACGGKEGGVRGIASESLAEPFGQLTTATPVAVLLLGGVVLDYPSPFLTIFSGGGAARHSAAARRRGEAFGGGAAKPRDGNRRATGDGGSEATRPRGRGAAAAGQQLQLSGTAPSGTAAGAISGLGSGSGSTTQPVRIDSEVAVPSVQPITDANESPVQIQITAVEVVPEVAASDAARDVTEPETEVASNDPDIATAVTQQEQPSTWSPIRDWSPIRDGDDEETEYDSSDEAIYDIDLLCHDPGRRIAIKNYDVNERNSVIRGYIALGPCQPRSHNFPIRKIGEQESDHGEDGSAPKAAAVRGGSPRGGVRWWLSVAADMFMVLCGQTVATLLGRLYYNSGGNSKWMATLTQSAGSPLLAILLLFTPAPAADEPRPAAAKMAPIYVGLGIIIGFDNLMYSYALQYLPVSTFSLVAATQLGFNSVTSRLINAQRFTVLIANSVVVLTFSAALLGIGASSDETASSVPRGKYPAGFALTLAASAVFALILSLFEATFEKVVRTRTLRWVLRAQLWTNVVASTVSAVGLLASGDWRTIPAEMAAFKDGRARYVATLVGTAVSWQVMAVGSLRLIVRVSSLFANVTGTLSLPLVPVFAVALFGDRMTGIKAVSMLMAVWGFLSYAYQQYIDGRRAAGAGKGRAAAECRVCAARAGSDPDSPA

SEQ ID NO: 24310 - protein, 450 aa, Ashbya gossypii ATCC 10895
MIAKEIAPALAQDQPEEVKHDSLCQARDHVTTGLAGLVATDPTTQKTGAHEQAHQAVFQAMKEHVERVNKDTCDAGEENSFFVCDLGEVERLLRYWRRELPRVQPYYAVKCNPDVRVLERLASLGVNFDCASKAEIERVLQLGVAPERIIYANPCKVCSVIRFAAARAVRQSTFDNVQELYKIARFHPESQVLLRISTDDSTAQCQLSAKYGCSPDEVDPLLAKVAELGLNLVGVSFHIGSGASDFSSLTQAVVDARRVFDRAAHFGLPALRVLDVGGGFQFDTFHQSSAILNAALDTHFPPGSGVELIAEPGRFLVATAFTLSSHVIAKLRLPERGSMLYINDGIYANMNCILFDHYQPTPRVLYHAAAFHYFDTTSSKSRTAACPHRTSIWGPTCDGLDCITDEYYLRYDLAVGDWLYFANFGAYTSSAATPFNGFEAAVEVIYIDTA

SEQ ID NO: 24311 - protein, 118 aa, Haemophilus influenzae R2846
DPIGPYVQAVDLGNLVLTSGQIPVNPATGEVPADIVAQARQSLENVKAIIEKAGLTAADIVKTTVFVKDLNDFAAVNAEYERFFKENNHPNFPARSCVEVARLPKDVGLEIEAIAVRK

SEQ ID NO: 24312 - protein, 428 aa, Rhodopirellula baltica SH 1
MTLIESIHARQILDSRGNPTVECEVTLMDGAAGRAAVPSGASTGMHEAWELRDGDKSVFMGKGVTTAVKNVNTKIADALEGMDATDQAAVDQAMIELDGTPNKKELGANAILGVSLAVAHAAAASTNQPLFRYLGGAGARMLPAPMMNIINGGEHADNGVDIQEFMVMPLGFERFSDALRCGTEIFHNLKKVLSDKGYSTAVGDEGGFAPDLKSNQEALDVIMTAIDKAGYKAGEQVWIALDAASTEFYDKSSGKYSLDNNQMSGDEMVDFLAGWCDKYPICSIEDGCDEDDWETWKKLTTKIGDKVQLVGDDLFVTNVERLQRGIDEGIANSILIKVNQIGTMTETIDAIQLAHRNGYTSISSHRSGETEDSTIADLAVAMSTGQIKTGSASRSDRMAKYNQLLRIEELLGDAAQYGGPLFAKRITG

SEQ ID NO: 24313 - protein, 245 aa, Bacillus cereus E33L
MIKLVLIRHGQSLWNLENRFTGWTDVDLSENGLSEAREAGAILKKNGYTFDVAYTSVLKRAIRTLWIVLHEMNLAWVPVHKSWKLNERHYGALQGLNKDETAQKYGEEQVHIWRRSIDVRPPALTEDDPRYEMNDPRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHISF

SEQ ID NO: 24314 - protein, 362 aa, Ashbya gossypii ATCC 10895
MTFWWKKSPKTPGDYVKHLTEQLARFELAVSDNRKKIQDECTKYITGTKDFILGETDPAPSGEAIDELYFAIYDADLLYDLLVHFHELDFESRKDVALIYATCLRRSKDNKFTTVDYLVTKPKILAYMLRIAEMALNKPNGTEVFLTTGGMILESIKYEQLCRLLLKNPQIWTFFDFARLSSFEVSTESLQILTELFTTHTKLVATEFFNQDANIKKFIDRINMLMAHGNYVTKRQSVKLLRTMILNRAYGQLMNSYINSPENLKLNMILLSDRSKNLQLESFNVFKVVVANPRKSKPVLDILIKNRDKLLKFFENFGVDTKDTTLLDEKEFVVAQIEGLPRLMSSNTENNLGSSPQKNLVA

SEQ ID NO: 24315 - protein, 353 aa, Kluyveromyces lactis NRRL Y-1140
MDLLLEVCDTYLLDYVYGKVFPVNMLPSSVTNSVGQFLDLNTGNLNGTAAKPAGDVYGYEPFLLEFTDYTFQSIFPRYNLFRETLTMFVLMTIFGWALYFSVATMSYLFVFDKAVFNHPRYLKNQMSLEMKQAFSAIPVMVLLTIPWFLFELNGYSKLYLDIDYKSWAGIRQLAFEVISFIMFTDCLIYLVHRWLHWPRVYRALHKPHHKWLVTTPYASHAFHPVDGYMQSVPYHLYPMIFPLQKISYLILFTFVNFWTVMIHDGEYLANDPVINGAACHTVHHLYFNYNYGQFTTLWDRLGGSYREPDQELFNKSLKKSKQTWEIQVEKMEAIKQEVEGDCDDRVYVTTKAS

SEQ ID NO: 24316 - protein, 230 aa, Triticum aestivum
MSDADDYRCFVGSLSWNTTDVDLKDAFGKFGRVTETKVVLDKFSGRSRGFGFVTFDDKKAMEEAVEAMNGIDLDGRNITVERAQPQGSGRDRDGDRDYRGGGDRYGGGRDFGGGRGGGRGGGGDCYKCGKPGHFARECPSGDGGDRYGSRDDRYSSRDDRYSSRDDRYGGRDGGRDDKYGGSNGSSRYGPDRGGDRYSGSRDGGSRSSGGGDRYSRDRSGPYDRRSRDEY

SEQ ID NO: 24317 - protein, 400 aa, Glycine max
  misc_feature (194)..(194): Xaa can be any naturally occurring amino acid
  unsure (1)..(400): unsure at all Xaa locations
MGSKDENSKAWKWGLGLVYIFAVATIWIAASFVVQSVVDAGVSPFLVTYICNSLFVVLIPIVEIGRYLEDSYGSLWFWRSEKSNPHSKGRVGESEKAILLKDNDAGNEASESLVLEEVDVIQERNNGSELLPADKVVGVSADQVNVIENISNHLDEKGRWSRCRVAKVSLLICPFWFLAQLTFNLSLKYTTVTXTIIVSLGDSQSGLATVASNPLLGDIFALASAGLYAVYITLIRKKLPDDDGKSGEASTAQFLGFLGLFNVLIFLPVALILHFTKKESFSTLTWKQLGLIIGKGLLDNVLSDYLWAKAVLLTSTTVATAGLTIQVPLAAIVDTLTGNAPRFMDYLGAIAVMIGFTGINIPSDTFSKSTETTVALENENLNTRTEELTLSISQDSVAIS

SEQ ID NO: 24318 - protein, 718 aa, Brucella suis 1330
MQMGMAVLVLVIACGVLSVLFAIWAIRSVLAADQGTQRMQEIAEAIREGASAYLTRQYSTIAIVGIVVFLLAWYLLSLNAAMGFLIGAVLSGVTGFIGMHVSVRANVRTAQAASLSLAGGLELAFKSGAITGLLVAGLALLGVSVYYFVLTVWLGYAPADRTVIDSLVSLGFGASLISIFARLGGGIFTKGADVGGDLVGKVEAGIPEDDPRNPATIADNVGDNVGDCAGMAADLFETYAVTVVATMVLGAIFFHGSDALTNVMLYPLMICGACVITSIVGTFFVKLGVNGSIMGALYKGLIATGLLSIVGLGVANTLTVGWGEIGTVAGKSITGTNLFVCGLIGLIVTGLIVVITEYYTGTNKRPVNSIAQASVTGHGTNVIQGLAVSLESTALPAIVIVGGIISTYQLAGLFGTAIAVTAMLGIAGMIVALDAFGPVTDNAGGIAEMAGLDPEVRKATDALDAVGNTTKAVTKGYAIGSAGLGALVLFAAYSNDLAYFAANGQIYPYFADMGPVSFDLSNPYVVAGLIFGGLIPYLFGGMAMTAVGRAGGAVVQEVRRQFREKPGIMTGKERPDYARAVDLLTKAAIREMIIPSLLPVLAPIVVYFGVLLISGSKAAAFAALGASLLGVIINGLFVAISMTSGGGAWDNAKKSFEDGFTDADGVKHMKGSEAHKASVTGDTVGDPYKDTAGPAVNPAIKITNIVALLLLAVLAHMA

SEQ ID NO: 24319 - protein, 134 aa, Vibrio vulnificus
MRSTGLADTVLVGPEPEFFLFDDVKFATDMSGSFFKIDDVEAAWNTGSDYENGNKGHRPGVKGGYFPVAPVDSSQDLRSAMCLVMEEMGLVVEAHHHEVATAGQNEIATRFNTLTTKADEIQIYKYVVHNVAHA

SEQ ID NO: 24320 - protein, 335 aa, Arabidopsis thaliana
MTSFCSMISLLLLLSLSSAVFSDDASFQKLPVPETRSGPEAFAFDSTGKGFYTGVSGGKILKYLPETGYVDFAQITESSNSSWCDGTIGTALAGRCGRPAGIAFNEKTGDLYVADAPLGLHVISPAGGLATKITDSVDGKPFKFLDGLDVDPTTGVVYFTSFSSRFSPIQVLIALGLKDATGKLYKYDPSTKVVTVLMEGLSGSAGCAVSSDGSFVLVSQFTKSNIKRYWIKGPKAGSSEDFTNSVSNPDNIKRIGSTGNFWVASVVNKIIVPTNPSAVKVNSNGEVLQTIPLKDKFGDTLLSEVNEFEGNLYIGTLTGPFAGILKLEKGSCPAT

SEQ ID NO: 24321 - protein, 452 aa, Acinetobacter sp. ADP1
MNNDSSKLQRGLKNRHIQLIAMGGAIGTGLFLGSAQVIQSAGPSIILGYAIGGLIAFLIMRQLGEMIVHEPVAGSFSHFAYKYWGKFPGFLAGWNYWVLYILVAMTELTAVGKYINYWWPQIPAWQSVLFFFVVITLVNLTNVKFYGESEFWLAIIKVVAVISMIIFGLYLLFTADSSSTASFSNLWAHGGFFPNGFEGLFYMLAFLMFAFGGIELIGMAAAEAENPAKTIPKAINQVVFRILVFYVGSLTILLSLVPWNQLDLGGLDKSPFVMIFSQLGIGWAAHLLNFIILTAALSVYNSGMFANSRMLFGLAQQGNAPKIFTKVNKQGVPIPAVLFSALLIFGCVLLNYFVPEDALGHLMYVVVGALVLNWAMISLTHLKFKAAVKKLKLNVTFPALWAPVSNYLVLIFIALVLFIMWQQGFKESVIMIPVWIVLMFGLFHLLTNKDHT

SEQ ID NO: 24322 - protein, 337 aa, Oryza sativa (japonica cultivar-group)
MAASSAAAGAGGEPQKQLLSIIRDFAAEKSHGGFSRDPLAASELLAERRVTDLKRRLDDLRAASDAAAAELEAAKRAREGAEQELRGGQVQVAIAAASIQALEATISHLQEEISKAGSDLDALKGKGDIERDEFISQMDQLNTKIRQFQQTVSVEFKRQKCSELPSGEGQHVRDMSKIEESEGILKDLIDKVNNADAELHVLEEEYKKDLLHHDEVRRELADTQAKRALMEAVMGETKQLQELGEYPFLGFVQKFSNSLHLVLFPVQIHQAFCKRRFFNGKQAGSRNGESARFACGGVAEAVRVPRLWSQQHGWVGGGGGGQLKMALAGWLLYIDKA

SEQ ID NO: 24323 - protein, 468 aa, Streptomyces coelicolor
IAGLAAAHRLLEAGARVTVLEASGRVGGKLLPGEIAGVRVDLGAESMLARRPEAVGLARAAGLADRLQPPSTATASLWTRGALRPMPKGHVMGVPGTAAALSGVLSEEGLARIERDAELPRTEVGDDVAVGEYVAARLGREVVDRLVEPLLGGVYAGDAYRISLRSAVPQLFEAARTHTSLTEAVRALQGRTATSPPSGPVFMGIEGGIGTLPPAVADSVRARGGEIVTQAPVTELRRTASDGWRIVAGDRVLHAGAVVVAVPAGPAAELLRAEAPAAAAELSAVEYASMALVTLAYRRSEAAALPEGSGFLVPPVDGHTIKASTFASRKWGWIADEDPDLVVLRTSVGRYGDTEILGRDDAGLVAVSRHDLAEATGLTAAPVATRVTRWQDGLPQYPVGHHARVARVREHVAKLPGLAVCGAAYDGVGIPASIASAYAAADQIRGDLGGVEELTAHPVQSLHGGAGE

SEQ ID NO: 24324 - protein, 384 aa, Burkholderia xenovorans LB400
MQSAMQARSKLPDVGTTIFTVIGQLAAQYDALNLSQGAPNFAPDASLIDGVAQAMRAGHNQYAPMAGIAALREALADKVATLYGVHYDPASEVTVIASASEGLYSTISALVHPGDEVIYFEPSFDSYGPIVRLQGATPVAIKLSLNDFRVDWDEVAAAITPKTRMIIINTPHNPTATVFSEADVARLKAITRNTDIVILADEVYEHVVFDGAKHQSMACHAELAERSVIVSSFGKSYHVTGWRVGYCLAPAALMDEIRKVHQFMVFSADTPMQYAFVDALARRESYLGLSAFYQKKRDLLTDALRDSRFELLPSEGSFFMLARFRGFSEESDSDFVLRLIRDARVATIPLSAFYTDGTDSGLIRLSFSKDDATLIEGARRLCQI

SEQ ID NO: 24325 - protein, 430 aa, Pyrobaculum aerophilum str. IM2
MAALGVLAHAVWRGAAEIYRLKMDNLSLFMRTEEYGLILKEERLEGGRRVLDIFWGPQHPSSGHTRFIIEVDGDVVVNVTPDPGYVHRTMEKLGETRHWIQNIPLFERLSLPDAINVTWAYALAIERLAKYDVSPRAQYLRVIMGELSRISTHLYDLGLHAIMIGSSTGFMWAYGLRELLVQLWAMASGSRTTPTWVLPGGVRTAPPDAFYEQTRGFLDYLEKKVDEFMRVVVKNPVGYYRLKDVGYLSKEDAARLMATGPGARGSGIEWDARRAYKYGVYDEFEWEVCVEDGGDALARTMVRICEIRQSARIIRQALDRVPRDGPLVGEALLHRIPPKQREKANELIRLGALFTTMLPQGEGVGVTEGGRGRYYFQVFGDGTEKPYRVRISTPSWQNLRAMIRAFIGARLMDLPAIYGSFGYFPPEQDR

SEQ ID NO: 24326 - protein, 474 aa, Medicago truncatula
MQRKLHMGRKGSWFSAVKKLFISDSKKDQHHHHHHHHHYEDAEWKSGGVSPITVVPVPSLPPKEDVKPKKTDAENEQDKQAFSLILATAVATGAAVAAAKTAAQAAAEAALEAARITSLRPCYIGKTNEEIAAIKIQTAFRGYLARRTLRGLRGLARLKALVKGQSVQRQAATTLQCMQTLSRLQSQVSARKIRMSEENQSFQRQLQQKREKELDKLQAAPIGEKWDYSSQSKEQIQARLLNRQIAAMRREKALAYASTHQQTWRNSSKATDATIMDPNNPHWGWNWLDRWMASRPWEGQNTKDQKNHRSGKGVASHTMSVGEISKLYALRDQNQDDKKSPTSQKANNPNQASRVAVPSTSTRGKAKTSSSPRVGSWGGDGDSKFTFNKNSESNRRHSIAVAPVKEDESLVNTPAKFSKVKSNVQSPSVKKQLSFTASSSGSRRHSIPTKMGMNSNKNVAATIPEVKVKNGGSK

SEQ ID NO: 24327 - protein, 447 aa, Blastopirellula marina DSM 3645
MQLSEAIQEALATEKYHTPTPIQGQAIPHLLEGSDLIGCAQTGTGKTAAFALPILNQLDLDRSRADACAPQVLVLSPTRELAVQIAQSFNVYGRNVKFRLTTIFGGVGQNPQVRALKRGVHVAIATPGRLLDLMDQGYVDLSQAKTFVLDEADRMLDMGFMPALKTIVSKLPKQRQTIFFTATMPPKVAQLASGLLNNPVRIEVAPESTTAERVEQRLMYVSQGDKRALLEHSLQAEGVGRTLVFTKTKHGADRLAKELNASGIRTDAIHGNKTQNKRNRALESFRSGRLQVLVATDVAARGIDVDGVTHVVNFDLPIDPESYVHRIGRTGRAGKEGIALSFCDFSEHGTLRAIERLIRTTITVDADHPFHVEPRSRGPRSGGGGPRRSYGKSSGRPAGNGGGRSGGYSQGGGDSSERPKTYGGGRSGGAKRTGGKRPFGAKSKRPE

SEQ ID NO: 24328 - protein, 354 aa, Magnaporthe grisea 70-15
MSRNNTSVVLAERPKPKIIPGKTFAKKVQPAPTEADLKDGQILAETLYIGLDPAMRGWLNDARSYVPPVQIDEVMRAAAVCRVLASRSKLAKRGDLVSGMPGWQEISILSEKGPRSFDAPFAVPPNGRPTDMLGVLGMTGLTAYMGVKHVAAIKPGDTVVVSGAAGATGSVVGQMAKHVYGAGRVVGIAGGEDKCRWLVEELGFDAAIDYKAPDFKKKFAEATKGFIDVYWDNVGGEILDLALARAKKHARFVMCGGISTYNDSANEVRGPKNINMVIAMSIRMQGFIVFDYIKEYAQARQDLAKWLQEGKIKRGETIVKGGMDVIEQTLVDLFNGVNKGKLLVEVKNPDSAKL

SEQ ID NO: 24329 - protein, 451 aa, Haemophilus influenzae Rd KW20
MKKFSSKTIKAKNSVKMTALSTRAIAANLILQVLDEGKSLSALIPEVQLSVKAQDLPLLQEICFGVCRVLPRLEQIIKRLVDKPLKGKTRIVHCLLLVGLYQLLYMRVPAHAAVDEVVNATKSLKSDSFRGLVNAVLRRFLREQDEILAIIDKNWQTLHPEWFVNKLKKAYPNWREIIEANNQKPPMWLRVNSQKNALETYRTLLEEQGVSSKTSHHPNALCLDIPIAVQKLPHFEEGAVTVQDLSAQWAATLLEPKNEEWILDACAAPGGKTTHILELAPQANVIALDVESHRLKRVEENLERLNQQAIVVCGDASKPDEWLAEIGKSAAKFDRILLDAPCSATGVIRRHPDIKWLRKETDIAQLVELQKKILSALWEKLKPNGVLLYATCSVLPEENCEQIQAFLNAHADAELLSLPFSDDKSAVGFQFIPQPNSGDGFYYAKLLKRAS

SEQ ID NO: 24330 - protein, 337 aa, Ralstonia eutropha JMP134
MSTNTFKRIVLASRPEGAVTPANFRLEEVPVPELADGQVLVRNHYLSLDPYMRGRMNDSKSYATPQPLNEVMIGGTVGEVVASKNSKYKAGDKVVGMFGWQEMGVSDGTGMQPVDTTHIPLSAYLGSVGMPGVTAWYGLNKIIQPKAGQTVVVSAASGAVGSVVGQLAKLAGCRAVGFAGGKDKCDYVVNELGFDACIDYKAAKDSKELYTMLKEATPNGIDGYFENVGGDILDAVLTRMNAFGRIAMCGMIAGYDGQPLPLKNPQLILVSRLTVEGFIVSEHMEVWPQALKELGTAVAQGKLKFRESVAQGLESAPEAFMGLLKGKNFGKQLVKLV

SEQ ID NO: 24331 - protein, 270 aa, Ralstonia eutropha JMP134
MAPFTGRVVLITGASDGIGAELAMLLAQQGARLALAARRLDMLHALASRIQAMHPHAEVAVWRTDVSDESACTRLVADVVAYYGGLDVLVNNAGVSAHGYFEQVSDYGYYETVMRVNYFGAMWCTRAALPHLRARRGLMVAVSSLAGKVGVPGRTAYSASKFALAGFCEALRCELHGSGVDICVVFPGVVATDTRVNGFGPDGRALGESRLREDDAMTAQECARQMLAAMTARKRELVMTAKGRLGQWLKLLAPAMVDRMALKALKQAGR

SEQ ID NO: 24332 - protein, 362 aa, Ipomoea batatas
MVTTITVPSRVERLAGSGIERIPKEYIRPEEERPSIGDIFAEEKMGGGPQVPTVDLKGINSEDLEVREKCREELRKAAVDWGVMHLVNHGIPKELTGRVKAAGEGFFGQSIEEKEKYANDQAAGNVQGYGSKLANNASGQLEWEDYFFHCVFSEDKTDLSIWPKTPSDYIAATREYAKQLRALTTTVLAVLSLGLGLEEGRLEKEVGGMEELLLQMKINYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVSEADPPRFPPRTFAQHIKHKLFRLTDQEGADTPKPDE

SEQ ID NO: 24333 - protein, 626 aa, Ralstonia eutropha JMP134
MARTAPAASFESLESDLDQKFAYPASSKTYIPGSRPDIRVPMRTILQTSTRTEKGEMPNPPIPVYDTSGPYSDPDVHIDLKAGLPALREKWIAERGDTEVLPGLSSEYGRDRANDPATAHLRFAQLTNPRRAKAGANVSQMHYARKGIITPEMEYVALRESLNLQALYDKPEYKALLRQHPGNALGAGLPLRPEDITPEFVRNEIATGRAIIPANINHTELEPMAIGRNFRVKINGNLGNSAVTSSLAEEVEKMVWSIRWGADTIMDLSTGKHIHETREWILRNSPVPIGTVPIYQALDKTGGIAEDLTWEMFRDTLIEQAEQGVDYFTIHAGVLLRYVPLTADRVTGIVSRGGSIMAKWCLAHHKENFLYTHFDEICEIMKAYDVSFSLGDGLRPGCIADSNDDAQFGELRTLGELTAKAWKHDVQVMIEGPGHVPLQRIQANMDEELKHCYEAPFYTLGPLVTDIAPGYDHITSGIGAANIGWMGTAMLCYVTPKEHLGLPDKEDVREGIITYKIAAHAADLAKGWPGAQLRDNALSKARFEFRWEDQFNLGLDPERARSYHDATLPAEGAKIAHFCSMCGPKFCSMKITQEVRDYAASLPKEAQQGMEEKSIEFLKKGSKIYS

SEQ ID NO: 24334 - protein, 248 aa, Neisseria gonorrhoeae FA 1090
MSTQDLSGKIALVTGASRGIGAAIADTLAAAGAKIIGTATGESGAAAISKRLAQWGGEGRVLNSAEPETVENLIADIEKTFGKLDILVNNAGITRDNLLMRMKEEEWDDIMQVNLKSVFRASKAVLRGMMKQRAGRIINITSVVGVMGNAGQTNYAAAKAGLIGFAKSMAREVGSRGITVNCVAPGFIDTDMTRALPEETRQTFTAQTALGRFGDAQDIADAVLFLASDQAKYITGQTLHVNGGMLMP

SEQ ID NO: 24335 - protein, 352 aa, Streptomyces chartreusis
MKALVLAGGMGIRLRPLSHTTAKQLIPVGGEPVVRYSLDVIREAGITEVGIVVGERGDQFRRILGDGRDMGLRITYIEQERPDGLAHCVLIAREFLGSDDFLMCLGDNVVLEGVGQLVSEFRSNRADAMLLLGKVDDPSEYGVAVVDDAGRIQRLVEKPETYVGDLAVVGAYVFSSAIHRAVRAIRPSARGELEITEAIQWLVDTGRRVVGHECPGYWKDAGRLADLLACNRVLLERLTTDITGQVDEASTIRGPVVVAENATVSGSELVGPVLVAAGAVVRDSKLGPHTAVGPGCRITEAEIADSILLEDATVHGVSGLSGSVVGRAASVRGGGAGAEVFLGDDSSVVIAS

SEQ ID NO: 24336 - protein, 521 aa, Neisseria gonorrhoeae FA 1090
MTQDKILILDFGSQVTRLIARRVREAHVYCELHSFDMPLDEIKAFNPKGIILSGGPNSVYESDYQADTGIFDLGIPVLGICYGMQFMAHHLGGEVQPGNQREFGYAQVKTIDSGLTRGIQDDAPNTLDVWMSHGDKVSKLPDGFAVIGDTPSCPIAMMENAEKQFYGIQFHPEVTHTKQGRALLNRFVLDICGAQPGWTMPNYIEEAVAKIREQVGSDEVILGLSGGVDSSVAAALIHRAIGDQLTCVFVDHGLLRLNEGKMVMDMFARNLGVKVIHVDAEGQFMAKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 24337 - protein, 601 aa, Lachancea kluyveri
MSKKSLENLSNEKLPATECGSSNSNLRESISSNDLSDGDRGFVNRKLHNFCNSFKRANSDTFDASQDLEGASINSVRSNSKFKQSMKSRHVVMMSLGTGIGTGLLVANGKSLHFGGPAGLLIGYSLVSVVAYIMMQAAGEMAVAYPTLPGNFNVYSSIFISKSFGFATVWLYCLQWLTVLPLELITASLTIKYWNSSINPDAFIAIFYAVIVFIHFFGAAGYGEAEFIFSTCKVSMIAGFIILSIVINCGGAGTGGYIGGEYWRNPGAFAGGSPIGHFKGIAYVLVTAYFSYGGMELFALTVNEQANPRKAVPSATKKCIYRILIIYMLTMILIGFLVPYNSDELMGSSGKSATHASPYVIAVASHGVKVVPHIINAVILISVVSVGNSAMYSAPRLLNSLAEQGYAPKIFSYVDRAGRPLVALVGCSIFGLLSFVAASDKEEQVFTWLAAIAGLSELFTWSAICLSHVRFRDAMKYQGYSLSELGYKSKTGYWGSIYAIFFNIIVFVAQFWVALAPIGNGGKADAEAFFQSYLAFPIWISCYVGYKIYSKEWKLLVPLDEIDLNSHRHIFDKHILQQEDDEHKEKLKNSGWWVKMANFWC

SEQ ID NO: 24338 - protein, 640 aa, Coccidioides immitis RS
MAWRDSSAPTCQGVPSGAHNNTGKGEGEITWPSEESSWRPSLELPRIACLLFTHGCSITTNLMTNVQKLRGAMVHPSTERLLQPRKDAVLSRREIEGLIARGRHILIYEGKVLKVDAWLKFHPGGEKAIQHMVGRDATDEINALHSLEARQRMKSYQIGRIEGQWKNFLPPIQGGIFRLEAIDEMIPDDVDDSHSSAQESSSPPSPLFEAVDRQKLRSRQSSATSISSVASTPPSPGPKAHFEPKPFFLDARTQEEIVLDVAKYPSVNSETQNNIVEKYRQLNQRIQDEGLYNCNYFAYFVEFCRYSLLFSLFVFFLRRGWYAISAFFLGCLWHQLVFTAHDAGHMGITHNFHVDTVIGIIVADYIGGLSLGWWKRNHNVHHIVTNSPEHDPDIEHMPFFAISHRFFSNLRSTYYERIMKYDLFAQFLIRYQHYLYYPILLFGRFNLYRLSWEYLLLRQAPRRGPAWWHLWFEVVGQVFFWAWYGYGVVYLNIPDWRNRLVFILVSHMVQGPLHVQITLSHFAMSTADLGVHESFPQKMLRTTMDVDCPTWLDFFHGGLQFQVIHHLYPRIPRHNLRSAQNLVKEFCKDVDIPYAIFTFYDGNKEVIGRLSDIAKQARIFAECQKSVAQQGIFSDHHHHH

SEQ ID NO: 24339 - protein, 108 aa, Bordetella parapertussis 12822
MSDVQEFIRETVTQHPVVLFMKGTAQFPQCGFSGRAIQILKGCGVKKLVTVNVLEDDEVRQAIKTFSNWPTIPQLYVGGEFIGGSDIMSEMNESGELKQLLDDSGATA

SEQ ID NO: 24340 - protein, 969 aa, Candida glabrata CBS 138
MVKNLKRKERDEHESDSDEEIDIAGNLVADGSDSESDDSSDGSDEEVQDVIEYSSDEEEPAKPAKAVKKKVEDKSFPSLELSDDEDEKKKVDNDDDDVNAYFSVNTDAKSKHKKGSFASFGLSKLILVNISKRGFRQPTPIQRKTIPLILQNRDIVGMARTGSGKTAAFVLPMIEKLKTHSSKIGARAIILSPSRELAMQTHSVFKEFSRGTHLRSVLLTGGDSLEDQFGMMMTNPDVIIATPGRFLHLKVEMNLDLKSVEYAVFDEADRLFEMGFQEQLNELLAALPSSRQTLLFSATLPTSLVDFAKAGLVNPVLVRLDAESKISDNLEMLFLSTKNDEREANLLYILQEVIKLPLATPEQIKQLNDNKADDSDESAEEDEDKKRRKRKSFNRKAMPKANELPSEKATVVFVPTRHHVEYLSNLLKDCGYLVSYIYGALDQHARKSQLYNFRIGLTSILVVTDVAARGVDIPMLANVVNYSLPASSKIFIHRVGRTARAGNRGWAYSIVSENELPYLLDLELFLGRKILLTPMYEALERLSKEKWVAEGNDETLFQSPKISYTSRMVLGSCPRLDIEALSELYNNLMKSNFDLDMAKKTALKAEKLYFRTRTSASPESLKRSKEIISSGWDEQNVLFGKNLEKEKNAFLEKLQNRRNKETVFEFTRNPEDEMANLMHRRRRAIAPIQRKAKERKELLEKERMAGLTHALEDEILKGDDAEVGYTVTEDTLKAFEDADTILAEQENASKKKKKTFRDPNFFLSHYAPANEIQDKQLELSGGFINEAAQSAYDLNSDDKVQVHKQTATVKWDKKRKKYVNMNGIDNKKYIIGESGQKIAASFRSGKFDEWSKARKLAPLKTGANESSIPSNLLVDPTRGPGKSGSKLPNGKFKHKLEKAPRLPDKKRDDYHKQKKKVESALERGIAVKGYNNAPAFKSELKSVAQIRKDRKTKENRHAKNARPSKKRKF

SEQ ID NO: 24341 - protein, 383 aa, Ralstonia eutropha JMP134
MILKSNDRSQFELPPTSGEAPSHSADAQQAAAHAVSTPVSAMSAVTSASSAVAATQSVAGMPAVPLDPQVAALLDLIARAKRPPIHVMDVEDAKIAYEKSAPILDISPLPMHAVDDLHVCARDGHGIPVRLYAPREASWADPLPMLVYFHGGGFTVGSVNSHDALCRMQAAHADCMVLSVDYRLGPQWRFPTAANDAFDVLHWVFEEAARLGADPARIALGGDSAGGTLATACAVHARDSGLAPVLQLLIYPGTCARQDTPSHGALAEGYLLTADMIQWFFSHYLDQESSRDDWRFAPLDGGGSGADVRGCCPAWIAVAGYDPLHDEGVAYADKLRAAGVTVTLADYAGMIHDFFKMGRFVPAVAQAHADAVAALRAAFGTGQ

SEQ ID NO: 24342 - protein, 340 aa, Xanthobacter autotrophicus Py2
MARKLSFKMAINEALDLEMRRDPSVILLGEDIVGGSGAPGEKDAWGGVLGVTKGLYAKHGNRLLDTPLSESAYIGAAVGAAACGMRPVAELMFLDFMGVCFDQILNQAAKFRYMFGGKATTPVVIRAMVGAGFRAAAQHSQMLTPMFTHVPGLKVVCPSNAYDAKGLLIQSIRDNDPVIFCEHKNLYGHEVDVPTEAYAIPFGEANVVRDGKDVTIVSYGLTVHRAMDAASALSRQHGIEAEVIDLRTLSPIDWDTVIESVENTGRLVVVDEAHPRCSIATDVAAYVAQQAFGALKAAPQMVTAPHTPVPFSPTLEDLYIPTADAIAGAVLRTVPHALAA

SEQ ID NO: 24343 - protein, 360 aa, Oryza sativa (indica cultivar-group)
MGKGGKGAEAAAAAAGAGEEENMAAWLVAKNTLKIMPFKLPPVGPYDVRVRMKAVGICGSDVHYLREMRIAHFVVKEPMVIGHECAGVIEEVGSGVTHLAVGDRVALEPGISCWRCRHCKGGRYNLCEDMKFFATPPIVHPGDLCFKLPENVSLEEGAMCEPLSVGVHACRRADVGPETGVLIMGAGPIGLVTLLAARAFGAPRVVIVDVDEHRLSVARSLGADAAVRVSARAEDVGEEVERIRAAMGGDIDVSLDCAGFSKTVATALQATRGGGKVCLVGMGHNEMTVPLTSAAIREVDVVGIFRYKDTWPLCIEFLRSGKIDVKPLITHRFGFSQEDVEEAFEVSARGRDAIKVMFNL

SEQ ID NO: 24344 - protein, 468 aa, Anaplasma marginale str. St. Maries
MFLRAEDLLDYIAKNSVKFIDWRFTDLLGRWHHTTYSVSSLSAEVFSSGIAFDSSSVPGWQPIEKSDMLLVPDVSTAFVDPFSPQPSLAVICNVVNPHGHNDYQRDPRYTARKAYEYMLSSEIADKCFFGTELEFFVFDHVRFGTDPYNTYFKLASQEDGGLGSRGCFSNHGYRMKAKDGYMRLAPVDSLHDVRSEMLAMLSEVGVTPLLHHHEVAASQCEIGFRYAELVTSADNVQKCKYVLRNVASSYGKSVTFMPKPVRGDNGSGMHCHQSLWKDGNNIFSGSNRGLSELCLHYIGGVIKHGRALSAFANPSTNSYKRLLPNFEAPTWLVYSHENRSAAIRIPCIPDGGSTRIEVRFPDPLANPYLCFAAQLMAGLDGIKHKVHPHEVSGKCLYSMEESETRDLLSVPTSLEEALTSLDKDRDFLLQGEVFTNEQIESYIQLKRSEVDNLRSYPHPVEFSNYYAL

SEQ ID NO: 24345 - protein, 332 aa, Lachancea kluyveri
ELHVVESVLLPKDMHPNLQLAIGLASMNKSSLFSAMYQEGTIGKGDYWEFVYEDALNLISALPLLTGKIYSNIVNDGEPLGQFNPDRDWSYNIASLLGMTFRDSVNKQHMTADQCEDFTNLVRLYCGIHVDHEGGNVSAHTTHLVGSALSDPYLSYSSGIMGLAGPLHGLAAQEVVRFLVEMNSEIESPENEKQVEEYLWKILKSNRVIPGYGHAVLRKPDPRFEAMLRFVEDRQQEFAQDKNVQLMKKMSQVAPKVLAKHGKTKNPFPNVDSASGILFHHYGIQELLFFTVIFGCSRSIGPLTQLVWDRALGLPIERPKSVDLNTIRSLCK

SEQ ID NO: 24346 - protein, 327 aa, Anaplasma marginale str. St. Maries
MSDAFNRALIDLKSLVLEDLQAMEQLIVDTSNSDISYIADIISHLMLSGGKRIRPILLLAVCKMLALADERRIRIAAAIEFIHSATLLHDDVVDQSELRRGAKTSNSLWGNKASILVGDFLLAAAFQWIVSCGNFELLTVLSGASRTIVAGEIQQMVYSKNLDITREKYIEIISAKTAALFSATCESAGVLSESPHGNREALRDFGHNFGITFQIVDDLLDYTAQHEQWGKAHSQDLNNGQVTLPLIMAYEEADSAGKEMLRGALAGRTADIETAHSYITSLNIVQKATKFAAEYVDAANRFLEPFPNSQCKSKLSALLNSALQRRF

SEQ ID NO: 24347 - protein, 366 aa, uncultured bacterium
FTGDFHAITSAHNLLSALVDNHIYWGNGLGLDTRRVSWKRVLVMNDRALREIVNSLGGAANGFPREDGFDITVASEVMAILCLAMDLPDLERRLGNIIVGYTRDEAPVRARDLKGDGAMTVLLRDALMPNLVQTLENNPVFIHGGPFANIAHGCNSVLATKTALKLADYVVTEAGFGADLGAEKFFDIKCRKAGLNPSAAVIVATVRALKMHGGVAKDDLKSENAAAVAKGCDNLKRHIENVRKFGVPPVVAVNRFITDTDAEIAEVVKAAESMGTKAFMCTHWADGGKGTEALAAHVADLANSGQASFKPLYPDSMGLRDKVKTVATEIYRAADISCDQAIEARFKELEAAGFKNLPVCMAKTQY

SEQ ID NO: 24348 - protein, 237 aa, Glycine max
MEGRMGLLFLVVLGAAWACDARELAKPDLLSKLSRKPDACALCEEYSTKVLDYLNENKTQQEIIDILHNICHQTSSFKQKCITLVDYYAPLFFLEIVTIQPGEFCHKVNLCQLITYISLLVQEDTSGFCKDTVSTLSAKLKDSDTKLEIIETSLKVCNSVEKYANKCKRMVLEYGPLVFDNAEKFLESTDICTAIYAMQIFNSGWPANLSFRFLWKQRSNRFVMYLLQKIAIYITTQ

SEQ ID NO: 24349 - protein, 261 aa, Streptomyces chartreusis
MTDNIERTAIVTGASNGIGRAIAATLAAEGVRVHICGRDAETVEKTVTELRADRGQVSGQACDVTKPDQVTALVADCVARYGPVDILVNNAGRPGGGITANIDNELWYATIDTNLNGVFLMSKSVLNEGRMTERQNGRIINIASVWGKQGTIGGAPYAAAKHGVIGFSRCLALELAKTGITVNAVCPGYVETPMSVNVRACQAGIWQVDEEEALRRLASDIPIGRYSEPEEVAWMVSYLASSKAASVTGQALNVCGGFGVH

SEQ ID NO: 24350 - protein, 380 aa, Oryza sativa
  misc_feature (31)..(31): Xaa can be any naturally occurring amino acid
  misc_feature (41)..(41): Xaa can be any naturally occurring amino acid
  misc_feature (321)..(321): Xaa can be any naturally occurring amino acid
  unsure (1)..(380): unsure at all Xaa locations
MADAEDIQPLVCDNGTGMVKAGFAGDDAPRXAVFPSIVGRXPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTQGIVLDSGDGVSHTVPIYEGYALPHAILRLDLAGRDLTDYLMKILTERGYSFTTTAEREIVRDMKEKLSYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEXITALAPSSMKIKVVAPPERKYSVWIGGSILASLSTFQQMWIAKAEYDESGPSIVHRKCF

SEQ ID NO: 24351 - protein, 369 aa, Medicago truncatula
MDPNNNHFNNQNYSNYPFNYENPNNYPNPNQFFNQRPQNIPNFGFPPNFNQSSSVPNFHPYYGSMMKYPSQTPPFNGSMPMENDNFHNVGATQYPEFSTQITPSGMAIADEVTPEDSTPKSKRSKEPAWNTQQNLVLISAWIKYGTSSVVGRNQRGETYWGKIAEYCNEYCSFDSPRDLVACRNRFNYMSKIINKWIGAYESAKRMQGSGWSEDDVLTKAQELFAGGKNIQFTLNEEWHALRDQPRYGSQMGGNVGSGSSGSKRSHEDSVGSSARPMGREAAKKKGKMKSKGETLEKVEKEWVQFKELKEQEIEQLKELNLVKQHKNKLLQEKTQAKKMKMYLKLRDEEHLDDRKKELLEKLERELFEN

SEQ ID NO: 24352 - protein, 317 aa, Blastopirellula marina DSM 3645
MEEFDVLKIASPPKRQRLEKPPGVTPIRVWWEYVGVIGLMHLFALYAFWPWLFSWTGVVSVFVGHHLFGMFGMTVGYHRLLTHRSFQCPLWLEHTFAILGVCCLQDTPARWVATHRVHHQHSDEQEDPHTPLVNFFWSQVGWLMVKDRNFGKMAHLDRYARDVVRDPLYLWLERGQNGLLVFVAHAFVIYLIGGAIGYFTGGWSEAWRMSWSLLIWGVFVRTVFVWHITWAVNSLTHMFGYRSYQTSDDSRNNWLIGLLSHGEGWHNNHHALPTAAAHGRRWWELDLSYRVICSLEAVGLAWNVARPDQKLATKARA

SEQ ID NO: 24353 - protein, 275 aa, Ralstonia eutropha JMP134
MCLILVAWQSHPDYALVVAGNRDEFYARPAAPAHWWQDASHVLAGRDLADVIGEPGTWMGVGGDGRFAALTNYRAPSEKRTDARSRGELVSGFLRGHDAPADYLGTLAGADGCYNGFNLLASDLNELWWYSNRSASRQPQRLRPGLYGLSNALLDTPWPKVRSRVGALAEALAADTGHANASAEPYLKLLADNRQAADFELPSTGVAPEWEKLLSSAFIRSGNYGTRASTVLRVRHDGRFDLSERSFDASGQTGEVSYRGKLNLARDTGTVPAPR

SEQ ID NO: 24354 - protein, 434 aa, Medicago truncatula
MGLYLIPSTKVCFINVKRQHKCGAAPTKTNIDFSSLIISMLLHMLVLVSLVYPINSLETSNHQLINQTFRSDEEFRNFKKMIAADLQRINKPAVKTIHSPDGDIIDCVLTHKQPAFDHPLLKGQKPLDPPERLRWHNQIDNLSDIFQLWSLSGESCPEGTIPIRRTTEQDILRAGSLNRFERKFTDASNGHEHSVGYLEGGVYKGAKANLNVWAPHVESQEFSLAQIWVLSGTFEKDLNSIEAGWQVSPQLYGDNRPRIFIYWTADAYKHGCYNLKCPGFVQISKKFALGAGISPVSKYNGQQFDIILSIRKDPKDGNWWLNYGPGNGIALGYWPSSLFTHLKDNADKIQFGGEIINTKSSGSHTSTQMGSGHYAEEGNGKAAYINDIQVLDSNNKVIVSPDLKYFVESPNCYTIHKDGKYLYYGGPGRNQKCT

SEQ ID NO: 24355 - protein, 399 aa, Alteromonadales bacterium TW-7
MRLGPGLLVTAAFIGPGTITTASVAGANFGFALIWTLLFSVIATILLQSMAARLGVATGQDLAQALRANIQTPLFKSLAIFLVISAIGVGSAAYEAGNLSGASMGLIGIFPNVNPQIWTPLIAFLSAGLLYSGKHKVVENALIVLVILMSLVFISTLIMASPSLGDILSGFTPSLPEGSITTVLALVGTTIVPYNLFLHSGVLAAKHDSKSDLQKVIKQTNVDTGLSITLGGVITLAILSTASVAFYGTNAGQISAANMAVQLEPLLGDAAHYFFAIGLFAAGLTSAITAPLAGAYAVCGMLGWSNDMASTRFKSVAIIILLFGAAVASLGLDPVAVIIFAQAANGLLLPVITIYLVWLVNQKSVMGKFTNSFILNLVTLPVLMLIFGLSSYKLIGLIF

SEQ ID NO: 24356 - protein, 117 aa, Bacteroides fragilis YCH46
MDLIKIAEEAFATGKQHPSFKAGDTVTVAYRIIEGNKERVQLYRGVVIKIAGHGEKKRFTVRKMSGTVGVERIFPIESPAIDSIEVNKVGKVRRAKLYYLRALTGKKARIKEKRVNG

SEQ ID NO: 24357 - protein, 1459 aa, Monilinia fructicola
MAANEAEGFTSIVRRERPVSAISRPVSGLSRVLSTSSAFSERRASRLYDDFDEDNKDEPISMAEDWGLMPEIQAMREQGEKDQVKRRDLGVTWRNLTVKGIGADAAINENVGSQFNIPKIIKEGRASPPLRTLVDSSHGCVKPGEMLLVLGRPGAGCTTLLKMLANNRAGYAEVTGDVHFGSLNHTEAHQYRGQIVMNTEDELFFPTLTVGQTIDFATRMKGPHNLPSNQSTPLEYQQRSRDFLLKSMGISHTHETKVGNEYVRGVSGGERKRVSIIETLATRGSVMCWDNSTRGLDASTALEYTKAVRALTDIFGLASIVTLYQAGNGIYNLFDKVLVLDEGKQIYYGPMKQARPFMEDLGFICDDSANVADFLTGVTVPTERKIRDGFHDRFPRTADEILAAYNNHPIKSEMEKDYDYPNTAVAKQRTSDFRESVQHEKYPRLSKKSPLTTSFTTQVKACIIRQYQIIWGDKATFIIKQLSTLAQALIAGSLFYNAPNNSAGLFVKSGALFLSLLFNALLAMSEVTDSFSGRPVLAKHKAFALYHPAAFCIAQIAADIPVLFVQISHFSLVMYFMVGLRQDAGAFFTYWVIIFATTMCMTALFRAVGAGFSTFDAASKVSGFLISALIMYTGYMIQKPDMHPWFVWIYWIDPLAYGFSAVLANEFKGQIIPCVGTNLVPNGPGYADLTYQACAGVGGALPGAVSVTGEQYLNSLSYSTDNIWRNFGILWAWWVLFVGLTIYCTSNWSSSAGKSGFLLIPREKAHHNASVLKAANAGDEESGAAQEKRQQDVHSASEDTKVGDENDDQLMRNTSVFTWKNLTYTVKTPSGDRVLLDNVQGWVKPGMLGALMGSSGAGKTTLLDVLAQRKTDGTIKGSILVDGRPLSVSFQRSAGYCEQLDVHEPFATVREALEFSALLRQSRTIPEAEKLKYVDTIIDLLEMHDIENTLIGTTGAGLSIEQRKRLTIGVELVSKPSILIFLDEPTSGLDGQAAFNTVRFLRKLADVGQAILVTIHQPSAQLFAQFDSLLLLAKGGKTVYFGDIGENSQTIKEYFARYDAPCPESSNPAEHMIDVVSGSLSKGKDWNEVWLNSPEYQYTVTELDRIINTAAAAPPGTSDDGFEFAMPMWQQIKLVTNRMNVSIYRNTEYINNKFALHIGSALFNGFSFWMIKDSVGGLQLRLFTIFNFIFVAPGVMAQLQPLFLERRDIYEVREKKSKMYSWWAFATGNVVSELPYLCICAVLYFVCWYYTGGFPSDSNKAGAVLFVMICYEFIYTGIGQFVAAYAPNVVFASLVNPLVIGTLVSFCGVLVPYAQITAFWRYWMYYLNPFNYLMGSLLVFTTWDTPVRCRESEFAIFNPASGTCGEYLSSYLQGMGAAANLTNPDATSGCRVCEYRSGKDYLQSLNLQTYSYGWRDAGICALFVFSGYALVFLLMKLRTKKNKGAEVGWPRGGVSTIVY

SEQ ID NO: 24358 - protein, 215 aa, Vibrio vulnificus CMCP6
MKFNAAIFDMDGLLLDTERVCMRIFKQACDVQNLPFYQETYLSIIGRNSAGIDAILRAAYGDDLDRLHAEWRKRYNQVVLHEAIPVKEGVIALLEWLKAHQIPAAVATSTQKDVALVKLKLAGLDHYFESITTGCEVTHGKPDPEIYLLAASRLNVPPAQCLAFEDSNNGVRAAVAANMMTYQIPDLVEPCEEVIAFGHRICPSLTEVLKELQPD

SEQ ID NO: 24359 - protein, 449 aa, Haemophilus influenzae R2846
MSKVASLDAFLTKVAQRDGYQPEFLQAVREVFTSIWPFLEANPKYRSEALLERLVEPERAFQFRVAWTDDKGQVQVNRAFRVQFNSAIGPFKGGMRFHPSVNLSILKFLGFEQIFKNALTTLPMGGAKGGSDFDPKGKSDAEVMRFCQALMTELYRHVGADTDVPAGDIGVGGREVGYLAGYMKKLSNQSACVFTGRGLSFGGSLIRPEATGYGLVYFAQAMLAEKGDSFAGKVVSVSGSGNVAQYAIEKALSLGAKVVTCSDSSGYVYDPNGFTTEKLAALFDIKNTKRGRVKDYAEQFGLQYFEGKRPWEVQVDIALPCATQNELELSDAQRLIKNGVKLVAEGANMPTTIEATEALLAADVLFGPGKAANAGGVATSGLEMAQSSQRLYWTAEEVDAQLHRIMLDIHANCKKYGTIEGQENINYVVGANVAGFVKVADAMLAQGVY

SEQ ID NO: 24360 - protein, 319 aa, Candida glabrata CBS 138
MSTLKLFILRHGQSDLNHENIFCGWIDAKLTDKGRSQAKNAGQLIAQHCKSNGITLPQIGFTSRLLRTEQTMDVILNELQLGKKDEVSGQFNNPVFVVFDYIYTLAEIRSYLLSEKEENPISNEIPVLRTWRLNERHYGAWQGQRKPKVLKEYGEEQYMYIRRDYNGRPPEVDLEKEMIQKHDLGAATGYEFKEPNRSLKYELEELNQNIKLPYSESLSDVVARLEPFLDEIILKVAKEFDLDSCLIVGHGSSVRSLLKILEGVSDEDIKGVDIPNGIPLVIELDKTNNFKFLRKYYLDPELAKINAEKVRKEGFEENP

SEQ ID NO: 24361 - protein, 255 aa, Kluyveromyces lactis NRRL Y-1140
MSGFSCEDELHSHNHDHGHSHGDDHGHGHNHDHGHSHEPPAETFSNQSLYTHIDMTKVQVLNGVSNDRSSLVSKSFLKPQDEKYNTSLYLESDADCQVLLQIPFTASVKIFAIILRVNKGGSGYSTPRHIQLYKNYNKNLDFDTINDLKAEYTVEFPDNVGIEPDYNNESLFDDDTFIKFDLPRNIFQNCENLTVLVKDNWSGDEDDLNRLYFCELRGEATGKLRNSGVPIVAVYEAAPNPADVKLESQTINYAS

SEQ ID NO: 24362 - protein, 629 aa, Pseudomonas fluorescens PfO-1
MTTKSKNAINLSDSAKVDEQSVQPFTRSQKVYVQGSRPDIRVPMREITLDVTPTDFGGEINAPVTVYDTSGPYTDPNVVIDVRKGLGDVRSAWIDDRGDTERLPGLSSNFGQERLADPELTKLRFAHVNNPRRAKAGANVSQMHYARKGIITAEMEYVAIRENMKLQEARAAGLLKQQHAGHSFGASIPKEITPEFVREEIARGRAIIPANINHVELEPMIIGRNFLVKINGNIGNSALGSSIEEEVAKLTWGIRWGSDTVMDLSTGKHIHETREWIIRNSPVPIGTVPIYQALEKVNGVAEDLTWELFRDTLIEQAEQGVDYFTIHAGVLLRYVPLTAKRVTGIVSRGGSIMAKWCLAHHKENFLYTHFDEICEIMKAYDVSFSLGDGLRPGSIADANDEAQFGELETLGELTKIAWKHDVQCMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARSYHDETLPKDSAKVAHFCSMCGPKFCSMKITQEVREYAANQRIDAVDVDVAQGLAEQAERFKKEGSQLYKKV

SEQ ID NO: 24363 - protein, 525 aa, Alteromonadales bacterium TW-7
MSKDIHDSRILILDFGSQYTQLIARRIREIGVFCELWAWDVTEEQIREFNPQGIILSGGPESTTLENSPRAPEYVFNAGVPVLGICYGMQTMAIQLGGRVHSSDKKEFGYAQVEKVGNCALFDAIEDHITDGGNGVLDVWMSHGDKVMEVPASFSTTAKTPTCPHAAMSNEEKRFYGVQFHPEVTHTHQGQRLLERFAIDICGCEKLWTPAKIIDDAIERIKETVGDDEVILGLSGGVDSSVVAMLIHRAIGDRLTCVFVDNGLLRLNEGQQVMDMFGNKFGLNIVKVDAEEQFLADLAGKSDPEDKRKAIGHTFINVFDEQAKKLKNAKWLGQGTIYPDVIESAASATGKAHVIKSHHNVGGLPDDMKMGLVEPLRELFKDEVRKIGLELGLPYDMLYRHPFPGPGLGVRVLGEIKKEYCDLLRRADAIFIEELHKAELYHKVSQAFTVFLPVKSVGVMGDARKYDWVVSLRCVETIDFMTARWSHLPYEFLGVVSNRIINEIDGISRVVYDISGKPPATIEWE

SEQ ID NO: 24364 - protein, 396 aa, Brucella suis 1330
MAETQVRNFNINFGPQHPAAHGVLRLVLELDGEVVERVDPHIGLLHRGTEKLMEAKTYLQAVPYLDRLDYVAPMNQEHAYALAVERLLDIEVPKRGQLIRVLYSEIGRILNHLLNVTTQAMDVGALTPPLWGFEEREKLMVFYERACGARMHAAYFRPGGVHQDLPDQLIEDIGKWIDPFFTTLKNLDDLITPNRIFKQRNVDIGVVKLEDAWAWGFSGVMVRGSGAAWDLRKSQPYECYSEMEFDIPVGKNGDCYDRYLIRMEEMRQSARIMRQCVDLLLGKERVGPVSNTDHKIVPPKRGEMKCSMEALIHHFKLYTEGYHVPAGEVYAAVEAPKGEFGVYLVSDGSNKPYRCKLRAPGFAHLQAMDFLCRGHMLADVSAILGSLDIVFGEVDR

SEQ ID NO: 24365 - protein, 810 aa, Coccidioides immitis RS
MTWKSRLFSRSAASGHGDGEVITTHSDEVKGEGKPESQEREIAAKDLEKVAKSHQWDPNLPSEQIDAIEEARRTGDVEIVTQVDKAFLEDSPYPEVRAAVRNTDEGEVANTVRAWILGLVFVTVGSGLNMFLSMRSPAITFPSIVVQLLVYPVGCLWAKVVPRRVFNVFGLRWTFNTGPFTIKEHAVITVSRLFFPTPKTMLNVLIHFCRSCQTFFNINLGWGFALLFTLSSQMIGMALSGIFRRFLIWPAAMIWPAVFSNTSLFYALHDKTRSDPSMTNGWRISRYRWFLYLMMAAFAYYWLPGVLWQGLSVFCFVTWIRPKSPVINQLFGGFTGLSLIPLTFDWTYISSYLQNPLLSPTHSHLNTLIGLGLFVIITTVGISYSGAMYSDYLPINTSSTFDNTQNFYNVSRILGPNFSFDIEKYKSYSPLFLAPTFALNYGLSFAALTAVLVHIALYHGKEIIYRAKAARNQEPDIHMKLMSKYEECPEWWYAVLLAVSVALGLATSEAYSSQLPWWAFFVATIMGLVFVVPTCMLLAIANIPLALNVLSPFIGGFMLPGKAIGVMVFKVYATNTLGRAQTYSRDLKLGHYMKVPPKTTFTCQVGATIWAVFVQIAVMNWTLGNIENVCTPDQPAHFTCPNGKTFFSSSIVWGVIGPQRMFGPGSIYSSIQWYWLIGAALPVVFYVLIRLFPRSPARFLNAPVMLGAMNWLPPATPLSFSSWAIVGLIFNYWIRRKWSGWWHQYNYVTAAALDSGLVIATIVIFFAITFPGVSLPNWWGNNIPYETIDYTYEAVRRTVSPGETFGPREW

SEQ ID NO: 24366 - protein, 340 aa, Zea mays
MQHLAAVLLVLAATTALPPGAAAWRPWPPRDNATAAAGLGASKGLEGSSEFVKLEYHMGPVLASAITVHPIWYGPWPAAQKRTIRAFLRSLSPSAAIPSPSVSAWWRTVRLYADQTSANVSASVSLGAEKSDARMSRGARLSRMDIQAVVRDAVTARTRPLPVDASGGVYLVLTSPDVAVDDFCGQVCGFHYFTFASVVGSTLPYAWVGNSARRCPEVCAYPFAVPAYVRGRRPESPPNGDVGVDGMVSVIAHELAEMASNPLANAWYAGGDPSFPTEIADLCEGIYGTGGGGAYTGQLLTDARSGAAYNVNGVGGRRFLVQWVWNPVLSYCSGPNALDQ

SEQ ID NO: 24367 - protein, 397 aa, Acidovorax sp. JS42
MHILRFSDLCAQGQARGQRVFIRADLNVPQDDAGRITEDTRIRASVPCIQMALEAGAAVMVTSHLGRPTEGEFKPEDSLAPVAQRLSELLGREVPLVADWVDGVQVQPGQVVLLENCRVNKGEKKNDPELAKKMAQLCDIYVNDAFGTAHRAEGTTYGIAEYAKVACAGPLLAAEIDAIQTALAHPKRPLVAIVAGSKVSTKLTILQSLSKNVDGLVVGGGIANTFMLAAGLPIGKSLAEPDLVNEAKAVIAAMAARGAEVPIPTDVVVAKAFAADAPATVKKASEVAEDDLILDIGPETAAQLAAQLKAAGTIVWNGPVGVFEFDQFAGGTKAIAQAIAESSAFSIAGGGDTLAAIAKYGIEKDVGYISTGGGAFLEVLEGKTLPAIEILQKRAAG

SEQ ID NO: 24368 - protein, 163 aa, Brucella suis 1330
MASITQAAKSLLLKEFASAFALSMRQFFAPKATLNYPHEKGPVSPRFRGEHALRRYPNGEERCIACKLCEAICPAQAITIEAGPRRNDGTRRTVRYDIDMVKCIYCGFCQEACPVDAIVEGPNFEFATETREELYYDKDKLLANGDRWEREIARNIAMDAPYR

SEQ ID NO: 24369 - protein, 272 aa, Haemophilus influenzae Rd KW20
MDLYAVWGNPIAQSKSPLIQNKLAAQTHQTMEYIAKLGDLDAFEQQLLAFFEEGAKGCNITSPFKERAYQLADEYSQRAKLAEACNTLKKLDDGKLYADNTDGIGLVTDLQRLNWLRPNQHVLILGAGGATKGVLLPLLQAQQNIVLANRTFSKTKELAERFQPYGNIQAVSMDSIPLQTYDLVINATSAGLSGGTASVDAEILKLGSAFYDMQYAKGTDTPFIALCKSLGLTNVSDGFGMLVAQAAHSFHLWRGVMPDFVSVYEQLKKAML

SEQ ID NO: 24370 - protein, 496 aa, Pseudomonas putida GB-1
MVAGLLERLGVAAEAYTQGDYPVHTPIDGSQIASVKLLGKAETIARIDQAQSAFDAWRTVPAPRRGELVRLFGEVLREHKADLGELVSIEAGKITQEGLGEVQEMIDICDFAVGLSRQLYGLTIASERPGHHMRETWHPLGVVGVISAFNFPVAVWAWNTALALVAGNSVVWKPSEKTPLTALACQALFEKALKAFGDAPAGLAQLVIGGREAGEAMVDDPRVPLVSATGSTRMGREVGPRVAARFGRSILELGGNNAMILAPSADLDLAVRGILFSAVGTAGQRCTTLRRLIVHRSIKDEVVARVKAAYGKVRIGDPRKDNLVGPLIDKLSFDAMQGALAKARDEGGQVFGGERQLADQYPNAYYVSPAIAEMPAQSDVVRHETFAPILYVLAYDDFEEALRLNNEVPQGLSSCIFTTDIREAERFQSASGSDCGIANVNIGTSGAEIGGAFGGEKETGGGRESGSDAWKGYMRRQTNTVNYSRELPLAQGIVFD

SEQ ID NO: 24371 - protein, 296 aa, Chromobacterium violaceum ATCC 12472
MTRVLVVGSINMDLVVTARRMPKLGETLLGDGFATHPGGKGANQAVAAARLGAEVALLGCVGDDAFGRDLRAHLEREGVDCRGVATVPGPTGIAAITVSGGDNAILVVPGANHQLTPAHLDAAEQAFIDADVVLTQLEIPLAAVRRAAELAARHKKPLLLNPAPAVPLPEELLQRVTLLTPNEHEFLTMLAQPDADWRALLAERPGKLVMTHGKHGAYFALARGQLRHQPGFEVQAVDSTGAGDTFNGALAAFLPLGLEEAVRRANAAGALSVTRPGAQGGMPTLAELEAFLENKA

SEQ ID NO: 24372 - protein, 358 aa, Glycine max
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 24373 - protein, 826 aa, Bacteroides fragilis YCH46
MKIIIIGGVAGGATTAARIRRSDETAEIILLEKGKYISYANCGLPYYIGDVIEEREKLFVQTPEAFGVRFRVDVRTENEVIFIDRKKKTVTVRLKSEDTYEESYDKLLISTGASPVRPPLPGIDSTGIFTLRNVADTDRIKAYVNNRPPRRAVVIGAGFIGLEMAENLHALGAQVSIVEMGNQVMAPIDFSMAALVHQHLMEKGVNLYLEQAVASFEQAGKEVKVVFKNGQSILADIVILSIGVRPETTLARAAELTIGEAGGIAVNDYLQTSDESIYAIGDAIEFRHPITGKPWLNYLAGPANRQGRIVADNLLGAQIPYEGAIGTSIAKVFDMTVASTGLPGKRLKQAGIVYASSTTHPASHAGYYPDAMPMSIKITFDPQTGKLYGGQIVGYDGVDKRIDELSLVIKHEGTIYDLMKVEQAYAPPFSSAKDPVAIAGYVAENIILGRVKPVYWRDLRDIELKDVFLLDVRTPDEFALGSLPGAVNIPLDEIRDRIAELPSNKPIYTFCAVGLRGYLAYRILIQHGFKEVYNLSGGLKTYRAATAPIILHENEETDDTPSAQDSPAKPSVGAEAPQTTTAANPKTIRVDACGLQCPGPVLKMKKTMDTLVPGERVEIVATDPGFSRDAAAWCNSTGNKFISKDSTGGKSVVVIEKGEPQACNLTTTCDSKGKTLIMFSDDLDKALATFVLANGAAATGQKVTIFFTFWGLNVIKKLHKPKVEKDIFGKMFGTMLPSSSLKLKLSKMSMGGMGGKMMRYIMHRKGIDSLESLRQQALENGVEFIACQMSMDVMGVKREELLDEVTVGGVATYMERADNANINLFI

SEQ ID NO: 24374 - protein, 474 aa, Lachancea kluyveri
AGPVGALIAYMFIGTLAYMVSQSLGEMATFIPVTSSFMVFTQRFLSPALGAANGYMYFLSWSITFALELSVVGQVIQFWTDAVPLTAWIIILWVVLVSANLAPVKFYGEVEFWIACIKVLAIVGFIIYAFIMVCGAGKTGPVGFRYWRNPGPWGPGIISKDVNEGRFLGWVSSLISAAFTYQGTELVGITAGEAANPRKTVPRAINKVFFRILFFYILSLLFIGLLVPFNDPKLKSEDSYISSSPFVIAIENSGTKVLPHIFNAVILSTIISAGNSDVYISSRVLYSMGLNGLAPKYLTWTTKSGIPYAAVLTTSLVGFLAYLESSHGASVVFDWLLNITAVAGFFAWMLISVAHIRFMQALKHQGISRDDLPFKAKFMPWGAYYAAFFIGVIIIIQGFTAFAPKFNVSDFFTAYVSVILFFAVWIGFQIWFRGPLFKKTEDIDLDTDRREIDNDVWEEDEPKNLWEKFWSAVA

SEQ ID NO: 24375 - protein, 434 aa, Oryza sativa (japonica cultivar-group)
MELSLITFTATGAAAAFTSPKIKRRMRMAPTMASKPGAKVKVSAGCKTCRGKGAVECPGCKGTGRNKKNGNIFERWKCFDCQGFGLKSCPSCGKEGLTPEQRGETRCILPCKSAQKEYTRKCLNFVGKASPPPESTVLHVDHLSRNVNEDHLKEIFENYGEVVNVELSMDRVVNLPRGYGYVEFKNRADAEKALLYLDGGQIDGNVVKVRFALPPQQQRAAASPKALHPSPKRDVVDHNKVGPSAEKATKQQPRKPASPQRKPAPSPRRRSPPSRRVESPRCRPDSPPIRRRTAPSPIRHGGTPSRRPGSPIRRRSPSPPPRRLRSPRHLSPRRDRGSPIRRRSPLPRRRLTPPRRMWSPPRRPQSLRHRSRSPIHRPIRSPSRSISPRRDQEGCSEVAVLEALVLRVSLGLCAMVHAFPTIKLALEHLDIAGS

SEQ ID NO: 24376 - protein, 550 aa, Ustilago maydis 521
MVAVAAASLAQRTRLRSTPMLVSAARLPVTAASTSRASRGLASAAASTPAQRPSSLSTTLAYNRATFTRVGVAFRAQSNLLAGKPFSSAIARRNLSFWSSSKPASTTSGDQSSSLSSEIETKKEQVIDAVNDLSQSSKASIHDVESSLSEGLHSTQQAASDAVSTLQSKASQVSSTLTEQLSNVDATAASTVTEAFSGAMGVIPGELTELGLNHWVTPPGWITNLLEFVGTTTGLPWWGTITITTVALRLLIAPISIAGQKNAIRLGNIQPEMKRNMDDIKHYKAAGDQMQMQKAVMATQKLLRDNNANPIKSLVPILFQFPLMFSYFLALERIAKSGSESFAHGGPFWTTDLTVPDPTWILPAISTLATFAVAEVGFKVGTNSQSDPAQSQMMKYIFRGFMPILAWFSTTFPSGVLVYWATTNLYSLAQLAILQVPLVRKWAKFPKRITHPKNPYQQEANTFMDKLRAAKDRMSDSSATHKPVKPVAATSTASTTPTQTSSRSDALNEILNDKSTYEASATTTNADAQSTAAQRNRERVLKARQRRARQ

SEQ ID NO: 24377 - protein, 389 aa, Oryza sativa (japonica cultivar-group)
MVAHGERGVVAEMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 24378 - protein, 323 aa, Candida glabrata CBS 138
MSFRPGSRGGARGGRGGSRGGFGGRGGSRGGFGGRGGSRGGSRGGFGGRGGSRGGPRGGSRGGPRGGARGGARGGAKGGAKVVIEPHKHDGVYIARGKEDLLVTKNMAPGESVYGEKRVSVEEPSKEDGVPPTKVEYRVWNPFRSKLAAGIMGGLDELFIAPGKKVLYLGAASGTSVSHVSDVVGPEGVVYAVEFSHRPGRELISMAKKRPNVIPIIEDARHPQKYRMLVGMVDAVFADVAQPDQARIIALNSHMFLKDQGGVVISIKANCIDSTVDAETVFAREVQKLREEKIKPLEQLTLEPYERDHCIVIGRYMRSGLKK

SEQ ID NO: 24379 - protein, 403 aa, Blastopirellula marina DSM 3645
MASKAKRIGILTSGGDCPGLNAVIRGAVKTANRLGFDTIGFLKGYEGLVDPVQYVPLNDENTRGILGRGGTILGSTNKGRFAATVGINDRVELCPQLMKKVKGTFDQLSLSGLICIGGDGSLAVAQQFHEYGLPVVGVPKTIDNDLSATAFTFGFDSAVECGTEALDRLQTTAASHERIMVMEVMGRHAGWIALHSGIGGGADVILIPEIQWNFDIVCEKILERYKAGKKFTLIVVAEGAHLPDKGMVTQESEKSDRQTRLGGIGQIIAAEIERRLHFEARTVVLGHLQRGGAPTTFDRVLATQFGAHAVRTIVERRFGHMVCYSPPNIESVPILEAVHQLRTVHPDSSAVQAAQAMGISFGNCALHETPFQRYVTQHEHELATDDTTALLESALQSLVGAEA

SEQ ID NO: 24380 - protein, 200 aa, Arabidopsis thaliana
MSSKKIVLTSSDGESFKVEEVVARKLQIVGHIIEDDCATNKIPIPNVTGEILAKVIEYCKKHVEDDDDVVETHESSTKGDKTVEEAKKKPDDVAVPESTEGDDEAEDKKEKLNEWDAKFMKDFDIKTIFDIILAANYLNVQGLFDLCSKTIADYIKDMTPEEVRELFNIENDFTPEEEEAIRNENAWTFEQDGKQQVPKP

SEQ ID NO: 24381 - protein, 258 aa, Kluyveromyces lactis NRRL Y-1140
MNRGNPSRTVYLGSIPYDQTEQQILDLCQTIGPVTAMKMMFDPTTGKSKGYAFIEFKDLATSASAVRNLNGYTLGSRSLKCGYTTGSGINGSGSGPGDEEENGNMVEDVKFPWLPVGVDVNINMTTPAMCISSELGKLQKDQQMALLKVIQHFCKDDKETFVALLEEAPQLSYAIAELLLSNGVCSVDQLTQLAMASKQRPEEQTDNTVEDGLDEEKVDLLRQVLQLQDSDIAMLPQDEKMAVWELKQRAMKGEFGHL

SEQ ID NO: 24382 - protein, 217 aa, Alteromonadales bacterium TW-7
MTQDELKKAAAWAALEFVKENTIVGVGTGSTVNHFIDALGTVKDTLVGAVSSSEASTARLKELGIEVFELNDIDVLDVYIDGADEINAQNEMIKGGGAALTREKIVAAVAKQFVCIVDDTKLVDTLGEFPLPVEVIPMARSYVARELLKLGGDPVYRQGVVTDNGNVILDVYNLNITNAKQLETDINQIVGVVTNGLFAMRGADKVIIGTKNGPQIK

SEQ ID NO: 24383 - protein, 732 aa, Azoarcus sp. EbN1
MDAAAIPAPGPFGSPSGLPVSSDFAALRQKLETYLRPEDVEKVEAAYHFSASAHEGQLRISGDPYISHPVAVADIVSDWHLDAQALIAALLHDVMEDTHISKQEIVDRFGRTAAELVDGLSKLDKIEFRSHEEAQAENFRKMLLAMASDLRVILIKLADRLHNMRTLQCIRSAKRRRIASETLEIYAPIANRLGLNNLYRELQELAFEHKYPLRYRVLSRAIKAARGNRREVVGKVLQGIEERLPQWGITAEVQGREKHLFGIYRKMAEKRLSFSQVLDIYGFRVIVRDVPSCYLAIGALHSMYKPVPGKFKDYLSIPKANGYQSLHTTLIGPFGTPVEVQVRTAEMHHIAETGVASHWLYKEDEKTLTELQQKTHSWLQSLLELQSASGGATEFLEHVKIDLFPGEVYVFTPQGRILSLPKGSTPVDFAYAVHTDIGNRCVACRVNGDLMPLRTELHNGDQIEIITAAHANPNPAWLAYVRTGKARAQIRHFLKGAQQEESVVLGERLLNQALRPHGLTLGQISTFAWERFLRDRSMRSKKEVFADIGLGRRLPVIVARRVAQAQDLESGRPNVIKPKPAGAILIRGSEGIAVQLARCCQPIPGDPIIGMIRKGQGLEVHLHDCAVVAKLRGDRGRWVDVEWETGEDRVFDVTIRVLTRNTRGVLAKVASAISEEDCNIQNVSMDNEQGIYTAINLVLQVRDRMHLAKVMRGVRRVQEVVRIGRLKGDVRS

SEQ ID NO: 24384 - protein, 403 aa, Nostoc punctiforme PCC 73102
MSLNWIVPAERIQKLPPYVFARLDELKAKAREQGLDLIDLGMGNPDGATPAPVVEAAIAALKDPANHGYPPFEGTASFRRAITNWYHRRYGVVLDPDSEALPLLGSKEGLTHLAIAYVNPGDLVLVPSPAYPAHFRGPAIAGGKIHSLILKPENDWLIDLAAIPDEVARQAKILYFNYPSNPTAATAPREFFEEIVAFARKYEILLVHDLCYAELAFDGYQPTSLLEIPGAKDIGVEFHTLSKTYNMAGWRVGFVVGNRHVIQGLRTLKTNLDYGIFSALQKAAETALQLPDVYLHEVQQRYRTRRDFLIDGLGELGWDIPRTKATMYLWVKCPVGMGSTDFALNVLQQTGVVLTPGNAFGVAGEGYVRISLIADCDRLGEALHRFKQAGIRYQPEAVVSASG

SEQ ID NO: 24385 - protein, 165 aa, Brassica napus
MASLFSFSSLLQPKVSFTSPLKPKAVKTSTSAPQTQTITEGLEEKFGRKGIKFSEPNMVELKVRNGSSLKLSLADAHVVSYQPKVFWKDDGFEEVLYTVEDGNKTRGGVGLVIINEEEASSVLSGCNWTVKDTDSDAIDALQIELSCTAGFLDITYIVSLYPVSI

SEQ ID NO: 24386 - protein, 1023 aa, Lachancea kluyveri
  misc_feature (105)..(105): Xaa can be any naturally occurring amino acid
  unsure (1)..(1023): unsure at all Xaa locations
MSFEDNIGDDSITKEIPAIEGDVAPDHRPYFGLENDLKEQENIRRLARSLTRQSLHSVSNNSLADNENPNDTNSEFGLKRSLTSISHVPGQVPFSSKDIDPRLDXESDTFDPAFWAQNLRKLYLSDKDYYKPVELGVCLKNMRVSGVSVDSDYQSTVLNLPLKWGEKLYTNLFRSNDESRYFDILKPMDALFEPGRLCVVLGRPGAGCSTLLKTISARTYGFKIQPESVISYDGITQKEITKHYRGDVIYSAEMDYHFASLPVGYTLEFAARCRCPESRPEGITREQYYKHYAAVVMATNGLSHTYNTKVGNDFIRGVSGGERKRVSISEVTLAGAKVQCWDNSTRGLDSATALEFVRALKTNANVSRITPLIAIYQCSQDAYDLFDDVLLLYEGYEIYFGKAEDAKQYFLDMGWDCPPRQTTADFLTSVSSPAERRAKPEWENKVPRTAKEFYDIWLHSKEYAKLKVKIDKHLAKSEDGETKRQLAEHHRARQSKNLRPQSPFIISFGMQVKAVIHRNIQRIKGDPSVYLSAIISNSVMGLLVSSMFYNQKSNTGSFYYRTSALFTAILFNSFSSFLEILALFEARKIVEKHKTYAFYHPSADALASIITELPSKILVALGFNLSFYFMVNFRRTPGHFFFYFLVSVTSTFAMSHLFRTIGAASTSLQMAMTPASLLLLIISIYVGFVIPKGSLLGWSKWLYYLNPIARSMESMVANEFAHRTFECSHFIPSGPGYENVTLANKVCAVVGSVAGQSTVDGTSYMEKSFSYYDKHRWRNWGIVLCYAVFFLIVYMVLIEYNKGEMQKGEVILFTRSTLNKKRKKNEALKGDIESNDSITKDLTVSEESYSNEKENSLQKIGSEDIFHWRDVCYDVKIKSETRRILSNVDGWVKPGTLTALMGSSGAGKTTLLDVLANRVSTGVITGNMFVNGHLRDESFQRSTGYCQQQDLHGRTQTVREALRFSAHLRQPQDVSKAEKDEYVEEIIKLLEMEAYSDALVGVTGEGLNVEQRKRLPIGVELVA

SEQ ID NO: 24387 - protein, 181 aa, Glycine max
MHMHVVYCIYLQRNLSFIFVCFPNLLGYYNVHLRSCIPYRYKEDIDGKMSNELEVLVVSSQKGRGLMFPKGGWELDESVEEAAYRESLEEAGVLGMIERELGQWNFISKRYGIYYEGHMFPMFVKEQLDIWPEKNLRRRIWMTVAEAREVCQHWWMKEALDILVQRIVSSQQRKEDLYSIG

SEQ ID NO: 24388 - protein, 443 aa, Ralstonia eutropha JMP134
MDAAKTVIPDLDALWMPFTANRQYKAAPRLLASASGMYYTTHDGRQILDGCAGLWCVAAGHCRKEIAEAVARQAATLDYAPPFQMGHPLSFEAATKVAAIMPQGLDRIFFTNSGSESVDTALKIALAYHRARGEGQRTRFIGRERGYHGVGFGGMAVGGIGPNRKAFSANLMPGTDHLPATLNIAEAAFSKGQPTWGAHLADELERIVALHDPSTIAAVIVEPLAGSAGVLVPPVGYLDKLREITTKHGILLIFDEVITAFGRLGTATAAERFKVTPDLITMAKAINNAAVPMGAVAVRREVHDTVVNSAAPGAIELAHGYTYSGHPLAAAAAIATLDLYQRENLFGRAAELSPVFEAAVHSVRSAPHVKDIRNLGMVAGIELEPRPGQPGARAYEAFLKCLERGVLVRYTGDILAFSPPLIISEAQIAELFDTVKQALQEVQ

SEQ ID NO: 24389 - protein, 192 aa, Methanocaldococcus jannaschii DSM 2661
MRDGEGIWGRGRTGGHAHPKEAMHTTFFILGGTMLIGVISDTHLYDRAFELPKAVFDEFSNVDLIIHCGDVTDKEILDSLKDLAKVVAVKGNMDYLNLPRKEILEINDIKIGVIHGDVVYPRGDRLKLRLLGKEMGVDVLISGHTHTPFIDDCRDILLLNPGSPTVPRCPLKSIMKLSVEDKLEAKLIPIEE

SEQ ID NO: 24390 - protein, 279 aa, Triticum aestivum
  misc_feature (9)..(9): Xaa can be any naturally occurring amino acid
  misc_feature (216)..(216): Xaa can be any naturally occurring amino acid
  unsure (1)..(279): unsure at all Xaa locations
RHEAAPAWXKGLSPIVAGLSGLGLSDPEMVRLLSLAPHKFRCRSIVAKLHYYLPLFGGSLEKLLRAINFTNLLCCKGRVEPNVAFLRECGLGDGDIAKLCSSRMVTANMERVRTMVALTEGLGVPRGSGMFRHALSAVAFLDEKKITAKVDHLKKTVGWSDAEVSIALPKAPFLLAKSNESLQHGSEFLVSEVGLEPAYIARRPVLLCYSLEGRMXPRYYVVKFLKENGLLKRDPSYYTVFKETDTYFVEKFICPHKEAAPYLAEDYAAACGGEVPASI

SEQ ID NO: 24391 - protein, 465 aa, Ralstonia eutropha JMP134
MSLFRTKNIDAMLAVAHNDGLKKVLGPMDLVMMGIGAIIGTGIFVLTGTGALTAGPALTVSFVIAAMACGFAALCYAEFASAIPVSGSIYTYSYATLGEIIAWMIGWDLLLEYGLATSAVSVGWSGYFQSLVSGFGVKLPAALTAAPGAVPGVETMVNLPAVLIMLAITWIVSYGVKESARLNNVMVAIKIGVVLLFIAVGVWHVKPANWEPFAPFGMTGVFNAAALVFFAFIGFDAVTSAAEEVRNPSKDLPIGIIGSLAVCTVLYVVVAAIMTGIVPFAKFAGVDHPVSLALQYAGKNWVAGFVDLGAILGMTTVILVMTYGQTRIIFAMSRDGLLPERLSSVHPVHATPYFATWTVGIVFAAIAGFVPLNVLAELINIGTLAAFTLISIAVLVLRRTRPDLPRAFRCPGVPVVPLLSAGFCLFLMAHLQALTWIAFLVWLVIGLAIYFLYARRNAVLHNHGG

SEQ ID NO: 24392 - protein, 366 aa, Oryza sativa
MATWSNASSLIVAAVILLGLSSASVAHGRRGRRSFVSSYDEPCMEMRLYLHDIIYDYSNSTSNSTSAAATKPTPLSTAVSNPGYFFGEMVVFNDPMTEGRALPPSPAMEEETAVRAQGVYLYDKKEAPNAWFAFSVVFNSTGRRGTLNLMGADLMSEKTRDLSVVGGTGDFFMSRGVATLSTDEASADLSYFRVKGSIAVKSKLLCRLGGKLGNDNMRGLFVGVGVRSDRKIRSRSSVFRRKFGTKKFDRGVAGAVEGGGVGCGAVEDGVGRVAVEDGGVGRGVVEDGGGGRSRGAVEGGGGGGDAVEAGGGGGAVGAEPAVGAGGGGGVVGLEEEAALCGSSGRVFFMGLLDFLGLLGQNFGHFG

SEQ ID NO: 24393 - protein, 663 aa, Alteromonadales bacterium TW-7
MPSRKELANAIRVLSMDAVQKAKSGHPGAPMGMADIAEVLWRDYLKHNPSNPEWADRDRFILSNGHGSMLIYSLLHLSGYDLPLDEIKNFRQMHSKTPGHPEYGYAPGIETTTGPLGQGITNAVGMAIAEKALAAQFNREGHDIVDHHTYAFMGDGCLMEGISHEACSLAGTLGLGKLVAFWDDNGISIDGEVEGWFSDDTPARFKAYGWHVISDVDGHDSDAVSAAISEAKSVTDKPTLICCKTIIGYGSPNKSGSHDCHGAPLGDDEIKASREFLGWTGDAFEIPEDIYAQWDGKAKGQELESSWDEKFAAYAKAFPELAAEYKRRTNSDLPADWAEKSQAYIEQLQANPANPASRKASQNALNAFGPLLPEFMGGSADLAGSNLTIWEGSKGLTADDASGNYVYYGVREFGMSAIMNGIALHKGFIPYGATFLMFMEYARNAVRMAALMKQPSIFVYTHDSIGLGEDGPTHQPVEQIASMRLTPNLYNWRPCDQVESAIAWQQAIERKDGPTSLIFTRQGLEQQARDAQQLSDVKKGGYILSCDGNPELIIIATGSEVQLAQDSATELRSQGKKVRVVSMPCTDAFEDQSPEYKESVLPASVSRRVAIEAGIADYWYKYVGLNGAVVGMTTFGESAPANELFEHFGFTVENIVNKANALF

SEQ ID NO: 24394 - protein, 466 aa, Bacillus cereus E33L
MKTVVVIGGGITGLSTMFYLEKLKKDYNIDLNLILVEKEEYLGGKIHSVEEKDFIMESGADSIVARNEHVMPLVKDLNLEEEMVYNETGISYIYSDNTLHPIPSDTIFGIPMSARSLFSSTLVSTKGKIIALKDFITKNKDFTKDTSLAVFLESFLGKELVERQIAPVLSGVYSGKLNELTMASTLPYLLDYKNKYGSIIKGFEENKKQFQSAGNKKFVSFKGGLSTIIDRLEEVLTETVVKKGAVTTAVSKQGDRYEISFANHESIQTDYVVLATPHNIAETLLQSNELNEQFHTFKNSSLISIYLGFDILDEQLPADGTGFIVTENSDLHCDACTWTSRKWKHTSGKQKLLVRMFYKSTNPVYETIKNYNEEELVRVALYDIEKSLGIKGEPEVVEVTNWKDLMPKYHLEHNQAVQTLQEKMMNLYPNIYLAGASYYGVGIGACIGNGKNIANEIIATLNEPSN

SEQ ID NO: 24395 - protein, 237 aa, Bacillus cereus G9241
MKKYALVTGGSGGIGSAISKQLIQDGYTVYIHYNNSEEKVNELQKEWGEVIPVQANLASTDGAEQLWNQIEHPLDVIVYAAGKSIFGLVTDVTNDELNYMVELQVKSIYKLLSMALPSMIQRRSGNIVLVSSIWGQIGASCEVLYSMVKGAQNSYVKALAKEVSLSGLRVNAVAPGAIETEMLNVFSEEDKNEIAEEIPLGRLGLPEEVAKTVSFLVSPGASYITGQIIGVNGGWHC

SEQ ID NO: 24396 - protein, 118 aa, Glycine max
  misc_feature (113)..(113): Xaa can be any naturally occurring amino acid
  unsure (1)..(118): unsure at all Xaa locations
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKXNGERE

SEQ ID NO: 24397 - protein, 310 aa, Nocardioides sp. JS614
MTVDPQIAALLEFIASVEAKPMSEGTPEEARQGFRTLTVDLRDPAAVPAVRSVEETTVPGAAGDLPARVYRPGLDGPLPTIVLLHGGGFVIGDLDTHDITARTLANGCAAVVVSVDYRLAPEHPFPAPVDDAVAAARHVADHLADFGGDDRVALAGDSAGGNLSAVVAQAFREEGRPLAGQLLIYPVTDMTGEYPSHTENAEGLFLDLATMAWFQQQYAGHLADLADPRLSPLLGDLHGLAPAVVVVAELDPLRDDGLAYATALAAAGVPVEVRRFPGLVHGFVDMGRHSEAAQRALDETCALFRAVLHG

SEQ ID NO: 24398 - protein, 471 aa, Zea mays
MGRLTEEQAAREAGSAGTNATSLKLTHRALSDVSCLSSFKNLEHLDLGFNCLVTLEGLSSCANLKWLSVKENKLVSLKGVEGLSKLQVLNAGKNELTKMDEVTSLTSLGALILNDNNISSICKLDQLQQLNTLVLSKNPVFTIGNALVKAKSMKKLSLSHCQIENIGSSLVKCVELKELRLSHNKISTIPSDLAKNVKILNLDLGNNFIERSSDLKVLSELRYLRNLNLQGNPVSKKDSLVKKVKKSVPTLRILNAKPLEATSKSDTRSTKENPPSKDEDPIGIDAKKDKRKGSKQEVKGLEELEVQSVSTGITTSNPGKLEVPDGKEKKKVKEAKTKKSEEPYHANNSSLKNKEVQSFVYDTSTKDKKEAKRKKFVDEEDVDAEGIDNTEISFADLMFSNVGNPETKLKNISTLEAAPDGKSVGGLVIDHTKKRKKPKGVVTITDSSALKMFSSMPEVGAGGLGLSGWDE

SEQ ID NO: 24399 - protein, 499 aa, Pseudomonas fluorescens PfO-1
MPHTKDQLPDALYRAAQVRELDARLIAGGTPGFELMQRAAHATWRALVRQWPAANEMTVFAGHGNNAGDGYLVAALAHRAGWQVQVLAVGEPQRLKGDAAVAHAEAVAEGVSIAAWDLSCELRGIVVDALLGTGLNGEVREPYAAAIAAINASGLPVVAVDIPSGLCADTGHALGDAVHADLTVTFIGLKLGLFTGAAADHVGELRFNDLQATAENFSDIPAAAQRLSAINLPRLAARAPAAHKGRFGHVLLIGGDHGFGGAILLSTESALRSGAGMVSVATRPEHVPAALSRVPEAMVLGTSSANQLMGLLEKVSVLVVGPGLGQAAWGRALLSAAANASLPQVWDADALNLLARGFVSLPKDCVITPHPGEAARLLGISTAEVQADRPAAALALSKKYTAVVVLKGAGSLIAHPDGRLALCHQGHPAMATAGLGDVLAGLIGALLAQGMDGFDAACLAVWLHASAGAQQGKFGRGLAASDLIPAIRQLLEEHAPCLK

SEQ ID NO: 24400 - protein, 252 aa, Salmonella typhi
MKTVTVKNLIIGEGMPKIIVSLMGRDINSVKAEALAYREATFDILEWRVDHFMDIASTQSVLTAARVIRDAMPDIPLLFTFRSAKEGGEQTITTQHYLTLNRAAIDSGLVDMIDLELFTGDADVKATVDYAHAHNVYVVMSNHDFHQTPSAEEMVSRLRKMQALGADIPKIAVMPQSKHDVLTLLTATLEMQQHYADRPVITMSMAKEGVISRLAGEVFGSAATFGAVKQASAPGQIAVNDLRSVLMILHNA

SEQ ID NO: 24401 - protein, 685 aa, Pisum sativum
MTTSFAAAALRDPKLQIPNYHGLRSSSAASSLSRNALSVPSSTRSSSLIRAVSTPAKSETATEKKRSKVEIFKEQSNFIRYPLNEDMLTDAPNLSEAATQLIKFHGSYQQYNRDERGSRTYSFMIRTKNPCGKVSNQLYLTMDDLADQFGIGTLRLTTRQTFQLHGVVKKDLKTVMGSIIRNMGSSLGACGDLNRNVLAPAAPIVSKDYLFAQETSENIAALLTPQSGFYYDVWVDGERFMSAEPPEVIQARNDNSHGTNFTDSPEPIYGTQFLPRKFKIAVTVPTDNSVDILTNDIGVVVVTGDGGEPQGFNLYVGGGMGRTHRMETTFPRLAEPLGYVPKEDILYAVKAIVVTQRENGRRDDRRYSRMKYLIDSWGIDKFRNVVEEYYGKKFEPFRSLPEWEFKSYLGWHQQGDGGLFCGLHVDNGRIAGKMKTALREVIEKYHLNVRLTPNQNLILTDIRAAWKRPITTILSQAGLLLPRYVDPLNITAMACPAFPLCPLAITEAERGIPSILKRIRDMFEKVGLKYNESVVVRITGCPNGCARPYMAELGLVGDGPNSYQIWLGGSSNQTSIARSFMDKVKPQDLEKVLEPLFYHWKQKRQSKESFGDFTVRLGFEKLKEFIEKWEGPAVPPTRHNLKLFTDKDTYEAMDGLAKLQNKNAHQLAMEVVRNYIASNLNGKGE

SEQ ID NO: 24402 - protein, 215 aa, Zea mays
GGDPAIHLPTCSLKKVAHAGCVNRIRSMTQKPHISATWGDTGHVQVWDLSSFLNSLAESGASAPKEDDIIHKHLPMKVFSGHKDEGYAIDWSPLVTGRLVSGDCNKCIHLWEPTSNNWNVDANPFVGHTASVEDLQWSPTEADIFASCSVDGTISIWDVRTGKKPSISVKAHKADVNVISWNRLASCMIASGCDDGSFSVRDLRSIETTNKAVFP

SEQ ID NO: 24403 - protein, 397 aa, Bacteroides fragilis YCH46
MNQLSDRLNSLSPSATLAMSQKSAELKAQGVDVINLSVGEPDFNTPDHIKEAAKKAVDDNFSRYSPVPGYPALRNAIVEKLKKENGLEYTAAQISCANGAKQSVCNTIMVLVNPGDEVIVPAPYWVSYPEMVKLAEGTPVIVTAGIEQDFKITPAQLEAAITPKTKALILCSPSNPTGSVYSKEELAGLAAVLAKYPQVIVVADEIYEHINYIGKHQSIAQFPEMKDRTVIVNGVSKAYAMTGWRIGFIAGPEWIVKACNKLQGQYTSGPCSVSQKAAEAAYTGSQAPVEEMRQAFERRRDLIVKLAKEVPGFEVNVPEGAFYLFPKCSSFFGKSAGDRKIENSDDLAMYLLEDAHVACVGGTSFGAPECIRMSYATSDENIVEAIRRIKEALAKLK

SEQ ID NO: 24404 - protein, 384 aa, Staphylococcus aureus subsp. aureus NCTC 8325
MKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCIFANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 24405 - protein, 508 aa, Ustilago maydis 521
MISGLLSRSSVGPARAFQASTLPRVVSTLPRVHSRGLATGADPYDVVVIGGGPGGYVAAIKAAQLGLKTACVEKRGALGGTCLNVGCIPSKAMLNNSHLYHQAQHDFKSRGIDVGSISLNLETMLKAKSSAVTGLTKGIEGLFKKNKVDYLKGAGSFSSPTTIKVALNDGGETEIEAKNIIIATGSEVTPFPGIEIDEKQIVSSTGALELQKVPEKMIVIGAGVIGLEMGSVWSRLGAKVEVVEFLSTVGGAGIDGEIAKNFKKTLEKQGLKFRLGTKVIDAEKKDGKVYLNVEDAKSGDKTQLDADVVLVAIGRRPVTSGLNLEAVGIEKDERGRIIVDDQYNTTCKGVKCIGDATFGPMLAHKAEEEGIAAVEIIKSGHGHVNYAAIPAVVYTHPEVAWVGKNEEELKKEGVEYKVGKFPFLANSRAKTNADSDGTVKFLVEKETDKVLGVHIIGPNAGEMIASAVLAIEYQASAEDIARTCHAHPTLSEAFKEAAMASYSKAIHF

SEQ ID NO: 24406 - protein, 187 aa, Hordeum vulgare subsp. vulgare
KYPYIAGMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDALLMGADYYETEADKKLLAEKGGIPIGIGKNSHIKRAIIDKNARIG

SEQ ID NO: 24407 - protein, 372 aa, Candida glabrata CBS 138
MSSEGQGQTEEISASDFVNQQKQLEDEARELMPWEPKQCTYELGSIRQPVFACRSHNQIGICYSCSILCHTSCDIVELFTKRHFTCDCGTERDTKPADEDGIHCQLRKNRSKDISSDSNEYRQNFKGLFCGCSTEYDPENPAVMLQCVLGTECGEDWFHDYCILGKTKEEADELRARKQPDAENDDELEDPLAGMPDLETFDAFVCWKCTSKYEQYFKRLLSHPLSETVIAKQLYRQCSEVKETDDGKRKHDEGSEDYSLFLKKDHESAFKKILKSSEADSKIRIFLTDLAPHLIKDEPVYEPPEEKEETLSIEALTRQIIQNAMDRHTAVEGLTAFHSLKDKLNSFLAPFAEAGQTVKEEDIVTFFSKSKH

SEQ ID NO: 24408 - protein, 185 aa, Hordeum vulgare
KYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNSYYDMNARIG

SEQ ID NO: 24409 - protein, 260 aa, Myxococcus xanthus DK 1622
MSRKVALITGASAGLGEQFAHLFAKDGHDVILVARSATRLEALAAKLEQAHGVKAHVFPADLGRPESPEQLFEAVRAKGLAVEFLVNNAGFGSCGPFLAQDLAREAEMVEVNCTALLKLSHLFARPMQERGSGRILNVASTAAFQPGPFMATYFATKAFVVSLSEALAHELKGTGVTVTCHCPGATHTEFTQRAGNGQTRLFQQPGVAKAEDVAAHAYAMMMRGRVLSIHGLLNWVGTLGVRFSPRVAVRALAASLNQQG

SEQ ID NO: 24410 - protein, 515 aa, Pyrobaculum aerophilum str. IM2
MPVIDVAKSDLERLTGLKYEEIAKLFEYIKGEIESDSGERLRIEVTHDRPDHFSAEGLAKTLKGIAEIEVGLPRISLGRSSIRLVAESITERPYIAMAVVRNVRLDEEAIKQMIQLQEKLHETYGRGRRKIAIGFYDVSKIKPPIYYRRISQEDEYIPLGFQKPVKVREMYELTEQGRRYSGLINRENPPALVDASGQIMVVIPVLGSECCKITEATRDVLIDVTGTDHRAVANALSILIYSLLERSGSKEVEIVEGGTGYSHEYVKIYVDERAVSEFLGVKIAHEDFIKYIKKARFDYQEGAVIIPPYRINVLSWVDVAEDVAIVMGYNQMPREVPEIPSAGRRHRTEVITLEVRKSMLSMGFTELNNYVLTDEAVAEVCSPARVANPISELYTTIRCSIITQLISAASALKRRETKIFEVGEVVREGRTVRALAFLISRDGATLTDGLSVVKSLCKRLGLKCEFFPAEAKWALPNRMAEVRGEITGYIAEVNPDVLTALKHAVPTVVAELYIG

SEQ ID NO: 24411 - protein, 128 aa, Magnaporthe grisea 70-15
MSDKTAVLTDKAPKPLPGIYSQAIKANGFVFVSGAVPMDPVSMQIIDGDIQAHTHQCIKNLTAILEEAGSSIEKVVKVNVFLSNMDDFAAMNEIYMQYWGEVKPCRTCVAVKTLPLNVDVEIECTALC

SEQ ID NO: 24412 - protein, 337 aa, Magnaporthe grisea 70-15
MSPSTESNPVPPYPLHPSVASRINPEYAAFYNAHIADKQQVHLQPIAASRSSGVLIPGAGPLLPVGSTQDYTIPRTASSGPDVRVRVFTPPGARPASGWPGCVYFHGGGWVLGTIDTENVVCSNLCARGGAVVVTVDYRLAPEDPFPAAVDDCWEAVRWVVARGPELLGLDLGRLATGGSSAGGNLAAVMCQRAAVVADHPPFRLQLLSVPVADNTATAETTPSWRENEHTPALPAPKMLWYRRHYLPRESDWAHPEASPLLWDGDWSRLPRAVIVCGELDVLRDEGVAFGDRLNKAGVRADVHVLEGQPHPFLAMDGVLEDGRRAITYFCEALKEL

SEQ ID NO: 24413 - protein, 354 aa, Kluyveromyces lactis NRRL Y-1140
MMMLSNTFKRAVPSVVQSMRFASTKTMTVREALNSAMAEEMDRDDDVFIIGEEVAQYNGAYKVTKGLLDRFGERRVVDTPITEMGFTGLAVGAALKGLKPIVEFMSFNFSMQAMDQVINSAAKTYYMSGGTQKCQIVFRGPNGSAVGVAAQHSQDYSAWYGSVPGMKVLVPYSAEDARGLLKAAIRDPNPVVFLENELLYGQSFEVSEESLSTDFTLPYKAKVEREGSDISIISYTRNVQFSLEAAEILSKQYGVSAEVINLRAIRPLDVEAIINTVKKTNHLITVESTFPAFGVGAEIIAQIMESEAFDYLDAPIQRVTGAEVPTPYAKELEDFAFPDPDTIVRAAKSVLSIE

SEQ ID NO: 24414 - protein, 429 aa, Bifidobacterium longum DJO10A
MFSGTELALVSLRGSQIEQMEQEDARGAKVAKIARDPNTFLSTVQIGVTLSGFLSASFGASSIAPYLIPAVESWGVHPGIAGGLVNIILTLIISYCSIVISEMVPKRIAMQRTEQIARAVVPAIDAFAAVCRPIIWLIGKNTNGIVRLLGFDPQQTESEVSDDELRVLVSSNTNLSKDERTILDDVFDASETIVAEVMRPRADVVFIEGDQPLAEAAAFVRDQPYSRYPVTGKDFDDVIGFVHVRDLLDVRDPNAKIVRDVVREGISLPGTSKLLPSLELLRKRGIHLAVVIDEYGGTDGIVTLEDMTEELVGDIRDEYDLPSEKGGERTTRTAFVNGVATIEASMTIEDFADLTGIELEDGPYETVAGYFLSKTGKMGAVGDVLHSDDGYNMVVTKVDGRRIETIEVRKAGAPDHAPLPAESQSDDAK

SEQ ID NO: 24415 - protein, 106 aa, Saccharum officinarum
MAEAHNGRRVGMVGDVRDAPAGHENDLEAIELARFAVAEHNSKTNAMLEFERLVKVRHQVVAGTMHHFTVQVKEAGGGKKLYEAKVWEKVWENFKQLQSFQPVGDA

SEQ ID NO: 24416 - protein, 199 aa, Zea mays
MAAAHHRPLHALLGGGAVADLLLWRRRNASAAAVAGATLVWFLFERAGYSLASVLSNALLLLVVILFFWAKSASLLNRPLPPLPNLEVSDGVVEKVVGRALVWINKVLAVAHDIAIKRDRTVFIQVIMALWVVSCIGMLFNFFTLIYIGVLLALLVPPVYERHQDVIDEKVGLAHSILSRQLSTVASKTGQPPKQKKAE

SEQ ID NO: 24417 - protein, 117 aa, Zea mays
  misc_feature (37)..(37): Xaa can be any naturally occurring amino acid
  unsure (1)..(117): unsure at all Xaa locations
DRTRPAFLDTIYAFVDLYKDQRITPAAGFEARGFIYXPPIALAITAKFVPLTKPIKLPRDVISEEYSLEYGTDKIYMHVGAVHANYRALVIDDLIPTGRTLCPPVKLIERVSSKVVK

SEQ ID NO: 24418 - protein, 319 aa, Brassica napus
  misc_feature (61)..(61): Xaa can be any naturally occurring amino acid
  unsure (1)..(319): unsure at all Xaa locations
MSKKKYFVLFLYGASKRKRIIYGASQLPLLLFKYLSERKKILNRRKFRQKFSKSNGDSPAXEVTMGFFRRLFGSKKQEKTIHTKNKSKKWSFTTRSSNPTSSSHPSKRRTDEEILDADKHAIAVAAATAAVAEAALAAAHAAAEVVRLTGRGGGRTSSVTQTNRNNRRLAQEYVAAVKIQSAFRGYLARRAFRAFPELVKLQALVKGHIVRKQTADMLRRMQTLVRLQARARASRSSHVSESLSEAEYIKLIAMDHHHNHRSQMGSSRWNAPLYNEDNDKILEVDTWKPHLPSYHKESPRKRGSLVVPTSVENSPQVRS

SEQ ID NO: 24419 - protein, 269 aa, Metarhizium anisopliae
MGHEDAVYLAKLAEQAERYEEMVENMKIVASEDRDLTVEERNLLSVAYKNVIGARRASWRIVTSIEQKEESKGNSSQVTLIKEYRQKIEAELAKICDDILDVLDKHLIPSAKSGESKVFYHKMKGDYHRYLAEFAIGDRRKDSADKSLEAYKAATEVAQTELPPTHPIRLGLALNFSVFYYEILNAPDQACHLAKQAFDDAIAELDTLSEESYKDSTLIMQLLRDNLTLWTSSEAETSGAAGQADAPAKEESGAAAEAPAAAEQTKASE

SEQ ID NO: 24420 - protein, 415 aa, Pseudomonas putida GB-1
MNAFNYRDGELFAEGVALSAIAERYGTPTYVYSRAHIEAQYRSYADALQGTEHLVCFAVKANSNLGVLNVLARLGAGFDIVSGGELERVLAAGGRADRVVFSGVGKTREDMRRALEVGVHCFNVESTDELERLQVVAAEMGKVAPVSLRVNPDVDAGTHPYISTGLKENKFGIAIADAEAIYVRAAQLPNLEVVGVDCHIGSQLTTVEPFLDALDRLLVLVDRLAECGIHLRHLDLGGGVGVRYRDEQPPLVADYIKAIRERVGERDLALVFEPGRYIVANAGVLLTRVEYLKHTEHKDFAIIDAAMNDLIRPALYQAWMGVSAVKPRAGEGRAYDLVGPICETGDFLGKDRVLNLAEGDLLAVASAGAYGFVMSSNYNTRGRCAEILVDGDQAFEVRRRETIAELYAGESLLPE

SEQ ID NO: 24421 - protein, 203 aa, Metarhizium anisopliae
MVNNRNYDFLIKLLLIGDSGVGKSCCLLRFSEDSFTPSFITTIGIDFKIRTIELDGKRVKLQIWDTAGQERFRTITTAYYRGAMGILLVYDVTDERSFNNIRTWFQNVEQHATEGVNRILIGNKCDWEDKRVVSTEQGQALADELGIPFLEVSAKSNINIDKAFYSLAADIKKRLIDSSKNDQATGTGVNVGDKTDAGGSKCC

SEQ ID NO: 24422 - protein, 415 aa, Ralstonia eutropha JMP134
MMPSSTVVIVGAGQAGLQAATSLRQAGFDGRIRLVGDEPCIPYERPPLSKSYLAGETGLDGLWLRPEMFYGKERIELELGQTATAIDRQTRQVELASGRKVAYDRLVLATGARFRPLSVPGAELDGVLPLRTLADADALRPRLAEAREVVVIGAGFIGLEFAAVARKAGVAVHIIEMTQRLMGRVVSEQTSRFYTRAHRDWGSAFLFGTGVARILGNRRVSGVETSDGRTLPADLVLIGIGVVPNTEIAAAAGLAIDNGIIVDQNLASTDPTIFAIGDCANYPSRFGRCRLESVQNAVDQGQAVAAAIVGESIPYDKVPWFWTDQADLKLQIAGITAGHDRSVLRGDPESRSFSVFFFRDGTLIGVESINRPADHVVARRLLLADPRLSPEQAVDPDFDLRAHAIRFSRRERAQT

SEQ ID NO: 24423 - protein, 508 aa, Glycine max
MDYHTTVLLLITFVSATIILIFIRRLFNQTSESEYAKLPPGPRPFPIIGNILELGTNPHIALTKLSKIYGSLMTFKLGRITTLVISSPQVAKEVLLENGQVLSSRTIPHSVHALDHHIYSTVWLPPSAQWRNLRRVCATKIFSPQLLDSTQILRQQKVKDLLDFVKERCKKGGVVDIGEVVFTTILNSISTTFFSMDLSDSTSEKSHEFMNIIRGIMEEIGRPNVADLFPILRPLDPQRVLARTTNYFKRLLKIIDEIIEERMPSRVSKSNHSKVCKDVLDSLLNDIEETGSLLSRNEMLHLFLDLLVAGVDTTSSTVEWIMAELLRNPDKLVKARKELSKAIGKDVTLEESQILKLPFLQAVVKETLRLHPPGPLLVPHKCDEMVNISGFNVPKNAQILVNVWAMGRDPTIWENPTIFMPERFLKCEIDFKGHDFKLIPFGAGKRICPGLPLAHRTMHLIVASLVHNFEWKLADGLIPEHMNMEEQYAITLKKVQPLRVQATPIKRD

SEQ ID NO: 24424 - protein, 306 aa, Caulobacter crescentus CB15
MKALSIPDVLAEVAVLVRPHFGKGKPADYIPQLATVPGGKFGMAVRMVDGDEHVIGDADEGFSVQSITKVFALGLALNRLGDEIWTRVGKEPSGTPFNHLSLLEAEQGVPRNPFINAGALAVTDVLMDVTRDPAALVRDFGGFLCGERLEIDPAVATSELAHAWQNRAIASLMRAKGTITHDPEAVVAAYCRQCALSMSCRQLARAFLPLAAGGFSPIAQETVFPERLTRRLNALLLTCGIYDSVGSFAYRVGLPAKSGVGGGIVAVVPGKATVAVWSPELDRFGTSVVGTAALEAFSQITNCSVL

SEQ ID NO: 24425 - protein, 417 aa, Methanocaldococcus jannaschii DSM 2661
MIMFLTLDDFNFEDKRVVLRVDINCPIDPNTGEILDDKRIREIKSTITELINKGAKVVILAHQSRPGKKDFTTLKNHAKVLSDVIGKEVEYIDEVIGSTAREAIINMKCGDVILLENVRFYSEEVLSDWKKWENITPKKQAETNLIKRLAPLFDYFVNDAFAAAHRAQPSLVGFSYYMPMIAGRLMEREVGVLSKVLENPEKPCVYVLGGAKADDSIRVMKNVLENGTADKVLTSGIVANIFLVAMGYDLGVNMDIIENLGLKSQIEIAKELLNKFEDKIVVPVDVALNINEERVEADLNKDEKVEHLINDIGEKTIELYSEIINEAKTIVANGPAGVFEKEAFAKGTEELLKAIANSKGFSVIGGGHLSAAAELFGIADKIDHVSTGGGATLDFLAGEKLPVIEMLKESYKKYKGQ

SEQ ID NO: 24426 - protein, 418 aa, Solanum tuberosum
MESGGALAGLHRNPTFHHLLRPPRTAVNNLLSSSSSTYKRHFSPLPLKFQKQSHFASYSYNCSINDGSTFQVAYSASATHSLANIDWDNLAFGVMPTDYMYSMKCSQDGNFSKGELQRFGNIELSPASGILNYGQGLFEGLKAYKRHDGNILLFRPEENALRMKMGAERICMPSPSVEQFVEAVKATVLANERWIPPPGKGSLYIRPLLMGSGAILGVAPAPEYTFLIYVSPVGNYFKEGMAPINLVIETEMHRATPGGTGGVKTIGNYAAVLKAQSAAKAKGYSDVLYLDSVNKRYLEEVPSCNGFIVKGNLIATPAIKGTILPGITRKSIIDVALSQGFQVEERQVSVDELLDADEVFCTGTAVVVSPVGSITHLGKRVSYGSDGVGRVSKQLYSTLTSLQMGLATDNMNWTVALK

SEQ ID NO: 24427 - protein, 377 aa, Solanum tuberosum
MEFVLQLQKQSHFTSYIDNSAINSGNSFRVASPASDVASELADIDWDNLGFGFMPTDYMYSMKCSQGENFSKGELQRFGNIELSPSAGILNYGQGLFEGLKAYRKHDGNILLFRPEENATRLKMGAERMCMPSPSVEQFVEAVKATVLANERWIPPPGKGSLYIRPLLMGSGAVLGLAPAPEYTFLIYVSPVGNYFKEGLAPINLVIETEMHRATPGGTGGVKTIGNYAAVLKAQSAAKAKGYSDVLYLDCVQKKYLEEVSSCNVFIVKGNLIVTPAIKGTILPGITRKSIIDVAISQGFQVEERQVSVDELLDADEVFCTGTAVVVSPVGSITHQGRRVTYGNDGVGLVSQQLYSALTSLQMGLSEDKMGWIVELK

SEQ ID NO: 24428 - protein, 665 aa, Oryza sativa (japonica cultivar-group)
MLQEMGKQVGAGKGIDWRALVRRTSTGITSAREYQMLWRHLAYGHEFVESVEPASLPLDDGSDLECEIEIVPAPGNETLAEATSFAKTIITGSSREQTSGQRVNSEAAALNTPNEKIVRVPSDKQLVPGHRLTNGTGPVSSSKQPSHTGSSPDPLDPNGHPKKKKKPKPWSREEDMELGAGVQKHGEGNWMEILHKYKFDSSRTHLQLQQRWALICKRQGSTKPATPKIPNVMSEELKAAQKAFSLAIGTTRSSTLRPGGVPHHNPMVTTTNPEVKSVTAPSPLPVPVHVVPVPVPVQPVQVQLPPPQLHQAPAQSAPPPPKVSNASNKSRNNSKKQVAQSIPVNGPLSIQEAALAAGGRIAEPSVATNFLKAAQSTKAVHIRSRGTGSSKSSTGSKTPTVAGEPGTQLGSDQHLELQSTGGPSQVLTAHATEQVHNVSEVAGVNPLGQSAGVHLSETKKALNTTPVSGSSDKMEIDDNSNYFAVTMEDLFPEDVKQEDVQDPKIEEAIDPKDADMLEFDRFVAQGCLNKDNVDKSKAAKIAPEAQSVIGSQKKQLKTLPTVGKSNPVFAGPPATAKKTKAPVPQGGMSSGIVGVLNRSLGGKAPAPATTGTQSTVQKQQSMSSKGNLLVPKNVAPGTVTPANNRANTAVNGASKVNPPASQKPA

SEQ ID NO: 24429 - protein, 3482 aa, Anabaena circinalis 90
MAQNTDYKKLIATTLTKMEAMQARITELETRQSEPIAVVGMGCRFPGGISSPEAYWNFCQAGLDAIVEVPQSRWDISKFYAPEPTPGKMNTRYGGFLQQDITEFDARFFSISSREATSMDPQHRLLLEVAWEALENANLPPTNLAGDRVGVFVGITSVDHAMTVYKSKYDEIDSFFGTGNSLSAAAGRLSYFLNLRGPCMSIDAACASSLVALHQAIRSLRNHECKIALVGGVNLILDPAITINLCQSGMMSPDGRCKTFDAAANGYVRGEGCGVLVLKRLSVAEKNGNRILALLRGSAVNHNGAAAGLTVPSGPAQQDLLRQALADARVKPQEVGYIEAHGTGTSLGDPIEMNAIAAVYGERSQPLYVGSVKTNIGHLEAAAGIAGTIKTILALQHGEIPSHLHFQEPNPLINWQGYPIKIPSQAIPWSNNGQVRIAGVSSFGFSGTNAHIIIEQAPAANIPEIKLQRPSHLLTISAHSETGLKELALRFHTRLESHPEMGDICHSAAIGRSSLPERLAIVADTLTELQQRLAAFAEEKNIDHGIFYRRFTGEKYPKIVFLFTGQGACYAGMGNQLYQTQPTFRQYIDQCADILGNYLEFPLQQILFGDRTDLLNQTAYAQPAIFALEYSLAMLWQSWGIKPSLLIGHSVGEYVAACIAGVFSLEAGLALIVKRGQLMQTAPLGKMASVFADEATVSALIQNYGNTVSIAAINHPQQIVISGESNSIDEIVANCKSQKIAVQLLSVNGAFHSPLMESILDDFEIAAREVSYHPPQILLVSGIDGQPLTTAPDASYWRQQSRQAVQYFQSLITALNKGYNLFLEVGPRPILAEQGRRYNDDAIWLSSLNRGLDNWQTMLSALAQLYINGVNFNAEKFNKDYGYRNIQLPNYPFQRKRFQFKSTVLSQSSLTKEVPLERELMETNMNLAKVANIKKNQQEIGNKLKSILALLLKEDENDIRDDETLLNLGADSIILTDFVRKIEEKFGVKVKIDQLFTDLQTIDEISIYLSDYIKQKPSNTSDETAINDILTKTSVQVSNSESELNNYLWVISQLQPIAVAYILKALEVLGKRLSIADTWTTEDLLQTLPIASKYHILVNRYLKTLEQTGIIQNQGNVWIVKSLPTPFSLPEAIENLQTICPAAKPELDMLQRCGENLAEVLKGNIDPLELIFPAGSVVHAESIYGNSPVSRLMNQRVSQAINSILNNFSSSDRPYQIIEVGGGTGATSEAIVNNLNLNHTTYFFTELSPVLLNKARQKFKNRHKFNFNQLDIEKSPVSQGLTAHSYHIVVAANVLHSTRNITETLNNIRELLIPGGYLVLLETVENNSWLDLTFGLTPGWWRFQDKELRLDTPLLSGESWCAALKRCGFVNADIYSQQNNISIYNGQELIIASTSPESAIDHQSKTVAVSIPTSGKEALMMAQLQSLKELKDIHEKTIIKQLEILQSAPVAPSNTPEVLLIQTETAPTPKISKTETTPPTQKISSPNLNPLALKLTESKSLTEQQQAFIQKLEIVYNQRTAKSKAYSQNSRKTMVDVKPTIDFRMALKEFQYPIVSESAQGAYFRDIDGNDYIDLAMGFGVNFFGHSPDFVLTEIQQQMQHGIGLGMQSNIAAETAALICEITGVERVAFSNTGTEAIMAAVRIARSRTKRQKIVIFAGSYHGTFDGILARAGEEAGTAEPLSLGTPSGMVEDVIVLTYGAEESLEIIAEQADNLAAVLVEPVQSRKPDLQPKEFIQKLRKLTQQKEIALIFDEIITGFRITPGGAQEWFEIEADIVVYGKAIGGGLPISMICGKADFLDTVDGGFWSYGDDSHPQTELTAYGGTFCRHPLALAACRAVLLHLREQGATLQETVNQLTNRLAIEVNQFFQETGIPIRIVHFGSLFRFESSGAYSIFLKPIELPLFYYLLNLKGVYTWEKRVCFLSTRHTNEDINKVVAAVKEAIIELRQAGFFANAKPPQTKKREASDRTEDEDARNNLNQQFPTSEAQRQLWLLAELDTTASASYNVTTSLELRGALDISSLQQAINEVVNRHEALRTKILEQGELQEVISSVTIDLPLINLMDEDNPEATALVLRTELSQKPFDLGVAPLFAAVLMRLAPEHYLLTLKTHHIVADGWSLGLILNELGKLYSAKIGVATESLSPPMQFRKYLALRQQEAQSPQMQAHRDFWLKTYEGEIPIFELPTDFPRPAVKTYTGGRESKIIAPQLWQNLQTVGRKNQATLFMTMFAAYTAFLRRISGHDDLVIGIPISGRQVEGSEKLVGFCSQFLPIRIQTDVTASFVTHLRHTKETLIAAFKHQTHALEELLAALQLQRDFSRSPLISVSFNLDPKLTLPEFEGLNVSLPPEPIGYTPFDLGFNFIEVNDALIIYCNYNTELFKPETIKQFLESFEILMQGVIKDANILLSELHLLTQVQQEELLAKLTGSTIELPQNSTIIDDFIAQVKSTPDAPALIVEEKTLTYRELNEKVNRLTNYLREKYNLGAGKAIALAIGRNQNLIIAILATFKTGAIYVPIDPQYPSSRIDFILKDSGCHLCLTESNFISQLPQEIEAICLDKIDNILTDFDINEPNFQPDTNQIAYILYTSGSTGNPKGVMGRHISILNVIRSLRLTFNLNKHPEWRYIFTAPVTHDPSFRNIFLPLTIGAALYMYEVQHIGHLVSFLQENKINVLHTTPSIYREILAVLAPEETIPTLKYISCGGEKLDRETAIALRKRFPAEIVSNVYGSTETCVGVSQYTIDDNLNTDVPLGQVFHNNRLFVLDEFNHPVPLHVIGEICVEGAALAVGYRNLPEITREKFQPNFLNSEKILFRTGDLGKQIAPGVIEFIGRKDNQVKVNGYRVDPGEIEYQISRYAEIEKAIVLPIEVNNQIQLSAYCQTDKDIKFSEIREFLAKYLPVYMIPSSFIFLKQFPLTKHGKFDLRSLIALKPTDQLTQVSYTAPRNTLESKLVHIWEKILTKHPIGIFDNFFEIGGHSLLLSRVVTHVHKELNVLVKLADFFKVPTILGLAALISKAQSNYQEPIPAITQQESYPMSHGQRRLWALEFLDHNHYAYGMPSAYQFNGDLNIAAFENAFKKLIERHEILRTTFTLINNEPRQIVNEQVDFAVNQIDLVDDENQAAKIAEAIRNNAKTTFDLESGLLLKINVLKLSQQSNIVLFNMHHIISDGWSAGVLIKDFLAHYHAYGKENVELPPPLRIHYKDYTSWQNQQLQTPKLQAQRDYWLPKLIPAPAPLDLPLDYTRPAVQSFSGSVVIWKPNQEFIKDFELLTKTQEASLFMGLLTLVKGFLFRYTEQNEITVGSPIAGRNHPDLEEQIGFYVNTLVLRDQITVDDSFATLLAKVKTTTIEAYDNQEYPFDKLVSDLNFKRDPSRNPLFDVVVVLQNNQNVDLAIDGIAVNTLEQELVTAKFDLEFIFVDEAELYLKLIYNTDIFANERISLMIKLLETLLEEVVKSPDTPLLHLCDHTDKACQEDNSLFATNFNF

SEQ ID NO: 24430 - protein, 481 aa, Ralstonia eutropha JMP134
MSRLYSNLIAGEFVEGANISRNINPSNTNDVVGEYAQGSVADVNKAVDAAKAAFPAWSRATSQERFDILRKASDEIIARKEELGRLLSREEGKTLAEGIGEVARAGQIFAFAAGECLRAGGEAIPSVRAGVGVEITREPVGIVGMITPWNFPIAIPAWKIAPALAWGNCVVIKPADLVPGSAWALVDIIQRAGLPKGVLNLVMGRGSVVGQALLEHKDVHAISFTGSVATGRKVAATCIASNPMKKVQIEMGGKNPLVVLDDADLNTAVEVAVNGAFFSTGQRCTASSRLVVQAGIHDRFVEACIERLKSIVVDDALKQGTQIGPVVDQSQIDQDLRYIQIAKDEGGKLVFGGELLKRATPGFYLQPALFTETTNAMRISREEVFGPVANIVRVRDYDEALALANDTEFGLSAGICTTSLKYATHFKRSSEAGMVMVNLPTAGVDYHVPFGGRKGSSYGSREQGTYAKEHYTTIKTAYTMA

SEQ ID NO: 24431 - protein, 219 aa, Xanthobacter autotrophicus Py2
MRAPLRNNLVMASSKRFHSGGQSREYAALVCASGTLWDPIIPELPGAEAFGGAIRHSVTSRSADEVQSRRVLVVGGGNSGADIACDVARTAASVSLSMRRGYWFVPKFIAGRPSDQFFRRRDGLPEWAHPPDAAALLKLLVGPHEAYGLETPDHPPFAAHPIMNTEVLHHMGHGRVCAGIAHGTTTTQKKHGIPAERMHSFFGASCRRASRRCFAEAFT

SEQ ID NO: 24432 - protein, 104 aa, Oryza sativa
MIIVRRIFYFREVVEHLHLISLLMLTEFDFMYDPAIFDFSFEFRLRVSLTKDGNLSLVSRIRNVNGKPFSFSFGYHTYLSVSDIRSGISPNILFVLQPLFVGAI

SEQ ID NO: 24433 - protein, 219 aa, Brassica napus
  misc_feature (162)..(162): Xaa can be any naturally occurring amino acid
  unsure (1)..(219): unsure at all Xaa locations
MYQREGRVYLSTFFAITYGIGFAAIVSTLTHVALFNGKGIWQQVRASATAKVDIHTRLMKKYKDIPSWWFYSMLAVSLALSLVLCTVMKDEIQMPWWGLLLASFMALIFTVPVSIITATTNQTPGLNIITEYLMGVLLPGRPIANVVFKTYGYISMSQAISXLNDFKLGHYMKIPPRSMFLVQFIGTIIAGTVNISVAWYLLTSVENICQKELLPPNSP

SEQ ID NO: 24434 - protein, 291 aa, Mycobacterium sp. JLS
MTSVHGKVVLITGGARGVGEELARRLHAKGAKLVLTDLDDGPLSALAADLGAERVLTVVADVCDLETMQSAAEQAVSRFGGIDIVIANAGIASYGSVLVVDPDAFRRVLDVNVVGVFNTVRAALPSVIERKGYILVVSSLAAFAAAPGMAPYDASKAGVEHFANALRLEVAHHGVTVGCAHMSWIDTPLVQDTKADLPSFRTMLDSLPGPLSKTTSVQKCGEVFVKGIERRRERIYCPGWVGLIRWAKPILTTRIGQASVLKTAPKVLPQMDAEVTALKRSLGARTHGLKK

SEQ ID NO: 24435 - protein, 449 aa, Ralstonia eutropha JMP134
MQTYDYDLFVIGAGSGGVRASRIAAGYGARVAVAEEYRTGGTCVIRGCVPKKLLMYASHFAQAVDDAAGFGWRAPTPVHDWASLIAAKNAEIARLEAIYVRMLQSAGVDAITGRAQIVGPHRVEVNGVIFTAKVILVASGSVPVEPAIQGAELMITSNEAFYLDTLPKRIAIIGGGYIACEFAGIFNGLGSDVTQLYRGQQILRGFDDELRNHLGAEVSKSGVDLRVAVDVAAVGKRGDGLVVHLTTGQAIEVDAVMAATGRRSNTSGMGLESAGVLLDESGAIKVDEYSATSNPDIYAVGDVTNRLNLTPVAIHEGHAFADTVFGGRKRASAHDNVPFAVFSQPQAASVGLTEAQARRRHAKVDVYSSAFRPMRTALSGRDERALVKLVVDASTDRVLGAHIVAADAAEIILGIAVAIKAKATKADFDATLGVHPTLAEEFVTLRNRR

SEQ ID NO: 24436 - protein, 476 aa, Acidovorax sp. JS42
MWIFVASTDYYRDQQCAHSLQEIAMSFAVIDPNPAAAVRTDAAWLEAHWMPFTGNRNFKAQPRMIVSGQGAYYTDAEGRKIFDGLSGLWCSGLGHGRTEVAQAIGRAAATLDYAPAFQFGHPASFALANKLKELTPAGLDYVFFTGSGSESADTSLKMARAYWRAKGQGTKTRLIGREKGYHGVNYGGISVGGIVGNRKLFGQGVEADHIPHTQPPAGTFQKGMAEDGGRALADKLLDVIALHDASNIAAVIVEPFSGSAGVVIPPKGYLERIREICTQNNILLIFDEVITGFGRCGTWTGAEAFGVTPDILNFAKQVTNGAQPLGGVIATKEIYDTFMAQGGPEYMLEFPHGYTYSAHPVACAAGNAVLDILQKEDMPGRVKALAPYFENAVHGLKGAKHVADIRNYGLAAGITISALPGEPAKRPYEIAMKCWEKGFYVRYGGDTIQLAPPFISTQAEIDRLVSALGDALHETA

SEQ ID NO: 24437 - protein, 1256 aa, Streptococcus pneumoniae R6
MRKTPSHTEKKMVYSIRSLKNGTGSVLIGASLVLLAMATPTISSDESTPTTNEPNNRNTTTLAQPLTDTAADSGKNESDISSPRNANASLEKTEEKPATEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWHLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDAKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDIFEDLEPNYYHFMDADGTPRTSFGGGRLGTTHHMTKRLLVDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGSVGIANPKGLEWTEKGLKLNALTATVLRVSQNGTSHESTAEEKPDSTPSKPEHQDPAPEARPDSTKPDAKVADAENKPSQATADSQAEQPAQEAQASSVKEAVQNESVENSSKKNIPATPDRQAELPNTGIKNENKLLFAGISLLALLGLGFLLKNKKEN

SEQ ID NO: 24438 - protein, 351 aa, Trichodesmium erythraeum IMS101
MTLLVAGDIGGTKTILQLVEVNREESKASVELRKLYENRYLSNDFPDLVPIVKKFLEEASEKLGEKQKPEKACFAIAGPVVNNIVKLTNLPWIIDAKLMENELGISQISLINDFEAVGYGILGLNTKDLETLQPGEPKSDTPIAVIGAGTGLGQCFLIRAAGVIKVYPTEGGHTDFKARSQLEFDLLKYLKKLHNIKRVSVERVVSGMGIVAIYQFLRDSLFATESPEIGDQIRQWEKEVGSNQITVDPGAVIGKAALEKSDPLCEQTLKMFIEAYGAEAGNLALKLLPYSGLYIAGGIAAKIIPLINSGSFMEAFKDKGRMKPLLEKIPVHVILNPHVGLIGAAIRASNL

SEQ ID NO: 24439 - protein, 463 aa, Methanocaldococcus jannaschii DSM 2661
MVNRKPNNPNKNGEEMRAIIIGSGAAGLTTASTIRKYNKDMEIVVITKEKEIAYSPCAIPYVIEGAIKSFDDIIMHTPEDYKRERNIDILTETTVIDVDSKNNKIKCVDKDGNEFEMNYDYLVLATGAEPFIPPIEGKDLDGVFKVRTIEDGRAILKYIEENGCKKVAVVGAGAIGLEMAYGLKCRGLDVLVVEMAPQVLPRFLDPDMAEIVQKYLEKEGIKVMLSKPLEKIVGKEKVEAVYVDGKLYDVDMVIMATGVRPNIELAKKAGCKIGKFAIEVNEKMQTSIPNIYAVGDCVEVIDFITGEKTLSPFGTAAVRQGKVAGKNIAGVEAKFYPVLNSAVSKIGDLEIGGTGLTAFSANLKRIPIVIGRAKALTRARYYPGGKEIEIKMIFNEDGKVVGCQIVGGERVAERIDAMSIAIFKKVSAEELANMEFCYAPPVSMVHEPLSLAAEDALKKLSNK

SEQ ID NO: 24440 - protein, 463 aa, Burkholderia xenovorans LB400
MSLFRKKSVEHMIAASAQNAGLKKALGALDLTFLGVGAIIGTGIFVLTGTGAVQAGPALMISFLIAALACGFAALAYAEFASTIPVAGSIYTYSYATLGELAAWIIGWDLMLEYGLATSAVSVGWSGYLQSLLSGFGVSLPVALTAAPGALPGHDTLFNLPAFLVMMAITALLSFGVRESARINNIMVAIKVIVVLLVICVGVFHVTPANWHPFMPNGWNGVFGAAAVMFFAFIGFDSVSSAAEEVKNPKRDLPIGIIASLGVCAVLYVAVAAVVTGIVPSAQFANISHPVSYALQVAGQKWVAGFIDLGAVLGMLTVILVMAYGQTRVIFAMSRDGLLPARLSRVHPRFATPFFTTWLVGIFFGLIGAVVPLNVLAELINIGTLAAFSMVSIAVLVLRKTHPELPRAFRCPGVPVVPVLAVASCLFLMINLQAVTWVAFVVWLLVGMVVYFGYSRRHSRLSS

SEQ ID NO: 24441 - protein, 448 aa, Xanthobacter autotrophicus Py2
MAEQYDLVVIGTGTAAMVAAMRVRAAGWSVAIIDYRPFGGTCALRGCDPKKMLVGGASALDHARRMRGNGVAGDVHIDWPELIAFKRTFTDPVPEKHEHRYDEKGIHTYRGHARFTGRNSLTVDGESLEARHVLIAAGAEPIRLGIPGEEYFATNEDFLAMERLPRRIVLVGGGYIASEFSHIAARAGVQVTILQRGKRMLGHFDPDLVGWLMDKFREIRVDVRLRTTVSAIEKDHAGFVVRASSEGGDATFDADLVVHSAGRAPALDALDLEAGGVAAEKGRLKLNEYLQSVSNAAVYAAGDAAQEGPPLTPVSSHDAKMVAANLLEGNRHRPDYRGVPSVAFTIPPIAAVGLSEEQARQQDLKFQTKSQKASDWFTARQAVEKTYGFKVMVEDDTGRIIGAHLVGPHADEVINLFALAIRHDLTADNLKTTMFAYPTGASDIGYML

SEQ ID NO: 24442 - protein, 501 aa, Aspergillus fumigatus
MDSAARPVSFPKSRWYAKSSKPKAPYKLPESVKPPQSEQPSSTPKPEYSAEQTEFDTKADPAGNAAPEASEATESKPQQPLPDLTQGIPSTLAAELEGRTKKSGQTSLNLTEDPSRFEDYTDDGRGDIPKDGYVSSLDRRRARMANLMYAFFLLAGAGGVAYLGRNWETEEEAKAHPDIPSGWSFSSWYNRMKARLSDITSYYKDPAFPKLLPDEDPNLRQPYTLVLSLEDLLVHSEWSREHGWRIAKRPGVDYFLRYLNQYYELVLFTSVPSMMADQVLRKLDPYRIIRWPLFREATRYKDGEYIKDLSYLNRDLSKVILIDTKEEHARLQPENAIILDKWLGDPKDKNLVALIPFLEYIAGMGVEDVRPVLKSFEGTSIPVEFAKRERIMREKFEKELEEERKRRPKRGVGSLASALGLKSTRTLDGEQSPSEGLAQGKMLWDQIRERGQKNYEMIEKEIRENGEKWLAEMAAEEEKARQEQMKMMKGSFTSMFGAGKQ

SEQ ID NO: 24443 - protein, 371 aa, Arabidopsis thaliana
MASDSSRKSSLKPSSRKSFLFPSVVIVIVGIIVALTYQSKLKPPQPKLCGSSSGPPITAPRIKLQDGRYLAYKEHGLPREKANRKIVFIHGSDCCRHDAVFATLLSPDLVEELGVYMVSFDRPGYCESDPHPSRTPRSLVSDIEELDDQLSLGSKFYVIGKSMGGQAAWGCLNLKYIPHRLAGVTLVAPVVNYYWRNLPLNVSTEGFNFQQKRDQWAVRVAHYAPWLIYWWNTQKWFPGSSIANRDSLLSQSDRDIISKRGYTRKPHWAEVRQQGIHESINRDMIVGFGNWEFDPLDLDNPFLNNEGFVHLWQGDEDMLVPVKLQRYLAHQLPWVHYHEVPRSGHFFHFTKGVVDNIVTTLLTTDTDTIRQ

SEQ ID NO: 24444 - protein, 496 aa, Pseudomonas fluorescens PfO-1
MVAALLDRLGVNPALYQNGKVPVHSPIDGSRIGAVNWEGPAEVEQHISRADHAFEQWRKVPAPRRGELVRQFGEVLREYKTELGELVSWEAGKITQEGLGEVQEMIDICDFAVGLSRQLYGLTIASERPGHHMRETWHPLGVVGVISAFNFPVAVWAWNTTLALVCGNPVVWKPSEKTPLTALACQALFERVLKNFSDAPAHLSQVIIGGRDAGEALVDDPRVALISATGSTRMGREVAPKVAARFARSILELGGNNAMILGPSADLDMAVRAILFSAVGTAGQRCTTLRRLIAHESVKEEIVTRLKAAYSKVRIGHPLEGNLIGPLIDKHSFENMQDALEQALSEGGRVFGGKRQLEDQFPNAYYVSPAIVEMPEQSDVVCSETFAPILYVVGYSDFEEALRLNNAVPQGLSSCIFTTDVREAEKFMSAVGSDCGIANVNIGPSGAEIGGAFGGEKETGGGRESGSDAWRAYMRRQTNTVNYSLELPLAQGITFD

SEQ ID NO: 24445 - protein, 379 aa, Anaplasma marginale str. St. Maries
MSGNDYYEILEVSRNASAEEIKKSYRKMVFKYHPDKNPGDKKAEEKFKKISEAYEVLSNPEKRAAYDRYGHSTFTSGGASGFDFTSGFSTDFSDIFQDFFGGGFGKSQRASSREHLRGSDLRYDVEVSLEDAFKGIKVPISYVTNVKCSSCSGIGSEGAVNSVKCGNCNGAGSVRTRKGFLTIEEVCNVCNGEGEVIKNKCRRCGGSGRVRNEVSLLVTVPKGIETGNKVRVNGKGEAGFRGAQEGDLYVYIRVKEHKFFTRRSSDLHCSVPIKMTIAALGGEIEMPSIDGSWTKLKIPEGTQSGDQIRMRGKGMPEVNSKDRRGDMYVHVTVETPVKLTKQQVDLLKKFEEESSANCSPKYQGFFQKIKDIWRDISSG

SEQ ID NO: 24446 - protein, 166 aa, Zea mays
  misc_feature (137)..(137): Xaa can be any naturally occurring amino acid
  unsure (1)..(166): unsure at all Xaa locations
GTRAARQAAADAPTAAVARVAHLVEQVQRHHLSPDANLLSSSVHSDLLTPREEGEAERALDLQALEAYTEAVDMAEEYHAAAGAGKKLNCYPQAYKPLEHRAAGADAQQRLKVPLLSHEGQVHEHEIEKLSTDSRRXVDSTLTSATPRSSSTLDEYTTIIAEALGP

SEQ ID NO: 24447 - protein, 101 aa, Arabidopsis thaliana
  misc_feature (35)..(35): Xaa can be any naturally occurring amino acid
  misc_feature (73)..(73): Xaa can be any naturally occurring amino acid
  unsure (1)..(101): unsure at all Xaa locations
SRDTLGGRILSSMLSSTGGATYPAHATMGAKYTGXKSSAFIPGTRKGNIDITGITITGGRDSLLKVGPPIAKXQAETLDHLPGLSGVEQNNEDDDPLHSKW

SEQ ID NO: 24448 - protein, 457 aa, Oryza sativa (japonica cultivar-group)
MPPVGEVAAAEARSGMVLGGGAAAAAVGGGEDAVVMQVAGAEGQDSVITINCPDQAGLGCDLCRTILEFGLRITRGDVSTDGQWCFVVFWVVPRTPSIKVRWANLKNRLMSMCPSNYPMTFYPEITQPGPSQFYLLKLFSADRKGLLHDVTHILSELELIIHRVKVSTTPDGRVIDLFFITDGMELLHTKERQEETCSMLIATLGPSISCEILLAEGFQQGFSSLPPTISEELFRLELADGDNCSRSICAEMKRVQKATINFDNTLSPAHTLLQINCADQKGLLYDILRTMKDCSIQVTYGRFWSDKKGFREVDLFIKQADGKKIIDPEKQDVLSSRLRSEMLHPLRVMIVNRGPDVELLVANPVELSGKGRPRVFYDATFALKALGICIFSAEIGRQAASERQWEVYRFLLDDSSEFPLSNSLVNRNRIVDRKELAICVTKERMTYPEYVIWSYIL

SEQ ID NO: 24449 - protein, 192 aa, Aspergillus oryzae
MTDLRSAEEITSQQYSSGLATVYFDIEHGNKPLGRVVLGLYGKTVPKTAENFRALATGEKGFGYEGSTFHRVIKEFMIQGGDFTRGDGTGGKSIYGEKFKDENFKIRHTKKGLLSMANAGKDTNGSQFFITTVATPWLDGRHVVFGEVLEGYEVVEAIENVPKVPGDKPQQVVKIVKSGELESEDKGSHEEL

SEQ ID NO: 24450 - protein, 199 aa, Solanum commersonii
MADQYEQNKPSVEETVGANVEATDRGLFDFIGKKEEEKTSHAHEEEAISSEFCEKVKVSEEEEHKEEKKEEKKLHRSSSISSSSSDEEEEIGEDGQIIKKKKKKGLKEMIKEKISGDHKEEVKTEDTSVPVEKYEETEEKKGFLDKIKEKLPGGGHKKTEEMRRHHHHHRLRWSMRRRGRRKRDFWTKLRRNYQDTTQN

SEQ ID NO: 24451 - protein, 207 aa, Neurospora crassa
MFSLRRLLLAATLFLGAMLLFAQSAEAAKGPKITHKVYFDIEQGDKPLGRIVMGLYGKTVPKTAENFRALATGEKGFGYEGSTFHRVIKQFMIQGGDFTKGDGTGGKSIYGDKFPDENFKLKHSKKGLLSMANAGKDTNGSQFFITTVITSWLDGKHVVFGEVLEGYDVVEKIENTKTGPRDAPAEPIKIAKSGELEVPPEGIHVEL

SEQ ID NO: 24452 - protein, 130 aa, Triticum aestivum
  misc_feature (13)..(13): Xaa can be any naturally occurring amino acid
  misc_feature (88)..(88): Xaa can be any naturally occurring amino acid
  misc_feature (100)..(100): Xaa can be any naturally occurring amino acid
  unsure (1)..(130): unsure at all Xaa locations
FRGRVGYATLVPXINFAMVDGGIYRSGFPADANFRFLKSLNLRSIVYLCPVPDPETNTGFLEKNGSKLHHFGIEGRKEPSVGIPDEKXREALKSCPICKXYSLVIHWMKGEHQTVCVVGCMKKLQKSVLS

SEQ ID NO: 24453 - protein, 214 aa, Cucumis sativus
DLGKHHQPKTFLDKVAYRVVKLLRIPTDIFFQRRYGCRAVMLETVAAVPGMVGGMLLHLKSLRKFQHSGGWIKALLEEAENERMHLMTMIELVQPKWYERLLVITVQGVFFNAFFVLYLMSPKLAHRIVGYLEEEAIHSYTEYLKDINEGKIENVPAPAIAIDYWRLPKDARLKDVITVIRADEAHHRDVNHFASDIHFQGKELRESAAPLGYH

SEQ ID NO: 24454 - protein, 379 aa, Thermobifida fusca YX
MARDYYEILGVRRDATQDEIKKAYRRLARELHPDVNPDPETQERFKEVAQAYEVLSNPEKRRMYDMGVDPFARGGAAGGGATGFGAGFPFDDLMNAFFGGSTGTRAARERMRRGRSIKVRVELDLEETAFGVTKDITFPTAVVCNTCQGEGTAQGTHPETCDMCGGRGEVSQVTRSFLGQVMTTRPCPQCAGQGTIIRNPCPDCAGEGRVRERVTRKVQIPAGVEDGTQIQLAGEGEVGPNGGPRGDIFLEIVERPHPIFERRGDDLHCTVTVPMTAAALGATLTIDTLDGPEEIDLRPGTNSGQVITLQSKGCHHLNAPGRGDLHIHVTVETPTRLDEEQEALLRKLAELRGEDRPPGKFSPGQGNFFSRIRDAFGAR

SEQ ID NO: 24455 - protein, 204 aa, Pseudomonas fluorescens PfO-1
MNTQPLRVGIGGPVGSGKTALTLALCLALRERYNLAVVTNDIYTREDADFLVRNEALAPERIIGVETGGCPHTAIREDASINLEAVDQLNRRFPGLDLILVESGGDNLSATFSPELSDLTIYVIDVSAGDKLPRKGGPGICKSDLLVINKIDLAPLVGASLEMMNSDTQRMRNGKPFVFSNQKTGQGLEEIIAFIERQGLLTAA

SEQ ID NO: 24456 - protein, 118 aa, Thermobifida fusca YX
MTDRRSDCLFCKIVAGEVPADIVREGERTIAFRDINPQAPTHVLIIPRDHYPDMASAGAAGIGLLDEIAREAGEIARAEGIADSGYRMVFNTGPGAGQTIFHVHGHLLGGRGLEWPPG

SEQ ID NO: 24457 - protein, 273 aa, Zea mays
MATVETSGTAIGSSGRWALHGKTALVTGGTRGIGRAVVEELAALGAAVHTCSRKAEELGERIKEWEARGFSVTGSVCDLSERDQRERLLREVADRFGGKLNILVNNVGTNIRKPTTEFTAEEYSFLMATNLESAYHLCQIAHPLLKLSGSGSIIFISSVAGAIGIFSGTIYAMTKGAINQLTKNLACEWAKDNIRANSVAPWYITTSLTEGILANKNFEEQVVSRTPLGRVGEPGEVSALVAFLCMPGSTYISGQTIAVDGGMTVNGFYPPKP

SEQ ID NO: 24458 - protein, 341 aa, Mycobacterium tuberculosis H37Rv
MNLGDLTNFVEKPLAAVSNIVNTPNSAGRYRPFYLRNLLDAVQGRNLNDAVKGKVVLITGGSSGIGAAAAKKIAEAGGTVVLVARTLENLENVANDIRAIRGNGGTAHVYPCDLSDMDAIAVMADQVLGDLGGVDILINNAGRSIRRSLELSYDRIHDYQRTMQLNYLGAVQLILKFIPGMRERHFGHIVNVSSVGVQTRAPRFGAYIASKAALDSLCDALQAETVHDNVRFTTVHMALVRTPMISPTTIYDKFPTLTPDQAAGVITDAIVHRPRRASSPFGQFAAVADAVNPAVMDRVRNRAFNMFGDSSAAKGSESQTDTSELDKRSETFVRATRGIHW

SEQ ID NO: 24459 - protein, 267 aa, Mycobacterium tuberculosis H37Rv
MSLPKPNNQTTVVITGASSGIGVELARGLAGRGFPLMLVARRRERLDELADQLRQEHCVGVEVLPLDLADTQARAQLADRLRSDAIAGLCNSAGFGTSGRFWELPFARESEEVVLNALALMELTHAALPGMVKRGAGAVLNIASIAGFQPIPYMAVYSATKAFVLTFSEAVQEELHGTGVSVTALCPGPVPTEWAEIASAERFSIPLAQVSPHDVAEAAIAGMLSGKRTVVPGIVPKFVSTSGRFAPRSLLLPAIRIGNRLRGGPSR

SEQ ID NO: 24460 - protein, 330 aa, Methanocaldococcus jannaschii DSM 2661
MKKGTDLLKKGFAKMVKHGVVMDVTNVEQAQIAEEAGAVAVMALERVPADIRAAGGVARMSDPALIEEIMDAVSIPVMAKCRIGHTTEALVLEAIGVDMIDESEVLTQADPFFHIYKKKFNVPFVCGARNLGEAVRRIWEGAAMIRTKGEAGTGNIVEAVRHMRLMNEAIAQLQRMTDEEVYGVAKFYANRYAELAKTVREGMGLPATVLENEPIYEGFTLAEIIDGLYEVLLEVKKLGRLPVVNFAAGGVATPADAALMMQLGSDGVFVGSGIFKSENPLERARAIVEATYNYDKPDIVAEVSKNLGEAMKGIDITQISEAEKMQYRGD

SEQ ID NO: 24461 - protein, 327 aa, Gloeobacter violaceus PCC 7421
MKAFVLAAGKGTRLRPFTDDIPKPLVPVLNRPVMARVLDLCRTHGFDEVVANLHYKGEKISRHFEDGSQYGVRLDYSWEKELMGTAGGVRRQAEFLGDGTFLVISGDVVTDLDITRLVHFHKAHGAIATMAVKEVGDPSRFGIVVTDAAGQIQSFQEKPAAGTERSNLANTGIYVFEPEVFDWIPEGQFYDFGKDLFPALVEKGAPVFAMGTGDYWSDVGTLGQYLYTHWDLLCHPHLKQRIGKGTVIEPGAILSSHALIGENCHIERGAVVMGYSCIGDGCVVRSGATVFDSIVWAAEQISLTVADELVRSIYGDDKQVALGVPTL

SEQ ID NO: 24462 - protein, 369 aa, Candida albicans
MTATPVYFDISCNGKPKGRVVFKLYDDVVPKTAANFRSLCTGDKGISPKSGKPLSYKDSIFHRVIKDFMCQGGDFTAPSDHLGTGGESIYGEKFEDENFKLNHNKPFLLSMANSGPNTNGSQFFITTVPTPHLDGKHVVFGEVIEGKSIVRQLERSEKGANDRPVEDWKIADCGELPANYEPVASGADDGTGDTYEEILTDNDTIDINNPQSVFAAVSKIKDIGTKLLKEGKLEKSYEKYTKANSYLNDYFPEGLSPEDLSTLHGLKLSCYLNAALVALKLKHGKDAIAAANNALEVEQIDDKSKTKALYRKGMGYILVKDEEQAQKILEEALELEPNDAAIQKGLQEAKHNIKLRRDKQKKAMAKFFS

SEQ ID NO: 24463 - protein, 333 aa, Prochlorococcus marinus str. MIT 9312
MKSILEQLSSMTVVVADTGDLDSIKKFQPRDATTNPSLILAAAKNPDYVKLIDKAIESSENTLPNGFSEIELIKETVDQVSVFFGKEILKIISGRVSTEVDARLSFDTEATVKKARKLINLYKNFGIEKERILIKIAATWEGIKAAEILEKEGIKCNLTLLFNFCQAVTCANANITLISPFVGRILDWHKAKTGKTSFIGAEDPGVISVTQIYKYFKEKGFKTEVMGASFRNLDEIKELAGCDLLTIAPKFLEELKREKGVLIRKLDASTKINNSIDYKFEEKDFRLSMLEDQMASEKLSEGITGFSKAIEELEELLIERLSEMKNHKLISAN

SEQ ID NO: 24464 - protein, 359 aa, Gloeobacter violaceus PCC 7421
MSPYRVTLIRGDGIGPEVTQAARIVLDATGIDFEWVVVDAGAEVMEKSGTPLPAPVIEAVRASDAAIKGPITTPAGSGIRSVNVALRRALDLYANLRPARTLPGVHSRYDNIDLVVVRENTEDLYSGIEFEKNSPQALEVIEMLMRLGGKKIFPRSGLAVKPISSEASERIARFAFEYARRHARRKVTAVHKANILKHTDGLFLEAARQVASEYPDVEFEDRIVDNLCMQLVQRPESYDVLVLPNLYGDIVSDLTAGLVGGLGVAPGANIGDRSAVFEAIHGSAPRYAGQNKVNPSALILSGALLLRHLGEQEAAVRVEQAVAAVIAEGRSVTYDLAPAGATPAGTRQMAEAIAQKVAG

SEQ ID NO: 24465 - protein, 452 aa, Pseudomonas putida GB-1
MSNNLDQLTDWLKEHKITEVECMISDLTGITRGKISPTNKFIAEKGMRLPESVLLQTVTGDYVDDDIYYELLDPADIDMICRPDENAVFLVPWAIEPTAQVIHDTYDKKGNPVELSPRNVLKKVLQLYADKGWQPIVAPEMEFYLTKRSEDPDFPLQPPVGRSGRPETGRQSFSIEAANEFDPLFEDVYDWCELQQLDLDTLIHEDGTAQMEINFRHGDALHLADQILVFKRTMREAALKHNVAATFMAKPMTGEPGSAMHLHQSVVDVATGKNIFSNEDGSMSALFLNHIGGLQKFIPEALPLFAPNVNSFRRFLPDTSAPVNVEWGEENRTVGLRVPDAGPQSRRVENRLPGADANPYLAIAASLLCGYIGMVEGIEASAPVQGRGYERRNLRLPLTIEDALERMENSRALVQYLGKKFITGYVATKRAEHENFKRVISSWEREFLLFAV

SEQ ID NO: 24466 - protein, 421 aa, Oryza sativa (japonica cultivar-group)
MAFLGNGYCSSGSEGEDEDEGMEGYRKGGYHAARPGDRFAGGRFVAQRKLGWGNFSTVWLAYDTLLNRFVALKIQKSARDYAQAALHEIELLSAIAKGDPTNSKNVVQLLDHFKHAGPNGHHVCLVTEFLGDSLLRLIRYNRNKGIGLSGVKEICRSVLVGLDYLHRELGIIHTDLKPENVLLVSTINPSKDPVRSGFTPILERTVSNQYSGSVISFSEKMLKMRARRAVAKISLRRESLGGVAAEMEKERSLDGISLKCKIVDFGNACWGSQQLAGEIQTRQYRAPEVIIGAGYSYSADMWSFACMAFELATGEVLFAPKTCQGCSEDEDHLALMMETLGKMPKKIASSGTRSKDYFDRHGDLKRIRRLKFWPLERLLVQRYNFTEPDAQGLADFLRPILDFTPENRPTAAACLKNPWLN

SEQ ID NO: 24467 - protein, 453 aa, Pseudomonas putida GB-1
MSVNNPQTREWQTLSGEHHLAPFSDYKQLKEKGPRIITKAQGVHLWDSEGHKILDGMAGLWCVAVGYGREELVQAAEKQMRELPYYNLFFQTAHPPALELAKAITDVAPQGMTHVFFTGSGSEGNDTVLRMVRHYWALKGKPHKQTIIGRINGYHGSTFAGACLGGMSGMHEQGGLPIPGIVHIPQPYWFGEGGDMTPDAFGVWAAEQLEKKILEVGEDNVAAFIAEPIQGAGGVIIPPETYWPKVKEILAKYDILFVADEVICGFGRTGEWFGSDYYDLKPDLMTIAKGLTSGYIPMGGVIVRDTVAKVISEGGDFNHGFTYSGHPVAAAVGLENLRILRDEKIVEKARTEAAPYLQKRLRELQDHPLVGEVRGLGMLGAIELVKDKATRSRYEGKGVGMICRTFCFDNGLIMRAVGDTMIIAPPLVISHAEIDELVEKARKCLDLTLEAIN

SEQ ID NO: 24468 - protein, 167 aa, Zea mays
EEKFNQRAESLAFRIEEELFKLFAGARPRYKEKGRSLLFNLKDKSNPELRERVSSGDIAPERLCSMTAEELASKELSEWRLAKAEEFAQMVVLPNMEVDPRSLVRKTHKGEFQVEVEEPDGTEMHIYNESNNLEDPSRVFGGGDNESNNSEEPDPRPAVEMEDLNQG

SEQ ID NO: 24469 - protein, 561 aa, Oryza sativa (japonica cultivar-group)
MELSSLAALLHSPLLLAVLLLVFSWLIVSSTKKRPPPPCGDGGRRLPLPPSPPGVPLLGHLPLLGTLPHRKLRSMAEAHGPVMLLRLGRVPAVVASSAAAAEEVMRTRDLAFASRPRVRMSERLFYGRDMAFAPYGEFWRQARRVTVLHLLSPRRVLSFRGVREQEVAALLDRVRRRCGGGGETVNLSDLLMSYAHGVISRAAFGHGGAHGFDGDEGGEKLRKLFADFEGLLGTMTVGEFVPWLAWVDKLTGLDAKVARTSAAMDGLLERVIADHRERRRSRGQAVGDGEADADHRDFVDVMLDVSEAEEGAGAGAGGVLFDTVAIKAVILDMMAAGTDSSFTTTEWVMAELINHPRVMRKLQDEIRAVVGTSSASAAAAATGGGQVTEDHLGELPFLRAVIKEMLRLHAPGPLLLPRETVEDTELLGYRIPARTRVIINVWAIGRDAAAWGDSAEEFVPERWLDGGGGGGVEYAQQLGKDSRFVPFGAGRRGCPGAGFAALSVELALANLLYHFDWELPPPAASGIMATTRLDMDELFGLSVRLKADLNLVAKPWSPGAS

SEQ ID NO: 24470 - protein, 271 aa, Symbiobacterium thermophilum IAM 14863
MVRCMREVGRPMDLAANANTILLGLLASLLAGLATVIGALPTLFTRSISPRIQDGLLGMAAGVMLAATIFSLLIPAMEYGGGGLRGALVAAVGLFVGGAFLDLIDRYSPHQHFIKGPEGGGATSSLQRIWLFIIAITIHNFPEGLAVGVGVGSGDLGSGLSLAMGIGLQNIPEGMAVALALLSERYALREVFLITLLTGLVEPVGGLLGVAAVTLMHPILPWALAFAGGAMLFVISDEIIPETHERGNERTATYMLLLGFVIMMLLDTTLG

SEQ ID NO: 24471 - protein, 430 aa, Staphylococcus aureus subsp. aureus NCTC 8325
MAFEFRLPDIGEGIHEGEIVKWFVKAGDTIEEDDVLAEVQNDKSVVEIPSPASGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 24472 - protein, 468 aa, Staphylococcus aureus subsp. aureus NCTC 8325
MVVGDFPIETDTIVIGAGPGGYVAAIRAAQLGQKVTIVEKGNLGGVCLNVGCIPSKALLHASHRFVEAQHSENLGVIAESVSLNFQKVQEFKSSVVNKLTGGVESLLKGNKVNIVKGEAYFVDNNSLRVMDEKSAQTYNFKNAIIATGSRPIEIPNFKFGKRVIDSTGALNLQEVPGKLVVVGGGYIGSELGTAFANFGSEVTILEGAKDILGGFEKQMTQPVKKGMKEKGVEIVTEAMAKSAEETDNGVKVTYEAKGEEKTIEADYVLVTVGRRPNTDELGLEELGVKFADRGLLEVDKQSRTSISNIYAIGDIVPGLPLAHKASYEAKVAAEAIDGQAAEVDYIGMPAVCFTEPELATVGYSEAQAKEEGLAIKASKFPYAANGRALSLDDTNGFVKLITLKEDDTLIGAQVVGTGASDIISELGLAIEAGMNAEDIALTIHAHPTLGEMTMEAAEKAIGYPIHTM

SEQ ID NO: 24473 - protein, 294 aa, Glycine max
MDQYEKVEKIGEGTYGVVYKARDRATNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEDTWPGVTSLPDFKSTFPKWPSKDLANVVPNLDAAGLNLLSSMLCLDPSKRITARSAVEHEYFKDIKFVP

SEQ ID NO: 24474 - protein, 251 aa, Triticum aestivum
  misc_feature (167)..(167): Xaa can be any naturally occurring amino acid
  misc_feature (170)..(170): Xaa can be any naturally occurring amino acid
  misc_feature (196)..(196): Xaa can be any naturally occurring amino acid
  misc_feature (216)..(216): Xaa can be any naturally occurring amino acid
  unsure (1)..(251): unsure at all Xaa locations
MVKLAFGSFGDSFSATSVRSYVAEFIATLLFVFAGVGSAISYGQLTQGGALDPAGLVAIAIAHAFALFVGVAMAANISGGHLNPAVTFGLAVGGHVTILTGLFYWVAQLLGATVACLLLQFVTHGQPMPTHAVSGISEVEGVVMEIVITFALVYTVYATAADPKKGXLGXIAPMAIGFIVGRPTSSPPGPFSGGSXMNPARSFGPAVAAGNFSGHXWVYWVGPLIGGGLAGLVYGDVFIASYQPVGHQDYP

SEQ ID NO: 24475 - protein, 385 aa, Anaplasma marginale str. St. Maries
MKSIKTLPWVQNSSVRGCRVLLRVDFNVPVEHGQVRDRTRIERVAPTVDYLVKAGAKVIMVSHFGRPSCVDADFSLEPLVGTISEVLGVPVTFVGDCFGERVCTVVNALPWGSVVLLENLRFHAGEEKNDPAFAKQLASMADLYVNDAFSCAHRLHASIDAITKFLPAAAGLNLQDELHYLGNIVSEHPVAAVIGGAKTSSKIPMLRNLAQKVDFLVLGGGLSNSFLRASGHKIGSSVYEPCDDAVHAVLESARKSNCCVIVPRDHVVARNLDCSAQTKQNKDVGEEDCIFDIGTQTSAEVAEVLGKCKTVFWNGPMGVFERAAFATGTSDLIRNLVCLKKEKGVSTIVGGGDSIFAIKASGYSAEDFSYVSTGGGALLQFLSVA

SEQ ID NO: 24476 - protein, 332 aa, Prochlorococcus marinus str. MIT 9312
MKKKKVICIGEALIDRIRNKSNQGFTDFLGGAPANVACALRKLKIDSTFIGSLGSDDYGKKFITQFSELDVNLDFLQLDNDSSTRVVNVDRDQFGDRFFSGFEESSHSCFADEVLSKKLIEKEILNLEKSLLETQYLVTGTILLSSPISAETIFFLLEQAKKFEVKIVIDLNWREVFWDHSSFSSEISKSAKVKLIKNFLNNANVLKLAKEEATLFFEDENPFRISQQLSNRPDVIITDGKNPVAWYINGLQGITETPTSQKIVDTTGAGDAFLAGLISKLISSGYPSNELEIEDCIKFAGVCGLLTCLGEGAIEQQPYYEKVKKFLGSLIS

SEQ ID NO: 24477 - protein, 166 aa, Sinapis alba
MASPDVEYRCFVGGLAWATDDRALETAFSQYGEVLDSKIINDRETGRSRGFGFVTFKDEKSMKDAIEGMNGQDLDGRSITVNEAQSRGSGGGGGGRGGGGGYRSGGGGGYGGGGGGYGGGGREGGYSGGGGGYSSRGGGGGGYGGGGRRDGGEGGGYGGSGGGGGW

SEQ ID NO: 24478 - protein, 169 aa, Sinapis alba
MASPDVEYRCFVGGLAWATDERSLETAFSQFGELVDSKIINDRETGRSRGFGFVTFKDEKSMKDAIEGMNGQDLDGRSITVNEAQSRGSGAGGGGRGGGGGYRGGGGYGGGGGGYGGGRREGGGYSGGGGGYSSRGGGGGGYGGGGRRDGGGYGGGEGGGYGGGGGGGW

SEQ ID NO: 24479 - protein, 268 aa, Oryza sativa (japonica cultivar-group)
MEPLPLGFGDGLDATLLSSLWAFQDDLQPQESMEELKQSLMATTLELDAAKEELKKKEQSIAKLADLVRHVAKERDDARDQLQRLLAAAAAKPPPLVTSSVTDSDGGSLVSSPAADNPFFDPVTSSDKRCCAIASPPPAAKQQHAAAAGADAVLDMLAMKKPLPQRGRLLQSVMEAGPLLQNLLVAGLLPRWRNPPPVALDTLPVGVRAGGAVYPGASLSPGITSSAAVIGYGGGANACGKRPMAAAAAAVAASCSPAAFSAKRHRLH

SEQ ID NO: 24480 - protein, 171 aa, Triticum aestivum
  misc_feature (71)..(71): Xaa can be any naturally occurring amino acid
  unsure (1)..(171): unsure at all Xaa locations
SLQLHSTAAGARSVLLPCPRLRTENGLDHDELNVCSAPTIQDMVLLHHEVEVEYPDGRPTEKHQATQLEFXKIENSRLTTAMAFTVGVLAAIGALFLLQNKVQRKGVIRPLEPEIYIPGECRSKLTILVLPSSPCSSTPLQRKPGPCCFLSLTPALRSSGLTALLTERGEK

SEQ ID NO: 24481 - protein, 686 aa, Zea mays
  misc_feature (66)..(66): Xaa can be any naturally occurring amino acid
  misc_feature (82)..(82): Xaa can be any naturally occurring amino acid
  unsure (1)..(686): unsure at all Xaa locations
SRRHRVVRAAAVETLQGKAATGELLEKSVNTIRFLAIDAVEKANSGHPGLPMGCAPMGHVLYDEVXMRYNPKNPYWFNRDRXFVLSAGHGCMLQYALLHLAGYDSVKEEDLKQFRQWGSRTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVPEDVKSHWSRHTPEGAALEADWNAKFAEYEKKYADDAATLKSIITGELPTGWVDALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVMGTGSELEIAAKAADELRKEGKTVRVVSFVSWELFDEQSDEYKESVLPAAVTARISIEAGSTLGWQKYVGAQGKAIGIDKFGASAPAGTIYKEYGITVESIIAAAKSF

SEQ ID NO: 24482 - protein, 608 aa, Triticum aestivum
  misc_feature (197)..(197): Xaa can be any naturally occurring amino acid
  misc_feature (573)..(573): Xaa can be any naturally occurring amino acid
  unsure (1)..(608): unsure at all Xaa locations
MAMDDVAFAAGSSSSAMDALAASSSAAAPADPSHGWQKVTYAKRSSRKPAAVAPAAPDLGGKPGGVFEGLDKRSQERHRAIQAARDAAAVYDSDDANANARVPWGSRSSDEGSDSDGAAAKDRPQAEAPKKPKKPKVKKPKVTVADAAALIDAESLAAHLVDISASYENQEGIQLMRFADYFGRAFANVSAAQFPWXAKMFKESPMPKMVDVPLSHVPEPVCKTASDWISQRSPDALGEFVLWCIDSIMSELSGPTVGPKGAKKVVQQTPKAQVAIFVVLALTLRRKPDVLINLSPKIVGNSKYLGQEKLPIIAWVINQASQGDLVSGMFCWSHSLFPSVCAKSSVNPQSRDLVLQLLERFVSTPNASKARAMLLNGAVRKGERLVPAGTLDLFMRCTFPVPNARVKATERFEAAYPIIKELALVGTPGSKAVKQASQQLLPLAVKAMQENNAELAKEATDVFIWCLTQSPESYKLWDKLHAENIQASVAVLRKITADWKTLSPKLNSEALKATLKSLKAKNEAALEEAEDSGEKASIKEADKYCKAIIGRLSRGATCLKGSLLVIALAAGAXGFMLSPNLDLTADLEKLQAMALELQAMASEYLRSF

SEQ ID NO: 24483 - protein, 370 aa, Methanocaldococcus jannaschii DSM 2661
MLSKRLLNFESFEVMDILALAQKLESEGKKVIHLEIGEPDFNTPKPIVDEGIKSLKEGKTHYTDSRGILELREKISELYKDKYKADIIPDNIIITGGSSLGLFFALSSIIDDGDEVLIQNPCYPCYKNFIRFLGAKPVFCDFTVESLEEALSDKTKAIIINSPSNPLGEVIDREIYEFAYENIPYIISDEIYNGLVYEGKCYSAIEFDENLEKTILINGFSKLYAMTGWRIGYVISNDEIIEAILKLQQNLFISAPTISQYAALKAFEKETEREINSMIKEFDRRRRLVLKYVKDFGWEVNNPIGAYYVFPNIGEDGREFAYKLLKEKFVALTPGIGFGSKGKNYIRISYANSYENIKEGLERIKEFLNK

SEQ ID NO: 24484 - protein, 288 aa, Brassica napus
MSFNKVPNVPGSPALSALLKVSVIGGLGVYAITNSLYNVEGGHRAVMFNRLTGIKEKVYPEGTHFMLPWFERPIIYDVRARPYLVESSTGSHDLQTIKIGLRVLTRPMGDRLPHIYRTLGENYSERVLPSIIHETLKAVVAQYNASQLITQREAVSREIRKILTERASNFDIALDDVSITTLTFGKEFTAAIEAKQVAAQEAERAKFIVEKAEQDKRSAVIRAEGEAKSAQLIGQAIANNQAFITLRKIEAAREIAQTIAQSANKVYLSSNDLLLNLQGMNLEPSPKK

SEQ ID NO: 24485 - protein, 181 aa, Aspergillus fumigatus
MEDIHSGPATNTNPIVFFDIALGGVPLGRIKMELFADVTPRTAENFRRFCTGESKNSQGKPQGYKNSKFHRVIKDFMIQGGDFVNGDGTGSCTIYGTPKFADENFVLKHDRAGVLSMANSGPNTNGCQFFITTTATPFLNGKHVVFGQVVDGMDIVRMIENTRTIRDKPSQDVIITQCGEM

SEQ ID NO: 24486 - protein, 529 aa, Oryza sativa (japonica cultivar-group)
MAVSLVVVVVVVIAIVVPLLYLVLLPAWKPARRDDGDGGMRRRLPPSPPWGLPLLGHLHLLGALPHRALRSLAAAHGPVLLLRLGRVPVVVVSSAAAAEEVMRTRDLEFASRPRVAMAERLLYGGRDVAFAPYGEYWRQTRRICVVHLLSARRVLSFRRVREEEAAALVARVRAAGGAVDLVEHLTAYSNTVVSRAVFGDESARGLYGDVDRGRVLRKLFDDFVELLGQEPMGELLPWLGWVDALNGMEVKVQRTFEALDGILEKVIDDHRRRRREVGRQMDDGGGGDHRDFVDVLLDVNETDMDAGVQLGTIEIKAIILDMFAAGTDTTTTVIEWAMAELITHPDAMRNAQDEIKAVVGITSHITEDHLDRLPYLKAVLKETLRLHPPLPLLVPHEPSSDTKILGYSIPACTRIVINAWTIGRDQATWGEHAEEFIPERFLESGLDYIGQDFVLVPFGAGRRGCPGVGFAVQAMEMALASLLYNFDWETRVVDRRSEFGTSSLDMSEMNGLSVRLKYGLPLIAISRFP

SEQ ID NO: 24487 - protein, 386 aa, Oryza sativa (indica cultivar-group)
MGEEEKKEAAKAKEEEKPKQEEKPKEQEEGKKEEKPKEEGEKGKDGGGGEEKKDGEALAGGGRSNRRRRRTHDVVMRVYMHCEGCARKVRKILKGFDGVEDVIADSKAHKVLVKGKKAAADPMKVVERVQKKTGRKVELLSPMPPPPEEKKEEEKKEEPEPPKPEEKKEPPVIAVVLKVHMHCEACAQGIRKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPSYPPPYQPSYPPYPSHPSHHPSQIFSDENPNACSVM

SEQ ID NO: 24488 - protein, 101 aa, Streptococcus thermophilus
TKQAEGLGIPLKSVDDIDSIDVTVDGADEVDPQLNGIKGGGGALLMEKIVATPTKKYIWVVDESKMVDQLGAFKLPVELFNMALIACISTLNLRAISHHSE

SEQ ID NO: 24489 - protein, 156 aa, Ustilago maydis
TPAGRLKCELFSDIVPRTSENFRQLCTGEFRPNHVPEGYKNSIFHRIIKDFMCQGGDFINADGTGSRSIYGDKFDDENFTLKHDKAGLLSMANSGPGTNGCQFFITAQPCPFLDGKHVVFGKVVDGLLTLRKMENVPTGANNRPKMAVRITQCGEM

SEQ ID NO: 24490 - protein, 263 aa, Triticum aestivum
  misc_feature (223)..(223): Xaa can be any naturally occurring amino acid
  unsure (1)..(263): unsure at all Xaa locations
HEGTEKFMDIKCRYSGLTPQCAIIVATIRALKMHGGGPDVVAGKPLDHAYVSENVALVEAGCVNLAKHISNTKGYGVNVVVAINKFATDTDAEMEVVKKAAMAAGAFDAVVCSHHAHGGKGAVDLGVAVQRACESQAEPLKFLYPLDSSIKEKIESIAKFYGASGVEYSEQAEKQIEMYTKQGFSNLPICMAKTQYSFSHVPSMKGAPSGFVLPIRDVRASIXGAGFIYPLVGTMSTMPGLPTRPCFYEIDIDTATGKVMGLS

SEQ ID NO: 24491 - protein, 891 aa, Thermobifida fusca YX
MPKYVYDFTEGNKDLKDLLGGKGANLAEMTNLGLPVPPGFTITTEACRHYLEHGTMPPGLDAQIEEKLAALEATMGKRLGQPDNPLLVSVRSGAKFSMPGMMETVLNIGLNDESVKGLAAQSGNERFAWDSYRRLIQMFGKTVLGIDGDLFEDAIDDLKARKGVTSDLDLDAADLAGLVDTFKTIVREATDAEFPTDPREQMRLAIEAVFKSWNAPRAVLYRRQERIPSDLGTAVNICSMVFGNLGMDSGTGVAFTRDPATGQQGVYGDYLQNAQGEDVVAGIRNTIPLTELERIDPKSYAELLEIMEKLERHYRDLCDIEFTIERGKLWMLQTRVGKRTAAAAFRIANQLVDQGLITLEEAVNRVSGEQLAQLMFPRFDEKAERDLLGRGMNASPGAAVGRAVFDSATAVAWSRNGEKVILCRRETNPDDLEGMLAAQGILTSRGGKTSHAAVVARGMGKTCVCGAEELDIDTKNRQLTAPDGRVIKEGDVISIDGTTGEVFLGEVPVVASPIVRYFEGELDPSSAEADDLVRAVDRIMRYADAKRRMAVRANADTPEDAARARRMGAQGIGLCRTEHMFLGDRRALVERLILADTDQERDEALAALLPLQREDFTGIFEAMDDLPVTVRLLDPPLHEFLPDITELSVRVAVAEARGEKNEGDLRLLQAVHRLHEQNPMLGLRGVRLGLVVPGLFTMQVRAIAEAAAARIKQGGRPRPEIMIPLVGTVQELEIIREESVQVIREVAAEHGVELDIPIGTMIELPRAALTAGQIAESAEFFSFGTNDLTQTTWGFSRDDVEASFFSTYLEKGVFGVSPFESLDVDGVGRLVRIAAEEGRATRPGLKLGVCGEHGGDPASVHFFHEVGLDYVSCSPFRVPVARLEAGRAALR

SEQ ID NO: 24492 - protein, 338 aa, Glycine max
MDTKVLSSGVQYSNLPESYIRPESERPRLSEVSECEDVPIIDLGCQNRAQIVHQIGEACRNYGFFQVINHGVALEAAKEMAEVAHGFFKLPVEEKLKLYSEDPSKTMRLSTSFNVKKETVHNWRDYLRLHCYPLDKYAPEWPSNPPSFKETVTEYCTLVRELGLRIQEYISESLGLEKDYIKNVLGEQGQHMAVNYYPPCPEPELTYGLPGHTDPNALTILLQDLQVCGLQVLKNGKWLAVNPQPNAFVINIGDQLQALSNGLYKSVWHRAVVNVEKPRLSVASFLCPNDEALISPAKPLTEGGSEAIYRGFTYAEYYKKFWSRNLDQEHCLEFFKNK

SEQ ID NO: 24493 - protein, 509 aa, Azoarcus sp. EbN1
MRLFRLAKIVTVGLRFGLDQMVLDADPSGRLLRLWHVVFFWRRPSAPRGVRLRQALESLGPIFVKFGQMLSTRRDLLPTDLADELALLQDRVPPFPTEQALKVLEDFYGRPVDDVFVDFARTPVASASVAQVHFARLPDGTEVAVKILRPGIERVIEHDLALLETAAMLLDRLWVEGRRLKPREVVAEFSKYLHDELDLMREAANCSQLRRNFKDSLLLVVPEVYWDWCGKSVMVMERMHGVPISQLATLRAQGTDLSRLSRAGVEIFFTQVFRDGFFHADMHPGNIFVHADGRYIALDFGIVGTLTEVDKNYLAQNFLAFFKRDYNRVARAHIEAGWVPAHTRVDEFEGAIRAVCEPIFDRPLKDISFGKTLLRLFQTARRFEMEVQPQLVLLQKTLLNIEGLGRQLDPDLDLWKTAKPFLERWMDERMGWRALLHGVRNEAPAWAGTLPQLPRLMHQALVEPTLHHAVQREQLERLTAAQRFQGRLLAVVALLLTAIVTIELYRGFA

SEQ ID NO: 24494 - protein, 1328 aa, Trichodesmium erythraeum IMS101
MLFNPFLRKLRFLLLLLLVLLVVNLGHVRASEESPPADWQLQGILAALDDPDPDVWVKALKKMSEYDLKPVEISSERVEQIGKLLSHENWHVRSAAARAVGEMGAEAKVLIPQLLQLFRDENSGVRSAAARAVGEMGAEAKVLIPQLLQLFRDENSYVREAAVRAVGEMGAEAKVLIPQLLQLFRDESSGVRSAAARAVGEMGAEAKVLIPQLLQLFRDEDSYVRSAAARAVGEMGAEAKVLIPQLLQLFRDESSGVRSAAARAVGEMGAEAKVLIPQLLQLFRDESSYVRSAAARAVGEMGAEAKVLIPQLLQLFRDENSYVREAAVRAVGEMGAEAKDLIPQLLQLFRDENWYVRSAAVRAVGEMGAEAKDLIPQLQQLFRDENPYVREAAARAVGEMGAEAKVLIPQLQQLFRDENSGVRSAAARAVGEMGAEAKVLIPQLQQLFRDENSGVRSAAARAVGEMGAEAKVLIPQLLQLFRDESSYVREAAATAVGEMGAEAKDLIPQLQQLLMDENSDVREKAARAVGKIGKLNTQQILPILNAAHRNRDKEATLRFLAYFVSGGEYDALTLTKWLGSPEQYPYQIDKFKNERPISHEEGKKVLELFAEIWKPSQSLEYLPFELERQINIVVEKVDWQPEDLPLLKKHYNNLKDEDINAKIVALQGIQWFSYLWKFLLLHALTWLILLCLYAKSPEIQTLFWHPQIRKIAGLGYIGLLLTWIPSLRRLLFSPFQPILIADADLDSFNPQDYFSDSNVCLQNTHNLQPIKTTIAKIQSPIVLQGESGLGKSMFLRHWAKTRKNLVVYLPASKCAQGAIAAIQSKIPISQTDPKFLKRLIYNNALEICIDGLNEVTPDTRTKISYFVESHFRGHILLATQPLYWIPPSTTKTYVLQPLKREQIRQFLQTRQFNPSAEPSISRSEYEEACEEYLGKTFNSQKQSEEEQKTVRRLLSNPMDLTIVAQILAQGKTPDLLNLQQQQYKVMAAEYKEVNFDSFPLTEFAETTYQMRLNDEINIPSEWKKELQTMEKYKMVLRRQKYVENDVGSQWYFRHDKIQEYFIVQTFIGEENQKLEEHIDDPRFRGVYLLLATLLPYLEAWSLREKLLQNAAETKDHVVSDQFIQRLNSRSELSKNGENVYLKELIEVMKLLIAEKNNNINKELTELTKLFITEKNNNINIEVNPNIEANPNTRNNSMTDNSESKYNFSQARVGNVVETNNGSMGNVVEKAESGSQVVGTQNNYGSQEKQTLAEAAAEIQKLLKQLELNNPAATDAEKEAFVTASIPPNNRQRFVGALQALGKEALKELLDNPYINVGVATVEGWQNPK

SEQ ID NO: 24495 - protein, 268 aa, Oryza sativa
  misc_feature (45)..(45): Xaa can be any naturally occurring amino acid
  unsure (1)..(268): unsure at all Xaa locations
MTAWSMASLIVAAIFLVSLTSASVAHGRRSSSRRSYDDEPCMEMXDILYDFSNSTSNSTSAAATKPTALSTAVSSPGYFFGRVVVFNDPMTEGRALPPSLEETAVRAQGLYLLDKKDDFSAWFAFSIVFNSTARRGTLNLMGADPNAATRDISVVGGTGDFLMSRGVATLRTDAIEGFKYFRVQMDIKLYECYNVSHLHFISFNKEKKKKVRHAKQMFDEMPQQPPESSECRIKFAESAAGKLGSSWALLQQSYWSLDRICIFQFLHP

SEQ ID NO: 24496 - protein, 234 aa, Triticum aestivum
MEAAASPLLLSADAPLAAGRRLLLVPSRPARAPRRGAAPSRCRRASVRAYAAAAAPAPASGNGLVGNNNGVYTVGDFMTKKEDLHVVKVSTPVDEALEMLVQNRISGFPVIDDDWKLVGVVSDYDLLALDSMAGCGLADTNSSMFPEVDSTWKTFREIQRLLSKTSGKVIGDVMTPSPLVVRETTNLDAAARLLLETKYHRLPVVDSTGNLVGMITRGNVVRAALKIKKKAEGA

SEQ ID NO: 24497 - protein, 449 aa, Burkholderia cepacia
MQKYDFDLFVIGAGSGGVRAARIAAGHGAKVAIAEEYRFGGTCVIRGCVPKKLLMYASQYGQGFEDAAGFGWHSAATSHSWTSLIAAKDAEIARLEGVYQRLIENANVEIFKGRAQIAGPNRVTVTGASVSARTILIATGARPVMPPVAGANLMITSDDVFDLPVGPPRIAIIGGGYIACEFAGIFNGLGRHVVQLHRGSQVLRGFDDELREHLGDELKKSGIDLRLGVDVVAVERQRGALSVQLTTGDAMEVDAVMAATGRLPNTWGLGLETVDVGLDQNGAIKVDEYSRTSSPGIYAVGDVTNRLNLTPVAIHEGHAFADTVFGGKALPTEHENVPFAVFSQPQAASVGLSEAQARDRYSNVEIYGSAFRPMRAALSGRDEKALVKLVVNGSNDRVVGAHIVGADAAEIIQGIAVAIKARATKADFDATLGVHPTLAEEFVTLRNRR

SEQ ID NO: 24498 - protein, 487 aa, Gibberella zeae PH-1
MPKATTPTAMRQTRRHNPLEDDITATGILKNKPSKKRSKGNDDEAENFVDDRASRTILRIGRELAEEENAGKPVAAKPTIDNFGYDSRFGDEAEDENKVYDDDEAWGEDDEVVEEIEVDPNDLDMYRKFMPDEEDDDLLKHGWDLKPTGEEQGDSVNLADLILEKIAAHEAAQERRENNLGPPDEEEFELPEKVVDVYTKVGQILARYKSGPLPKPAKIMPTVPNWEALVNITQPESWSTNACYQMTRIFISSKPQVAQRFMEMVILDRVREEIYETKKLNVHLFNSLKKALYKPAAFFKGFLFPLVGSGTCTLREAHIISAALVRVSIPVLHSAAALKGLCDIAAQEASHGTEGGGATNIFIKALLEKKYALPFQVIDALVFHFLRFRSVDPASVKAGDNMSGINEGDAKTKLPVIWHQCLLAFAQRYKGDVTEDQREALLDLLLTHGHSAIGPEVRRELLAGRGRGVPIEQTGPALDGDDTMLID

SEQ ID NO: 24499 - protein, 334 aa, Arabidopsis thaliana
MVKKGGTKRKIAIETIQKRDSLRVTCTKRREGLYSKASQLCLLSDAQIAILATPPSSESNVSFYSFGHSSVDAVVSAFLSGQRPVPKDNKETREDVGICLTRNNLGLGFWWNDESLARSENPQEISEAIDSMRTLLRNLKELRADEALACNQAFVNDREDLKNNDKCDFVSDHETHDQTLILQSASPICCIPENLNEITQEPNQTLNIQSSTSAICCVPDNSPENFNEITEEQDQIRSICETFCVMDNNAALPEMNLDYDQDIGFDTPFESALNDWFSDNTTHQEISASILNAVVDDQVSVDLTPFSYFQRCLDGDNLRFSDCFKDFANTISAL

SEQ ID NO: 24500 - protein, 373 aa, Gibberella zeae PH-1
MPTELEELVGFIANPNAQIRLLAAENLVPYSLSEPSIFKNDKLQPVKHLSFLVRDHPKIAEHALTMLVNLSGDEEVLKFLASDEKFLGIVFDLIVNPEEPNANLLAMLAANLSKWDGLKDFLKRKQEPPKELGSDEIVLNQLLDLFVKGQDGTYNKNADFDYLAYVFADLSKHDDIRKHFLQEQAYDKVIPLTKLKVFTEHKSDIRRKGVASTIKNVAFEVKSHPSFLSEDEIDILPYILLPIMGNEEYDVDETMDMLPDLQLLPPDKKRDSDHQNIQTHVETLTLLTTSREGRDLMRRVKVYPVIRETHQRVNDEGVQEACERLVQVLARDEEGEGEDEVKDNGLKAIEGKPEVANGQVEEVEDEDDQLVEV

SEQ ID NO: 24501 - protein, 149 aa, Oryza sativa (japonica cultivar-group)
MRGGIPICFPQFGNSGTLEQHGFARNRIWALDEEHPPLNQNDNNSKASVDLILKPSEDDLKCWPHGFEFRLRVSLTKDGNLSLVSRIRNVNGKPFSFSFGYHTYLSVSDISEVRIEGLETLDYLDNLSQRERFTEQGDAITFESEVKNV

SEQ ID NO: 24502 - protein, 230 aa, Methanocaldococcus jannaschii DSM 2661
MEDIKIKEIFENIYEVDLGDGLKRIATKSIVKGKKVYDEKIIKIGDEEYRIWNPNKSKLAAAIIKGLKVMPIKRDSKILYLGASAGTTPSHVADIADKGIVYAIEYAPRIMRELLDACAERENIIPILGDANKPQEYANIVEKVDVIYEDVAQPNQAEILIKNAKWFLKKGGYGMIAIKARSIDVTKDPKEIFKEQKEILEAGGFKIVDEVDIEPFEKDHVMFVGIWEGK

SEQ ID NO: 24503 - protein, 197 aa, Methanocaldococcus jannaschii DSM 2661
MFGGNMRIFEVMRETKETNIYLKINIDGTGKYKIDTGIPFFDHLLASFAKHGCFDLIVKARGDLEIDDHHTVEDVGICLGLALNQIEKRNIFRFGWAIIPMDDARATVAIDLSGRSYCVGNYEPKREFVGDLATENINHFFESVASYGMLNIHYEVIGKNEHHKAEALFKAFGVALDLATKIDERKGVISTKGEVKL

SEQ ID NO: 24504 - protein, 311 aa, Oryza sativa (indica cultivar-group)
MAALAQLAGAAVRVALAALLALLLPAYRVYRLTASFLGALLAAAAADDVAGKVVLITGASSGIGEHLAYEYARRGAYLALVARREESLREVGDAALAAGSPGVLVVAGDVSSPDDCRKFVDDTIRYFGRLDHLVNNASIWQVGKFEELTDVNHFRKLMASKAAAANLYETLRMELAGDGIAITEVIPGVVESEITKGKMLTKEGDMRVDQDERDAILGAAPVERAGEFARAAVRGVCGGERYVFEPRWYRAAYTLRVCFPEALEWCARLLTVWRLGPATTDTVGRWLLLGVPGQRWLSQPASLRSPEIKAR

SEQ ID NO: 24505 - protein, 149 aa, Glycine max
  misc_feature (46)..(46): Xaa can be any naturally occurring amino acid
  unsure (1)..(149): unsure at all Xaa locations
MARTKQTARKSTGGKAPRKQLATKAARKSAPTTGGVKKPHRYRPGXVALREIRKYQKSTELLIRKLPFQRLVREIAQDFKTDLRFQSHAVLALQEAAEAYLVGLFEDTNLCAIHAKRVTIMPKDIQLARRIRGGARLSGSETITTPAAS

SEQ ID NO: 24506 - protein, 505 aa, Oryza sativa (indica cultivar-group)
MVTYLNLAPEEEGDGGALPNLNGGEADMEEDGRLAAGQGDNLDQVEWQAHVHALHVFDLNLHPFDLNFEVTEEEEQIHLAYDHKHMEHDLHVNAHVYEEQQQVEDGDDALQLELEALENYLQDYGVYADAVNVVFDVEELPNSHEVQHANGNERSQSRDLTNIERRAIYARLLEKSMNGKLEKDTTRWAASWHAHKLASMINPQAAERYPYFPGQEPPIRGDVDLLLQCMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKFLPADSNICISQALNGTAMITNVKFFCMEGISTYIQEIEELCTDYPKTTVIFDHMAFCKPPMNIEEEKAFTSFLELSRFPQIYVKYSALFRISREAYPYEDTSQLLSRVISSYGANRIMWGSDFPFVVPECGYKGAKEAISHVAGKIPVSSSDLEWILGKTVTQLFQGAWVSA

SEQ ID NO: 24507 - protein, 142 aa, Symbiobacterium thermophilum IAM 14863
MRLRDLMTTDVRTCAPDTPVSEVARIMEEADCGFVPVVDGGRVAGVITDRDIVLRAVARGRDIRTTTARECMTSPAVTVGPDTDAHAAADLMADKQIRRLCVVDGGRLVGVVALGDLATERIHVDEAGEALSSISEPAQPAH

SEQ ID NO: 24508 - protein, 180 aa, Medicago sativa
MALISSAAVTTVNRASSAQANLVAPFTGLKSSAGFPVTKKTNNDITSIASNGGRVNCMQVWPPVGKKKFETLSYLPPLTEEQLAKEVEYLIRKGWIPCLEFELEKGFVYRENHRSPGYYDGRYWTMWRLPLFGATDSSQVLKELADCKAEYPDSFIRIIGFDNVRQVQCISFIAHTPKNY

SEQ ID NO: 24509 - protein, 181 aa, Lactuca sativa
MASISSSAIATVNRTTSTQASLAAPFTGLKSNVAFPVTKKANNDFSSLPSNGGRVQCMKVWPPIGLKKYETLSYLPPLSDEALSKEIDYLIRNKWIPCLEFELEHGFVYREHHHSPGYYDGRYWTMWKLPMFGCTDSAQVMKEVGECKKEYPNAFIRVIGFDNIRQVQCISFIVAKPPGVL

SEQ ID NO: 24510 - protein, 257 aa, Burkholderia sp. 383
MTTPLKVFITGASSGLGLAMAEEYARQGATLALVARRTEALDAFARRFPKLSISVYSADVRNAEALATAAASFIATHGCPDVVIANAGISQGAVTGQGDLATFRDVMDINYYGMVATFEPFVAPMTATRHGTLVGVASVAGVRGLPGSGAYSASKSAAIKYLEALRVELRPAGVGVVTIAPGYIRTPMTAHNPYRMPFLMDADRFAARAAQAIARQHAFRVIPWQMGVVAKVLHVLPRWLYDRLFEKAPRKPKAGAH

SEQ ID NO: 24511 - protein, 180 aa, Stellaria longipes
MASSIMSSAAVATRSNGAQASMVAPFTGLKSNASFPVSRKTNLDITSIASNGGRVRCMQVWPPINMKKYETLSYLPDLSSEQLLSEIEYLLKNGWVPCLEFETEHGFVYREHTSSPGYYDGRYWTMWKLPMFGCTDATQVAAEVQEAKKAYPDAHIRIIGFDNVRQVQCISFIAYKPEAF

SEQ ID NO: 24512 - protein, 168 aa, Saccharum sp.
MALTVMASSATAAAPFQGLKSTASLPVARRSTTSLAKVSNGGRIRCMQVWPAYGNKKFETLSYLPPLTQEQLLKQVDYLLRNNWVPCLEFSKEGFVYRENSTSPCYYDGRYWTMWKLPMFGCTDASQVYKELQEAIASYPELRAILGFDNIRQTQWLTFIAYKPAGSE

SEQ ID NO: 24513 - protein, 182 aa, Manihot esculenta
MASSMLSTATVASINRVSPAQATMVAPFTGLKSTPVFPTTRKTNSDITSITSNGGKVQCMKVWPTLGMKKFETLSYLPPLTREQLASEVEYLLRSGWIPCLEFELEHGLVYREHARVPGYYDGRYWTMWKLPMFGCTDAAQVLKELDELIKHHPDGYARIIGFDNVRQVQCISFLAYKPPGA

SEQ ID NO: 24514 - protein, 255 aa, Burkholderia sp. 383
MNTQDHPLSHLFDNNDAWVKHKLEDDPQFFARLADQQAPEYLWIGCSDSRVPANEIIGLPPGEVFVHRNIANVVVHSDLNCLSVIQFAVDILRVKHIMVVGHYGCSGVNAALLNRRVGLADNWLHHVQDVRERHTALLDAWPVGEARYRRLIELNAIEQVVNVCRTTIVNDAWARGQSLTVHGLVYGVHDGRMRNLGMAVSNFEALDETYTRCVAALVAGGEHAPDNDMIAADAARLEGVAQAVAATLKPCDDAK

SEQ ID NO: 24515 - protein, 462 aa, Streptomyces sp. KO-3988
MPELPAIRRAPRRLPLAGHAVPLLVQPLEFLKSLPALGDMVRVRMGPDDAYVPCDPALFRQILKDTRLYDKGGLFYDRGREAVGNGLVTSRWADHRRQRPLMQPSFDHRHIGHYAELMADETEALMRSWRSGEVVDVDKAMARLTLRITTRSLFSVPADHTLVAQVEKWLPILMDGFFRRMFVPARVLSLVPGKMNRQYPPPIAEMRKLTEEIIDEVRRKKDEDPGLLAGLMNARDETTGAPLGTQEIFDQVLILLIAGSETTATALAFTFHLLGAHPEIGARLREEVDGALGGRTPRFEDLSGLTFTRQVLMESLRLYPPAWMFTRSTTTACELGGHAFPEGTTFLLSPYILQHDPELFPRPERFDPDRWRPGAMSDVARRSVLPFGAGGRKCIGDQFALNEAMLAVAAIAGRWNLTPVGDRPIRPIARATLKTGPLPMRLQERPHEPVRNATTTDLRDQR

SEQ ID NO: 24516 - protein, 576 aa, Listeria monocytogenes str. 4b H7858
MQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDGKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPSVFKSMLNSVARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLGLLDDHCAGKFDYSRKIWTVVIFMIWYDVYVADKYDFGK

SEQ ID NO: 24517 - protein, 409 aa, Aeropyrum pernix K1
MTLSSAGGSRSHRHNGGHSERDVEIRILKDKVRSLTKEKISLQKELEYYKNEITKLLSPPYIEAVVLEVIDDNRVVVKSSTGPNLIVNVAAGVDARSLKPGAIVALNNRGSTIVDVLPGRYDPLVKAMEVEERPKVFFKDVGGLEEQIREIYEAVVLPIKNPHLFRELGIDPPKGVLLHGPPGTGKTLLAKAVAGETEATFIRVVGSELVNKFIGEGARLVREIFRLAREKAPSILFIDEIDAIASKRVDIGTSGDREVQRTMLQLLAELDGFDPLDNVKVIAATNRLDLIDPAVLRPGRFDRIIEVPLPSLRGRLEILGIHTRKAKMAPDVDLEAIAKLTEGFSGADLKAVVVEAGYNAIRRGSRVITMDDMIKAVEKVKAALDKRGGGDPFIRAQQKSGDDTIATVI

SEQ ID NO: 24518 - protein, 243 aa, Oryza sativa (japonica cultivar-group)
MLAKGRKVAGRGGDMSAHYAFGLQEDDAIIKRRLLTRTTTTRGEPPLKKLQKKFMSFATEVEKDADNISDCERLYKAFLQEINAFVLPLLKSKAVVDANLREKESFNELQDEIQRQILQAQTDIEELKKKLEQSRIERLYKEECEAIRKMISLQPPRSETEKLIAGLEKEIANLEAENTACIRTLELRKKQLSLLLHVVEELQISIEDEQRSIADELRAGAEEQQNMSTDEGSGDASDAMALD

SEQ ID NO: 24519 - protein, 320 aa, Ustilago maydis 521
MPPKGSKRSSKTAAVEQPMDVDEPSSSHPSGSIANDPIASSIIQDSKTSVAVDQRRLVEILPERVGSVANTDFPLHYPGENNAFSLAAANQNLKVIVTRLSDASCEFDLIGVDASIANAVRRVLMAEVPTVAIEHVYIWNNTSIIQDEVLSHRLGLVPLAINPDKVAMRMPGDEADDSNTVVFHLKAKCERNRSAARGETDPDKLYIGHNVYSEQLRWDAKGGQEKDFADSPPRPVQDKILIAKLRPGQELDLELHCEKGIGKDHAKFSPVATATYRLLPHIQLLQPIPDESIDKFVSCFPPGVIGVQGSGKTRSVFRSV

SEQ ID NO: 24520 - protein, 133 aa, Zea mays
MRGSNRHATLVESVACQHSYFTVQSNPIHPPVRSGGDRQPAAVMSGRGKGGKGGGGGGAKRHRKVLRDNIQGITKPGIRRLARRGGVKRISGLIYEETRGVLKIFLKNGMRDSVTYMEDDRCKNVSDMDEVWG

SEQ ID NO: 24521 - protein, 296 aa, Laodelphax striatellus yeast-like symbiont
MPYVSVARYGKDNVRVLKVSRDAGIGVQTVTEMTIRCLIEGDIEASYTGADNSSVVATDSIKNTIYILAKQHRVNPPELFASIISSHFIQKYSHIHVADVDIVTHRWLRMDVDGKPHPHSFIKDAGETRNVHVYAKRQDGIAIASSIVGLSLLKSTGSAFSGFVRDEFTTLPESWDRILATDVDASWKWSKFADLEAVEQSAAKFDAAWESARCITLELFAQDDSPSVQNTMYKMCQQILNVLPDTQSVAYVLPNKHNFELDLSWHGGIQNTGKQAEIYVPQTCPNGLIKCEVSRS

SEQ ID NO: 24522 - protein, 402 aa, Caulobacter crescentus CB15
MADINTPALGESVTEATVARWTKKVGEAVKKDEILVELETDKVSLEVASPADGVLSAIGAAEGATVVPGTVLGVVAEGATASAAPAAAPAPKAEAPKPAPAAPAPAAAPAAAPVSPAPARIAAESGLDLSKVAGTGKDGRVTKGDALAALEARASAPAPAAAAAAPRALHEREERVKMTRLRQTIARRLKEAQNSAAMLTTFNEVDMSAVMALRAQYKDVFEKQHGVKLGFMSFFVKAVVAALKAIPDVNAEIDGQDVIYKNHYDIGVAVGTDKGLVVPVVRDADALNLAGIEKTIGDLGKRARNGQLAIEDMQGGTFTITNGGIYGSLMSTPILNAPQSGILGMHAIKERPMVINGKIEIRPMMYLALSYDHRIVDGAGAVTFLVKVKEAIEDPQRLLLEL

SEQ ID NO: 24523 - protein, 337 aa, Ustilago maydis 521
MSQVNIGINGFGRIGRIVFRNSVVHNTANVVAINDPFIDLEYMVYMLKYDSTHGVFNGDISTKDGKLIVNGKSIAVFAEKDPSNIPWGQAGAHYVVESTGVFTTIDKASAHIKGGAKKVVISAPSADAPMYVCGVNLDAYDPKAQVVSNASCTTNCLAPLAKVIHDKFGIVEGLMTTVHATTATQKTVDGPSAKDWRGGRAAAANIIPSSTGAAKAVGKVIPSLNGKLTGMAFRVPTTNVSVVDLTARLEKGASYDEIKAEVKRASENELKGILGYTEDAVVSQDFIGNSHSSIFDAAAGISLNNNFVKLVSWYDNEWGYSNRCLDLLVFMAQKDSA

SEQ ID NO: 24524 - protein, 296 aa, Ricania japonica yeast-like symbiont
MPYVSVARYGKDNVRVLKVSRDAGIGVQTVTEMTIRCLIEGDIEASYTGADNSSVVATDSIKNTIYILAKQHRVNPPELFASIISSHFIQKYSHIHVADVDIVTHRWLRMDVDGKPHPHSFIKDAGETRNVHVHAKRQDGIAIASSIVGLSLLKSTGSAFSGFVRDEFTTLPESWDRILATDVDASWKWSKFADLEAVEQSAAKFDAAWESARCITLELFAQDDSPSVQNTMYKMCQQILNVLPDTQSVAYVLPNKHNFELDLSWHGGIQNTGKQAEIYVPQTCPNGLIKCEVSRS

SEQ ID NO: 24525 - protein, 475 aa, Caulobacter crescentus CB15
MARPEGDRPMAQYDVVIIGGGPGGYNAAIRAGQLGLKVAIVEGRGKLGGTCLNVGCMPSKALLHASELYAAATGPEFAKLGIEVKPKLNLSQMMAQKAESVEALTKGVEFLMKKNKVEYVKGWGRIDGVGKVVVKAEDGSETTLETKNIVIATGSEPTPLPGVSVDNKRIIDSTGALSLPEVPKRLVVVGAGVIGLELGSVWKRLGAEVTVVEYLDRILPGTDTEVANAFQKILVKQGFKFQLGAKVTGAEAGAKGVKLSFEPVAGGEAQTIEADYVLVAIGRRPYTQGLGLETVGVTPDKRGMIANDHFKTGVAGVWVIGDVTSGPMLAHKAEDEGVACIEMIAGKAGHVNYGIIPGVVYTSPEVATVGKTEDELKAEGVAYKVGKFPFLANSRAKINHETDGFVKILADAKTDRILGAHMIGPNVGDMIAEYCVAMEFGGASEDVARTCHPHPTRSEALRQAAMGVEGWTMQA

SEQ ID NO: 24526 - protein, 405 aa, Methanocaldococcus jannaschii DSM 2661
MENYNDILEKMLNGEIKPYQLDKMFGSKIATEIRRKFIEKKVGIEFKHICNYSIDEEMAMKKNIENMIGAIQIPLGFAGPLKINGEYAKGEFYIPLATTEGALVASVNRGCSIITKCGGATVRVIDDKMTRAPCLKTKSVVDAIKVRDWIRENFERIKEVAESTTRHGKLIKIEPILIVGRNLYPRFVFKTGDAMGMNMVTIATEKACNFIEGELKKEGIFVKTVAVSGNACVDKKPSGMNLINGRGKSIVAEVFLTEKEVNKYLKTTSQAIAEVNRLKNYIGSAISNSMGFNAHYANIIGAIFLATGQDEAHIVEGSLGITMAEVEDDGLYFSVTLPDVPIGTVGGGTRVETQKECLEMLGCYGDNKALKFAEIVGAAVLAGELSLLGALAAGHLGKAHQELGR

SEQ ID NO: 24527 - protein, 199 aa, Arabidopsis thaliana
  misc_feature (53)..(53): Xaa can be any naturally occurring amino acid
  unsure (1)..(199): unsure at all Xaa locations
MSGITYQLLFLLLLASVSLSPVRCLGYGASSEERTLAMIKPDGVSGNYTEEIXTIVVEAGFNIVKEMLTQLDKETASAFYEEHSSRSFFSHLVTYMTSGPVLVMVLEKRNAVSDWRDLIGPTDAEKAKISHPHSIRALCGKNSQKNCVHGSDSTSSAEREIKFFFKDVVSGLFSSPPILLLKLLPLSSIQVLSVMTYDH

SEQ ID NO: 24528 - protein, 392 aa, Gloeobacter violaceus PCC 7421
MVPPVKHRLSERALAVVPSLIRDASRYCDELGALNLAQGLPDFAAPAFLKEAAQRAIAADRNQYCDPWGLAQLREAIAAKCTRDNALAVDPATQVTVCCGATEGINLALMALLDPGDEVVVFSPFYENYRPNLATVEAKPRYVPLSAPDWRVDEAVLERAFAGTAPRAVIVNNPANPTGKVWSRQELELVARYCERHDAYAITDEIYEYILYDGAEHISLASLAGMAERTVTVSGLSKTFCVTGWRLGYVIASEPLTAAIRRLHDFLTICAPAPMQHAAVAALEAPADYYADLRRLYQAKRDRLVTALYRSGFEPVRPAGAYYVWTDAGVLGAKNALAAAGRLAVEAGIAAVPGDCFLPPGHPNCNLRFCYAKSDETLAAAVERLDRWSGHG

SEQ ID NO: 24529 - protein, 252 aa, Azoarcus sp. EbN1
MKLYRELGFTEAPAYYPTPIEGTLFLALDLDNWSEEEVANENLFHLFDYNRAWARQMQQIDPGFFEKLSKLQSPEYLWIGCSDSRVPANQIIGLLPGEVFVHRNVANVVVHTDLNCLSVIQFAVDVLKVRHIMVVGHYGCGGVKAALGRERIGIVDLWLRHVQDVHVKHRQAVDGLPPELAHDRLCELNVLEQVVNVAQTVVVQDAWKRGQPLAVHAWIYGLKNGLVRDLGLNVTRPEDLVPRYVAALETLA

SEQ ID NO: 24530 - protein, 49 aa, Triticum aestivum
  misc_feature (16)..(16): Xaa can be any naturally occurring amino acid
  unsure (1)..(49): unsure at all Xaa locations
YQGFKGTGRIKKNVNXFERWKCFDFQGFGMRKCPTCGKGGLSPDQRGER

SEQ ID NO: 24531 - protein, 375 aa, Photobacterium profundum SS9
MPGKVLSGEGLRGQSAGSTAICTVGKTGAGLTYRGYDISDLAESADFEEVAYLLLKGKLPTQAQLDAYKTVLISYRGLPLALKVVLEQIPADAHPMDVMRTGCSMLGNLEQEHEFSEEYDKADRLLALFPAIICYWYRYSHHGVRIETYCDQDSLGGYFLKMLTDKSPSELHKRAMHCSLILYAEHEFNASTFAARVCASTLSDLHSCIATAIGTLRGPLHGGANEAAMAMIEQWQTTDEAEAGILTMLANKDKIMGFGHAVYSESDPRNVLIKRWSKLLSEEADDAVLYAISERVETVMKREKGLFCNADFFHASAYHFLNIPTKLFTPIFVMSRLTGWAAHVFEQRAHNRIIRPSADYIGPEHQDWLPIDKRH

SEQ ID NO: 24532 - protein, 300 aa, Prochlorococcus marinus str. MIT 9312
MIPDNTKFTNPFFGRILTAMVTPFTENGNVDYELAIKLSNYLFENGSDGIVLCGTTGESPTLSWAEQHDLFIAVKGSLDSSCKVIVGTGSNCTSEAVEATKKAYDSGADGALVVVPYYNKPPQEGLYKHFSSIANSAKDLPLMLYNIPGRTGCNLLPDTVKKLMDFSNILSIKAASGRIEEVTELRAICGSELSVYSGDDSLLLPMLSVGAVGVVSVASHLVGLQLKEMIQSFQSGKVANALAIHEKLQPLFKALFMTTNPIPIKAALELSGWNVGKPRSPLSPLSNDMKKQLSFILTSL

SEQ ID NO: 24533 - protein, 907 aa, Medicago truncatula
MRITMNTHFLSCERSTMLLHQNSSPLLRRFRFRYVKFKPHRSRFRCLLPQIAVQSSANVIAAAAKAASVHGAVYSAINHVAVTAVAIASGACLSTKVDFLWPKPDEQPGTIMQDGVDVTGYPIFTDAKVQKAIAFATKAHLGQIRKTGDPYLAHCIHTGRILAALVPSSGKRAVETIVAGILHDVVDDTCQSLQDIEAEFGDDVAELVAGVSRLSYINQLLRRHRRVNVNQGVLGQEEASNLRGMLLGMIDDPRVVLIKLADRLHNMRTIYALPMHKAQAVAEETLIIWCSLASRLGLWALKAELEDLCFAVLQPQIFQSMRADLASMWSPSARIGSSGRLYLKGNLIPLAEKSSTSFYNKSLAFNEGLCSMKDLLEAVVPFDVLLDRRKRANFLYSIANNVETCTKPKVVQDAGLALASLVICEEALERELIISASYVPGMEVTLSSRLKSLYSIYSKMKRKDTSIDKVYDARALRVVVGDKNGALHGPAVQCCYSLLDIVHRLWTPIDGEFDDYIINPKPSGYQSLHTAVEGPDNSPLEVQIRTQRMHEYAEHGLAAHWLYKETGNPFSSVDRMDTPETDASSSIDKMDAPETEASSSIDRMDTPETEASSYFSKDTEAENSSDILLSKNKSLKAGHPVLRVEGSHLLAAVIISVENEARELLVAVSFQLAASDAVADRRSFFQDKRWEAYARLYKKVSDEWWFEPGHGDWCTCLEKYTLCRDGMYHKQDQFGRLLPTFVQVINFTEQEESEYWDVVSAVFEGKQVDCIASQSKLDLVPSTSMDASINNKVHLLRTMLSWEEQLRSEVNINQTKHDAKFDGPRGPLNLGEVVVICWPNGEIMRLKAGSSAVDAAQRTGLEGKLVLINGHLALPNTKLKDGDVLEGLGFEPRTPHLFILKVNFSSH

SEQ ID NO: 24534 - protein, 391 aa, Thermobifida fusca YX
MRALTWQGPRDVRVETVPDPTIEEPTDAIIRITSSGLCGSDLHLYEVMAPFMREGDILGHEPMGVVEAVGDAVTTLRPGDRVVVPFNIACGHCFMCVQGLQAQCETTQVRETGMGGRLFGYSSLYGSVPGAQAEYLRVPHADYGPIKVPKGPPDDRFVYLSDVLATAWQAVRYAAVPPGGSLAVLGLGPIGDMCCRVAQHLGAGQVFGVDVVPERLSRAARRGVTTFHFDEDTVDAIRDLTDGRGPDAVIDAVGMEAHGSPITRTAQRLTALLPSKAGAALITTAGVDRLTALHTAITLVRRGGTISLSGVYGGIADPLPMLTLFDKQVQIRMGQANVRRWVDEILPLLTDDDPLGVDSFATHRLPLAEAPYAYAAFQHKDNGMVKTLFHP

SEQ ID NO: 24535 - protein, 432 aa, Listeria monocytogenes str. 4b H7858
MDHSMSKKLHDEALLHIVGGVNSPSRSNKGVGGGIPVTMERASGAYFYDVDGNKYIDYLAAFGPIITGHAHPHITEAITKAAQNGVLYGTPTKHEITFAKMLKEAIPSLEKVRFTNSGTEAVMTTIRVARAYTGRDKIIKFAGCYHGHFDLVLVEAGSGPSTLGIPDSAGVTKSTAEEVITVPFNDLASFKEALAVWSDQVAAVLVEPIVGNFGMVAPEDGFLEAVNELAHANGSLVIYDEVITAFRFMYGGAQNYLGVIPDLTAMGKIIGGGLPIGAYGGRIDIMEKVAPLGPAYQAGTHAGNPASILSGIACLEVLQEEGLYERFEKYGSMLKDGIEKAALKHGIAVTVNQIVGALTVYFTEDPVTNYAEAGATNGELFGRFFKGMLEEGINLAPSKYEAWFITSAHSEADILETIQAVDTVFGKMVQDN

SEQ ID NO: 24536 - protein, 169 aa, Zea mays
  misc_feature (18)..(18): Xaa can be any naturally occurring amino acid
  misc_feature (50)..(50): Xaa can be any naturally occurring amino acid
  misc_feature (113)..(113): Xaa can be any naturally occurring amino acid
  unsure (1)..(169): unsure at all Xaa locations
MVLSPKEAGEFLVKHGLXPEERFRAVETRGCPQVSFRGDISINLGPLEEXSNLFKTDLPLCESGGDNLAANFSRELADYIIYIIDVSAGDKMPRKGGPGITRGDLLVINKTDXLAAAVGADLSVMERDALRMRDGGPFVFAQVKHGLGVEEIVNHVMNSWEQATGNKRH

SEQ ID NO: 24537 - protein, 470 aa, Pseudomonas fluorescens Pf-5
MADAGTVLQRGLSTRHIRFIALGSAIGTGLFYGSAAAIQRAGPSVLLAYLIGGAAIYLTMRALGEMAVRTPVSGSFGHYASSYLGRFAGFLTGWSYAFSMLMVCLADVTAFGVYMGLWFPDTPRWIWVLSIVLGIGALNLCSVKVFGELEFWLSLLKVGAIVAMIVGGFTLLFFGIQLGEEQSRGGLANLWEYGGFFPNGVEGMIASFTIVMFAFGGIEVIGITAGEAKDPQRMIPKAINSVPLRILIFYVLTLLILLTLAPWSSIGSHGSPFVQIFSSLGISSAATVLNIVVISAVVSAINSDIFSAGRMMYGMAAIGQAPAVFARTSRFGVPWMTVLVMSVALLLGVLLNYWIPQELFLIFASLVTFSVVWVWLMILLSQMAMRRGMSAREIHELKFPLPLGTAGQACAVVFMLFIFGVLGAFADTRLALYVGLGWLALLSLAYWIWIKPDTTGSAAAESGIGTQEKG

SEQ ID NO: 24538 - protein, 222 aa, Oryza sativa (japonica cultivar-group)
MRQEATCSLVLTQDAQHRKNQPPLAEEDDDRDHTDDAMPPPCSILLRQEEGEATAAAAGEGLLVPPLNFAMVDHGVYRSGFPDISNLPFVESLRLRSVLCLCPEPYPEANQEFLRAHGIRLFQFGIDGSKEPFVNIPEDRIREALKVVLDVANHPVLIHCKRGKHRTGCVVGCLRKLQRWCLTSIFDEYQRFAAAKARVSDLRFMELFDISSLKHLPASFSC

SEQ ID NO: 24539 - protein, 353 aa, Streptomyces sp. KO-3988
MTDTHAIARVPMKWVGPLRISGNVATTETHVPLATYETPLWPSVGRGAKVSMLSERGIAATLVDERMTRSVLVEATDAQTAYTAARAIEARIEELRAVVRTCSRFAELLQVRHEIAGNLLFVRFEFSTGDASGHNMATLASDALLAHLLQTIPGISYGSISGNYCTDKKATAINGILGRGKNVVTELVVEREVVERVLHTTAAKIVELNIRKNLLGTLLAGGIRSANAHYANMLLGFYLATGQDAANIVEGSQGVTLAEDRDGDLYFSCNLPNLIVGTVGNGKGLEFVETNLNRLGCREDRAPGENARRLAVIAAATVLCGELSLLAAQTNPGELMRAHVELERDNTTAEVGV

SEQ ID NO: 24540 - protein, 226 aa, Ostreococcus tauri
MWLFRKQKTPQELLRDNKRSLDRSIREIERERTQMMNQEKKLIAEIKRVAKANQMGAVKVMAKDLVRTRHSITKFYALKSQLQGVSLRMQTLKSSQAMADAMRGVTKAMKSMNARLNLPSLTNILKEFERQNEKMEMTTEVMGDAVDDAFAGEDEEEETEELVNAVLDELGCNVGAELISAPATKVGVASESKAERAAVLEGGASEPTAGSGLDDDLQARLDALRK

SEQ ID NO: 24541 - protein, 172 aa, Glycine max
MARENPLVIGGVIGDVLNPFTSSVSLTVSINNRAISNGLELRPSQVVNRPRVTVGGEDLRTFYTLVMVDADAPSPSNPVLREYLHWMVTDIPATTNASFGREVVFYESPNPSVGIHRIVFVLFQQLGRDTVITPEWRHNFNSRNFAEINNLAPVAAAYANCQRERGCGGRRY

SEQ ID NO: 24542 - protein, 296 aa, Geisha distinctissima yeast-like symbiont
MPYVSVARYGKDNVRVLKVSRNAGTGVQTVTEMTIRCLIEGDIEASYTGADNSSVVATDSIKNTIYILAKQHRVNPPELFASIISSHFIQKYSHIHVADVDIVTHRWLRMDVDGKPHPHSFIKDAGETRNVHVHAKRQDGIAIASSIVGLSLLKSTGSAFSGFVRDEFTTLPESWDRILATDVDASWKWSKFADLEAVEQSAAKFDAAWESARCITLELFAQDDSPSVQNTMYKMCQQILNVLPDTQSVAYVLPNKHNFELDLSWHGGIQNTGKQAEIYVPQTCPNGLIKCEVSRS

SEQ ID NO: 24543 - protein, 298 aa, Campylobacter coli RM2228
MDKNIIIGAMTALITPFKNGKLDEQSYARLIQRQIDNGIDAVVPVGTTGESATLTHEEHRTCIEIAVDICKGTKVKVLAGAGSNATHEAVDLAQFAKEHGADGILSVAPYYNKPTQQGLYEHYKAIANSVDIPVLLYNVPGRTGCEICTETIIKLFRDCENIYGVKEASGNIDKCVDLLAHEPRMILISGEDAINYPILSNGGKGVISVTSNLLPDMISKLTHLALEENYKEAKKINDELYNINKILFCESNPIPIKTAMYIAGLIESLEFRLPLCSPSKENFAKIEEVMKKYKIKGF

SEQ ID NO: 24544 - protein, 192 aa, Prochlorococcus marinus str. MIT 9211
MDYSEETTAKSFAKIFSGHFTNKQQANKYPKDFAHINIFVRPLEFKLFDSLSFYSEQSYDHSPWSPYRQAVQKINIKKGLIILETYNLKNHKRVAGAGFNLELINYINRDDLIPRFGCEMHFIEPKKGHYRGSLRPGKTCFINREGQETYLLSKVEINKKKWVSIDEGYDVQTDKKVWGSENGPYEFLRVEE

SEQ ID NO: 24545 - protein, 220 aa, Edwardsiella tarda
AETLQRLNPETTLFLVASKTFTTQETMTNAHSARDWFLQAAGDERHVAKHFAALSTNAQAVAAFGIDTANMFEFWDWVGGRYSLWSAIGLSIALSIGYDNFEQLLAGAHAMDRHFASAPLQQNLPVLLALIGIWYNNFFGAETEAILPYDQYMHRFPAYFQQGNMESNGKYVDRNGQAVDYQTGPIIWGEPGTNGQHAFYQLIHQGTKLIPCDFIAPAIS

SEQ ID NO: 24546 - protein, 296 aa, Cerataphis fransseni yeast-like symbiont
MPYVSVARYGKDNVRVLKVSRDAGTGVQTVAEMTIRCLIEGDIEASYTGADNSSVVATDSIKNTIYILAKQHRVHPPELFASILSTHFIQKYSHIHVADVDIVTHRWLRMDIDGKPHPHSFIKDAGETRNVHVHAKRQDGIAIASSIVGLSLLKSTGSAFSGFVRDEFTTLPESWDRILATDVDASWKWSKFADLEAVEQSAAKFDAAWESARCITLEMFAQDDSPSVQNTMYKMCQRILNAIPDTQSVAYVLPNKHNFELDLSWHGGIQNTGKQAEIYVPQTCPNGLIKCEVSRS

SEQ ID NO: 24547 - protein, 277 aa, Cordyceps bassiana
GVHTVTETVVCVLLEGAIETSYTQADNSVVVATDSMKNTVFILAKQHPVTPPELFAATLGAHFIEKYSHIHVANVDIVTKRWVRMHVDGRPHPHSFVKEGEEKRNVRTRVSRRGGIAVNSGLSDLTVLKSTGSAFHGFVRDDFTTLPETWDRIMSTDVDASWDWIAFPDLAAVRDAAPEFDRAHKAARNITFKRFAEDNSASVQATMYKMSEDILKAVPNINKVYYSLPNKHYFELDLSWHKGIKNTGKDAEVYVPQSNPNGLIKVEVSRDGPSSKL

SEQ ID NO: 24548 - protein, 544 aa, Fulvimarina pelagi HTCC2506
MLGLMQNRQLSIASLIEHAARTHGSTEVVSRLVDGSIHRSTYHETARRSRQAANALQSLGVEVGDRVATLAWNTHRHLELYYAISGFGAVCHTINPRLFFEQIRFIVDHAEDRVLFFDPTFSGLVEEIAEVCPSVEAFVVLCSRDEMPRDLKVGNLLCYEDLLTDEVETFQWPDLPEETAAALCYTSGTTGNPKGVLYSHRSTILHAYASVMPDAFGISARDCVMPASSMYHANAWGLPYAATLAGAKLVLPCNQLDGPHLTEMIDAERVTISCGVPTIWLGVLQYLAKTKQSLKSLRRLVVSGSACPVSLITNYRKRHDVEIMHFWGMTELSPLGTIARVPHEDANAPDEVLDEMRSRQGRPLYGVEIEIVDDEGVPLPHDGETFGDLMVRGFWVADGYFRRDERESDAEGWFRTGDVSTIDPSGVMRITDRSKDVIKSGGEWISSIDLENAAVGHPSVAEAAVVGIPHPKWDERPLLIAVLNEGAEPDAQSIRDFLLDHVARWQLPDDIVFVDEIPHTATGKILKMELRDIYADHFLSSEED

SEQ ID NO: 24549 - protein, 130 aa, Prochlorococcus marinus str. MIT 9312
MSSKKVIKTSNAPDPVGPYNQAIKAGDFIYCSGQIAIDPATNEITCLGDIEKETIQVLKNLSAVLKAGGAKIADVVKTTIYLTDLSNFQIVNNIYSDFFNVENPPARACVEVSSLPKGVLVEIDCVAFLD

SEQ ID NO: 24550 - protein, 2247 aa, Oryza sativa
MAQLAKNACMAVVEQQVKAQDVRLWSMERKDVTRVAKTDHSFESNILQRAFVLDRMLVLCFYCTPVIAFFVDADDDTTRQEKVKLSDKLITVSVRPSQPSGITTSGRSDKSAVALGVDKEDDELQQGGESGKDLGRGLRAKRPSVRVNGPMWAKLAELGVWRIWARTLEKPDYLEKPRYVMKQAAQLMAQEGKLDLLLRTMEENEKKREEVDGRTRTDFADLKKSLEVRLPAVEKKVEILSSDLATLNHKVQQLESSIQRQPSGDEFAGKVTTAVLPKEELNYHSTPFIKGQRDPEFASPDQQNQDGLTFQSGNSGLGGGIAGSIPPMSCPQFNGDNPQLWKSNCEVYFDIYGIHPQNWVKIATLNFCGNAAFWLQSVRSQLAGATWFELCDRVCGRFARDRKQALIRQWIHITQTSSVADYVDRFDSIMHQLMAYGGSNDPAYFVTKFVDGLKDHIRVVVMVQRPQDLDSACTVALLQEEALEGVQSVSNKKNETTTFLKTKPSHNLTSPTFQARSIPFTNIEDKRGVEFSKGRDDKVSALRSYRRSKGLCFVCGEKWGRDHKCATTVQLHVVEELINALKTDPEENCNSEGAPESEEDSLMAISFQALNGTDSSKSIRLRGWVQNTELLMLVDSGSTHSFIDAKLGAQLCGLQKLNQAIKVQVADGSQLFCDSFLPNCSWWSQGHSFTSDFRLLPLGSYDAILGMDWLEQFSPMQVDWVHKWIAFQHHGQAVQLQGIHPQLSTCFPISNDQLQGMSKKGAVMCLVHLNVAETLTATTVPEIVQPILNEFQEIFSEPTELPPKRNCDHHIPLVEGAKPVNLRPYRYKPALKDEIERQVAEMLRSGVIQPSSSPFSSPALLVKKKDGTWRLCIDYRQLNDVTVKSKYPVPVIDELLDELAGSKWFSKLDLRAGYHQIRMAEGDEYKTAFQTHSGHYEYKVMSFGLTGAPATFLSAMNETLSPVLRKFALVFFDDILIYSPTLELHLQHVRTVLQLLSAHQWKVKLSKCSFAQQEISYLGHVIGAAGVATDPAKIQDVVSWPQPTTIKKLRGFLGLAGYYRKFVRHFGLISKPLTQLLKKGIPFKWTPEIESAFQQLKQALVAAPVLALPDFSKHFTIETDASDVGIGAVLSQEKHPIAYLSRALGPKTRGLSTYEKEYMAIILAVEHWRPYLQQGEFIILTDHHSLMHLTEQRLHTPWQQKAFTKLLGLQYKICYRKGVSNAAADALSRRESPISEVAAISECIPSWMQELMQGYQLDGQSKQLLAELAISPNSRKDYQLCQGILKYKGKIWVGNNTALQHKLVNELHATPLGGHSGFPVTYRKVKSLFAWPGMKKLIKEQLQSCQVCLQAKPDRARYPGLLQPLPVPAGAWQTISLDFIEGLPRSSHYNCILVVVDKFSKYSHFIPLSHPFNAGGVAQEFMKNIYKLHGLPRAIISDRDKIFTSQFWDQLFSKFGTDLHMSSAYHPQSDGQTERVNQCLEIYLRCFVHAAPHKWSSWLYLAEFWYNTSFHSTLNKTPFEVLYGYTPSHFGIGLDDCQIADLHEWHTERKFMQQLLQQHLNRAQQQMKHQADKKRSFRQFAVGDWVYLKLQPYVQTFVAQRACHKLAFRYYGPFQVMSRVGTVAYHIQLPATSSIHPVFHVSQLKAAVGFSKKVQDELPTSLGALQVPFQFLDKRLVKKGNRSVLQLLTHWYHSSPSESTWEDMEDLFARFPRALAWGQASFQDWGIVRPSQPSGITTSGRSDKSAVALGVDKEDDELQQGGESGKDLGRGLRAKRPSVRVNGPMWANSVEMSRAHGSPRSFFPVGNPFRVMFPGGAHLSRKLQELLASYEDALALSLRKLKPEAASDVLTLSWMRLAVDCLSELHTNIANLITDLELPVSDWDDKWVDIYLNSSVKLLDICIALSSELSRLDQGQLLLQYALHVLGSESGVPSQEQLKRAEPSLREWMELVGVRCARLVSCSATLQELAGNLSLMKVKNSAKGKVLMRALYGIESVTVFVCSIFVAVLSGSPKPLVELHVPEKFGWSQAFNDLHTAVSEELTRQLSGGSVAAVKELEEVEACARRLHVLASTSQLEEEAANLANAVSHTEEEVMSDSIAQEGDHHCGLKLADDTTREGGIVISESIAEGGTQEAEMKKDISYEKEVAMVERISYKEHQDSNVKQANGSSDESALVVPERTSVQESKEELLNCISSMSKSAEGLRHGLDSLSKRVGDFFQIVLTGRDALLCNLRISDAASKVAEVSS

SEQ ID NO: 24551 - protein, 331 aa, Triticum aestivum
  misc_feature (149)..(149): Xaa can be any naturally occurring amino acid
  misc_feature (180)..(180): Xaa can be any naturally occurring amino acid
  misc_feature (218)..(218): Xaa can be any naturally occurring amino acid
  unsure (1)..(331): unsure at all Xaa locations
MAASLQAAATLMPAKIGGRASSARPSSHVARAFGVDAGARITCSLQSDIREVASKCADAAKMAGFALATSALLVSGASAEGAPKRLTFDEIQSKTYMEVKGTGTANQCPTIDGGVDSFPFKAGKYEMKKFCLEPTSFTVKAEGIQKNEXPPAFQKTKLMTRLTYTLDEMEGPARGRRRRXTLKFEEKDGIDYAAVTVQLPGGERVPFLFTVKQLVATXGKPESFSGPFLVPSYRGSSFLDPKGRGGSTGYDNAVALPAGGRGDEEELAKENVKNASSSTGNITLSVTKSKPETGEVIGVFESVQPSDTDLGAKAPKDVKIQGVWYAQLESN

SEQ ID NO: 24552 - protein, 348 aa, Gloeobacter violaceus PCC 7421
MDTTPLTPLTKGITLYQHILSQQALNPDATGEFSGLMVQISLAAKLISRQLAQAGLVENVLGFTGETNVQGEAVRHLDQYANETFIRVFQNTNLVCLLVSEELEDPLPLSNQCPIGSYALVIDPVDGSSNIDVNVSVASIFSVQRRNPRATDETSSLLQKGTGQVAAGYVLYGPNTMFVYTSSQGVHGFTLDAGLGEFVLSHPNIRIPERGDYYSINDAYSAEWQPGTRAFIDYLKQAKSRGEKAYSARYIGSLAADVHRTLLTGGIFLYPGTVAKPKGKLRLLYEAQPLALIAEQAGGKASTGTERILDIEPKTLHQRVPLVIGSPYEVDLAVAFARGEKQTVVAGS

SEQ ID NO: 24553 - protein, 124 aa, Thermus thermophilus
  misc_feature (1)..(1): Xaa can be any naturally occurring amino acid
  misc_feature (53)..(53): Xaa can be any naturally occurring amino acid
  misc_feature (80)..(80): Xaa can be any naturally occurring amino acid
  unsure (1)..(124): unsure at all Xaa locations
XEAVKTDRAPAAIGPYAQAVKAGGFVFVSGQIPLAPDGSLVEGDIRVQTERVXENLKAVLEAAGSGLSRVVQTTCFLADXEDFPGFNEVYARYFTPPYPARATVAVKALPRGVRVEVACVALAE

SEQ ID NO: 24554 - protein, 235 aa, Spinacia oleracea
MRSQIYRSATKAARSFLSSSKNASSRFLPEGRTVAATAAVSLRVKAPYLASFGGANASGTWMSTALAIPAAAYLLQDQEACAAEFERTFIAIKPDGVQRGLISEIVARFERKGFKLVAIKVVIPSKDFAQKHYHDLSERPFFNGLCDFLSSGPVVAMVWEGEGVIKYGRKLIGATDPQKSEPGTIRGDLAVVVGRNIIHGSDGPETAKDEIKLWFKPEELVNYTHNAEKWIYGDN

SEQ ID NO: 24555 - protein, 338 aa, Leuconostoc pseudomesenteroides
MEALVLTGTKKLEVENIEQPEVKPNEVLIHTAFAGICGTDHALYAGLPGSADAVPPIVLGHENSGVVAEIGSDVTNVAVGDRVTIDPNIYCGQCKYCRTARPELCENLSAVGVTRNGGFEEYFTAPASVVYQIPDNVSLKSAAVVEPISCAVHGIQLLKVTPYQKALVIGDGFMGELFVQILQAYGIHQVDLAGIVPEKLAMNKEKFGVKNTYNTKDGDKIPEGTYDVVVEAVGLPQTQEAAIEASARGAQVLMFGVGGPDAKFQMNTYEVFQKQLTIQGSFINPNAFEDSLALLSSGKLDVESLMSHELDYQTVDDFVNGKLGVVSKAVVKVGGEEA

SEQ ID NO: 24556 - protein, 396 aa, Marchantia polymorpha
MASMVAASSALGASCSLAAVPSQATTSSNNAAQAVILRSAKLGGRSSSILGQSLAGLSVKSVAHKAVASRSRVASTRAELGDSLEEFLFKNTKNINLRQLMLSMGLAIKKISFKVRTASCGATACVNTFGDEQLAVDMLANKVLFEALLHSHVCKYACSEEEPNLVDMGGPTEGGFSVAFDPLDGSSIVDTNFTVGTIFGVWPGDKLTGVTGREQVAAAMGIYGPRTTYVLCLAEVPGTHEFLLMDDGTWQHVKETTTIGEGKLFSPGNLRATYDNPEYEKLINYYVSEKYTLRYTGGMVPDVNQIIVKEKGIFTNVISPTTKAKLRLLFEVAPLGLLVEKAGGYSSDGKISVLDKVVVNTDDRTQVAYGSRNEIIRFEEALHGTSRVAALVGASA

SEQ ID NO: 24557 - protein, 512 aa, Borrelia burgdorferi
MMNAQAILVLDFGSQYSQLIARRIREIGVYTKVIPYYTPLKEIKNMNISGIILSGSPASVYSKEAPTLDMEIFNLKIPVLGICYGMQIIVKLFGGLVSKDSKQEYGRSEIFLKDEKSLLFSELPNKFQIIMSHGDSIEKIPDNFKQLAFTKNCIASISNETQKIYGLQFHPEVTHSEFGDQILKNFVFKICQAQINWSLEGNLETIVKKIKLKVGSKKVILGLSGGTDSLVCALLIKKAINENLICVFVNTGLLRKNENKKILELKHQYDLNIKYIDASTKFLNRLKNISDPEEKRKIIGKEFVDVFEKITLEDQNIEYLAQGTIYSDVIESKSKDSSSSKIKSHHNVGGLPDKMSLKLLEPLNEFFKDEIIQIGINLGIKKESLYRHPFPGPGLAIRIIGEVTQEKINILQEADNILTEELFINDLYYQIRQAFVVLLPVKSVGVMGDQRTYEYTAVIRCVNTQDFMTAEWTELPYSFLKKVSSRIINEVRGINRVCYDISSKPPSTIEWE

SEQ ID NO: 24558 - protein, 452 aa, Oryza sativa (japonica cultivar-group)
PEICTGNLQQQQHNEIYHLDIYICCNCKKNSFLPLQLFCAHLNQASMLSSGGELKSSSLVQQMVWVGTGNSSSSSIMGSLRQLPCSEEQDAASSPASMLFLPQQLLLHASSNSSPCLNIPEVNLSTGLHPLGSFHGDVQQQEIISGMPDQSWRQLLLGGLVGDHEKYSVATALLSKGLDDEASMPHEASAAAYDFYGHGGGAGDGILQASPEASSCKSQLSQMLLQAAASSPRSCVTTSGLGSSMMDFSNTAAVAPAAEPELTRKHHAGQSDNSSECNSTETGSALKKARVQASSSAQSTLKVRKERLGDRITALHQIVSPFGKTDTASVLQETIGYIRFLLGQIEALSYPYLGQCCSANPMQQQTGIMAGERSTDGLFPEFPAGQDAEKDGKKQQAKKDDDLRSRGLCLVPVSCMPHLAADNDVVVGSDFWAAAGGGGGGGAPPLAGMNLR

SEQ ID NO: 24559 - protein, 75 aa, Glycine max
  misc_feature (17)..(17): Xaa can be any naturally occurring amino acid
  misc_feature (39)..(39): Xaa can be any naturally occurring amino acid
  unsure (1)..(75): unsure at all Xaa locations
TRFTVEKHNKKQNALLXFEKVVHAKQQETYGTLYTITLXANYGRQKKVYESKVCEKACLNLKDVLEFKLVGKAPK

SEQ ID NO: 24560 - protein, 305 aa, Trichodesmium erythraeum IMS101
MSIIIFGSVNIDLIATTPRLPTPGETINGNNFFTAGGGKGANQAVAAAGLGIPTKIVGRVGNDSFGQQLLVSLSTANVDTTDVLVDENTHTGVAVIAVGASGENNIIVVPGANHSINNTDVERLKNLLSDVTALLLQLEIPVEVAISAAKVAQEMGVKVILDPAPMPANFPNDFYNLIDIITPNEIEASQLVGFEVNNQETAMEAAVELCHRGVKNAVVKIGDRGVICATKEEAFFQPAFVVKTIDTVAAGDAFNGGLAAALDTGLSLKEAVKWGAAAGALCTTKPGAQPAMPDRKTFDNFLLKR

SEQ ID NO: 24561 - protein, 579 aa, Ostreococcus tauri
MGDMAPEPARASAPSAAVDAARDAEQRAPRSPAPAPSSANDDGVRPRRYDNWGARSVECYEKLEQIGEGTYGQVSERKRTRAGTGSEGDARVERTRTPNARELDRSTTQRRCDAVYMARCKETMDIVALKKIRMDNEKEGFPITAIREIKILKKLRHRNVVDLKEIVTSKASASNGHKGSIYLVFEYMDHDLTGLAERPGMKFSVPQIKCYMKQLLMGLHYCHNNNILHRDIKGSNLLINNNGVLKLADFGLAKPITNENAQPLTNRVITLWYRPPELLLGATQYGPSVDMWSAGCIFAELIHGKPILPGKSEMEQMDIIFKLCGSPTPENWPDADKLPYAKHFTQKKTYPRRLREVFSQFTPSAKDLLEKFLTLDPAKRISAKDALMHDWFWEVPKPCEPEDLPRYEPSHEYQTKKRRQEAKRAEQQNKRQRMDGHRPPPPMDDQKPASGPDVRPRGHAGPPGGMRPGMPPSGRYGAGGSASGWSSGGQQKQSYAQRSIGRQPTSGYGSIGGGMNRLGGSGGSYSNLNITTGTSGGSYSGYRGGSKTAGWAGGGQKAGSQKAGWANVSKDAKDGERRN

SEQ ID NO: 24562 - protein, 372 aa, Candida albicans SC5314
MVVDLDKYLKPGKDHYLALGLEGSANKLGVGVIKHNKGPLSSTNRAEVLSNIRDTYITPPGEGFLPRDTARHHRNWVVRIIKQALATAKIAGKDIDVICFTQGPGMGAPLQSVVIAARTLAQLWNIPIVGVNHCVGHIEMGREITGAENPVVLYVSGGNTQVIAYSKQRYRIFGETLDIAIGNCLDRFARTLKIPNEPAPGYNIEQMAKKGKHLVPLPYTVKGMDLSMSGILAAIDSIAKEMFGKQQKKLIDEESGEPITAEDLCFSLQETLFSMLVEITERALAHVDSNQVLIVGGVGSNQRLQEMMKLMIQDRKNGQIYATDERFCIDNGIMIAHAGLLSYRTGQTNQLNNTVCTQRFRTDEVFVKWRDD

SEQ ID NO: 24563 - protein, 296 aa, Tolypocladium inflatum
MPYVSAARYGKDNVRVLKVTRDAATGVQHVTEMTVCCLLEGDIDASYTEADNSVVVATDSIKNTIFILAKQHPVTPPELFAAILGSHFVQKYSHIHVANVTVVTHRWVRMDVDGKPHPHSFIKDAGETRNVEARVSRKDGIALTSAIAGLTVLKSTGSAFHGFVRDEFTTLAETWDRILSTDVDASCKWKTFADVKAVEETAPKFDKAWEAARNITLKLFAEDDSASVQNTMYKMCEQILDAVPDTESVAYSLPNKHNFELDLSWHNGLKNTGEDAEVYVPQTSPNGLIKCEVSRS

SEQ ID NO: 24564 - protein, 272 aa, Oryza sativa
  misc_feature (154)..(154): Xaa can be any naturally occurring amino acid
  unsure (1)..(272): unsure at all Xaa locations
MDAGDAWGRSSSSSSSAAAAARRLQARYDLYMGFDDADAAGVEEVEARGGGEAYNCPFCGEDFDFVAFCCHVDDEHAVEAKSGVCPICATRVGVDLIGHLTMQHGSYFKISFFLLYNAGNEHMQFYIFTSYSVEDTWHYWYLGKQLHMAFLNEXYMQRRRRVRKISSGSHSLLSLLRKDLRDGSLQSFLGGSSYVSNPPAAAPDPFLSSLICSLPVAEPSKDLHSDSSDNNFLLNKFPDDKTAERYVTSSFALSAASLRSLFATIPLYLVSG

SEQ ID NO: 24565 - protein, 249 aa, Beta vulgaris
MEFPTQTMEGSPSSQRKMGRGKIEIKRIENTTNRQVTFCKRRNGLLKKAYELSVLCDAEVALIVFSSRGRLYEYANHSCSVKGTIDRYKKACSDQSGAGSVAEANAQYYQQEAAKLRNQIRTATENNRLLSRHMMGEGLSSLSMKELKNLETKLERGISRIRSKKNELLFAEIEFMQKREIELHNNNQFLRARISENERAQQSMSLMPGGSDYDLVPSQSFDSRNYFQVNALQPSSQYARQDQTPLQLV

SEQ ID NO: 24566 - protein, 312 aa, Prochlorococcus marinus str. MIT 9312
MNSVIFQETAKLKKPVPAEKVIELSEKLVEPSRHSKKYPPRLHKTWGTIVFMVAIHILSLIALQPKFWSLPAVTSLLFFYWVTACLGVTLGYHRLLSHRSFIVPRWLERFFATCGAISCQHGPIDWVGLHRHHHSFSDTEVDHHNSKKGFWWSHMGWMFKDVEALKAVPKLSADLIKDPYYRFLNKYFLFLQIPIGLSLFAIGQKLGVGGWALVLWGIPLRLVVVYHITWLVNSATHCWGKAPFESGDSSKNNAWVAALTFGEGWHNNHHAFPNSAKQGLFRGQIDITWEHIKILAKFGLAKKVKLPSRSYY

SEQ ID NO: 24567 - protein, 198 aa, Platanus x acerifolia
LGALLEEREGRLSDEEIVDYLVALLVGGYETTSTTMTLAVKFLTDTPLALAQLKKEHDEIMARKQNEALQWSDYKSMPFTQCVINETLRVANIVSGVFRRAIKDVNIKGYTIPKGWKVFASFRAVHMDQHHYKEARTFNPWRWQQEASPTTPAENVFTPFGGGPRLCPGYELAGVEISIFLHHLVTMFSWVPAGEDRL

SEQ ID NO: 24568 - protein, 302 aa, Isaria tenuipes
MPSVTAARYGKDNVRLFKTHRDPNTGVHSVTETVVCVLLEGDIESSYTRADNSVVVATDSMKNTVFVLAKQHPVTPPELFAATVGAHFVDTYPHIHVAAVRVVTTRWARIRVDGRPHPHSFVKESEEKRTVAARASRRAGIAINSGIADLTVLKSTGSAFHGFIRDEFTTLPETWDRIMSTDVDASWDWAVFPDLAAVRAAATRFDAAHEAARDITLRRFANDNSASVQATMYKMSEDILAAVPQVSKVYYSLPNKHYFELDLSWHKGIKNTGKDAEVYVPQSNPNGLIKVEVSRDDPTSKL

SEQ ID NO: 24569 - protein, 715 aa, Streptomyces coelicolor A3(2)
MTRARPNWKGSPVWSGHPYPLGAAYDGQGTNFALFSEVAERVDLVLVDDDGNHSTVPLPDVDGFVWHCYLPGVGPGQRYGYRVHGPWAPAVGHRCNPAKLLLDPYTRAVDGLVDNHASLFERARGKADPGDSAGHTMLGVVTDPFFDWGDDRPPRRPYSESVIYEAHVRGLSRTHPDVPEELRGTYAGLAHPAVVDHLTSLGVTAVELMPVHQFVHDGVLLDRGLSNYWGYNTIGFFAPHNGYAALGTRGQQVSEFKSMVKTLHEAGLEVILDVVYNHTAEGNERGPTLSFRGIDNASYYRLVDGDWQHYYDTTGTGNSLLMRHPYVLQLIMDSLRYWVTEMHVDGFRFDLAATLARQFHEVDRLSAFFDLIQQDPVISRVKLIAEPWDVGEGGYQVGNFPQLWSEWNGKYRDAVRDFWRAEDHSLGEFASRLTGSSDLYQHSRRRPRASVNFVTAHDGFTLRDLVSYNDKHNEANGEDNRDGESHNRSWNCGAEGGTKDPAVRELRGRQQRNFLATLLLSQGIPMICHGDELGRTQRGNNNAYCQDNEISWIDWRLDGEQRALLDFARRLIALRADHPVLRRRRFFHGETLTHADQPLPDLVWLLPDAREMTDDDWQRSDAHTVGVFLNGDAIAEPDPRGRPVVDDSFLLLLNSHWEPADFRLPDAGYGERWTALVDTADPDGVPDEAEHKAGTRLTVEQRSLVLLSRPSRTGR

SEQ ID NO: 24570 - protein, 230 aa, Edwardsiella tarda
HNMRIPGSLRPDKRRRIARETLEIYSPLAHRLGIHHLKTELEELGFEALYPNRYRVIKEVVKAARGNRKEMIQKILAEIDGRLTEAGMACQVNGREKHLYSIYRKMHLKEQRFHSIMDIYAFRVIVKDVDTCYRVLGQVHSLYKPRPGRVKDYIAIPKANGYQSLHTSLIGPHGVPVEVQIRTEDMDQMAEMGVAAHWAYKEGESSTTAQIRAQRWMQSLLELQQSAGNS

SEQ ID NO: 24571 - protein, 414 aa, Triticum aestivum
  misc_feature (102)..(102): Xaa can be any naturally occurring amino acid
  misc_feature (113)..(113): Xaa can be any naturally occurring amino acid
  unsure (1)..(414): unsure at all Xaa locations
DGNCFSADPEHQHEANYCQQPYEGRRSGKDFGLVVTIVGIVLIVLVLSLLLVASNKRNCQRVTAEQQLLQKQMQDNSTPGMSSELLESARYISQAVKFGSQXMPTHRVFSLEXLKEATKCFERSAFLGEGSIGKLYKGKLENGTVIAIRCLALHQRYSIRNLKLRLHLLAKLRHPNLVCLLGHCIDNAVDESSVKRVFLVYEYVPNGTLSSYLSGSTPEKTLKWCDRLHVLIGIARAVHFLHTGIIPGSLYNRLKTSNILLDEHHIAKLSDYGLSMITEEIYKHEAIGEGQRYIQNNAEELETLQDDVCSFGCIILEALMGSKLHRKGDPFILSELVMSLSCQEEREHVLDPVVLGTSSQDSLSMVVSITIKCLSVESSTRPSIEEVLWNLQYAAQVQATADGDLRSEVSSQAC

SEQ ID NO: 24572 - protein, 349 aa, Leuconostoc mesenteroides subsp. mesenteroides ATCC 8293
MKAAVWHGVKDVRVEDVELKPTKSNEVVVRVAYAGICGSDLHEYLEGPVFIPVDQPDELTGGQAPLTMGHEFSGVIEKVGPDVANFKVGDHVSINPTVTKGISSDDLDVYDGYSFIGLSTDGGFTSYVNVPEDNLYHLPEEFSLKLAATIEPTAVAVQAIKEADLRFGEKVVIFGAGPIGVLVAAAAKAAGATKIVAVDLSEIRLRKALEMGATDVINPSQVPDTVAAIKNIIPGGADASFEVAGVQPTFEQAIDATRPRGSVVIVSIFAKPISFNPMQLMNAGVKLTTTIAYSKETFQQTVALVSSGQINVEPVITDTISLDSIVSDGFESLTSDKSQAKILIDLSKD

SEQ ID NO: 24573 - protein, 459 aa, Prochlorococcus marinus str. MIT 9312
MIKKILEFQFDLIVVGAGSGGLAAAKRAASYGAKVAIIEVNKIGGTCVIRGCVPKKLMVYAAKSKKNMDSSEGYGLKSEGISFESDILLKNVREEVSRLSDLHRNSLNKLDVTVFEGLGRFTAQNELEIICPKTKKIINKISSKKILISVGGKPKKLNIPGMDLAWTSDDIFELENFPKSILIVGGGYIACEFASIFRNLGTEVTQLIRGQRLLNGFDEDLSSCLEESPTFTGINIIFNTQLKSIRRVNGNLESTLDSGEKILTNNILIATGREPNLIPLNLDFLNLKMDGQYLDVNELNQTSNANIFAVGDIINRPNLTPVAIEQGRVFSDNFFNDQKRKVNYENIPKAVFTIPEISTVGLSEKRAKEVYSEKNIKIFKCKFTPMSNTFKEKKTKCMLKIVVNSITDKVLGCHMFGETSSEIIQMVSIALNAGITKKDFDTTMALHPTISEEFVTMYG

SEQ ID NO: 24574 - protein, 187 aa, Brassica napus
MSSSSPSGSGGDDLSERRGIPAAKFIQDVETYLSQSGFDSNSALAFHQERLQQYKVVEMKLLAQQRDLQAKIPDIEKCLEVVATLEARKGTGESLLADFEVSEGIYSRACIEDTDSVCLWLGANATALLRNNLENAKASLEVLVADLQFLRDQVTVTQVTIARIYNYDVHQRRVKQVTPTAIAAADA

SEQ ID NO: 24575 - protein, 257 aa, Brassica napus
MFPSSKNILYQNLLVVYSLFLCAFEGEKKMKAPNMETITKSLENISFNDRRRRAGDGFGRSSSRTEESSNEHIPPISDRTLELNSHLSLPSHWEQCLDLKTGEIYYINWKNGMRVKEDPRKVMINADSDSGESYGTLCSEEDSSYYDSEESSSASSPSSNENQKEDEDEDDEDKDEEDEGEEEDVIVVAGCKACFMYFMVPKLVEDCPKCAAQLVHFDRPHSCFFLKRLSLFPLFFIFLLMRICLGFLFLSLILYLL

SEQ ID NO: 24576 - protein, 309 aa, Ginkgo biloba
  misc_feature (129)..(129): Xaa can be any naturally occurring amino acid
  unsure (1)..(309): unsure at all Xaa locations
MASDGVVTVYGDGAITDTKVSSYAVKVGLAQMLRGGVIMDVVNAEQARIAEEAGATAVMALERVPADIRAQGGVARMSDPGLIKEIKSAVTIPVMAKARIGHFVEAQILEAIGIDYIDESEVLTPADDXHHINKHNFRIPFVCGCRNLGEALRRIAEGAAMIRTKGEAGTGNVIEAVRHVRSVLGDIRKLQSLDDDEVFAFAKQIAAPYELVRQTKQLGRLPVVNFAAGGVATPADAALMMQLGCDGVFVGSGVFKSGDPARRARAIVQAVTHYNDPHILAEVSCSLGEAMVGINLKDEKVERYAERSE

SEQ ID NO: 24577 - protein, 401 aa, Leuconostoc mesenteroides subsp. mesenteroides ATCC 8293
MEKENVMTKPINHQVIKTEASGIRLVLDLVKKPADQMIELTVGEIDLPTPAATKEAGKQAISNNVTKYTENMGFLSLRRVISDYIKKFYEVSYSPESEILVTVGASQGIDLTVRALIDAGDEVLLIGPAYPAYIQAVVLAGAIPVVVDTRSTHFRLSPEQLGSAISSKTKLVILNYPNNPTGIVLSKEELSSLASVIQQNDLYVLTDDVYQRLTYDQDCAPSIASASLMKERTIIVNGLSKSHSMTGWRIGYLAGPKVLIQEIYKIQQANVGCASSISQMAALTALTTDIEAPKTYIRVFRKRRDYVLQRLDEMSLNYTKPDGAFYVFIDVKAFGMSSWDFVAFTINESDLVLVHGSAFTEAGEGYVRLSFANEMQVLVEAMNRLEKTVDVLTTKKSAHLS

SEQ ID NO: 24578 - protein, 312 aa, Phaseolus vulgaris
MEGEGSRVVALYDGNGAITETKKSPFSVKVGLAQMLRGGVIMDVVNADQARIAEEAGACAVMALERVPADIRAQGGVARMSDPQLIKEIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKSIAAPYDLVMQTKQLGRLPVVHFAAGGVATPADAALMMQLGCDGVFVGSGVFKSGDPAKRARAIVQAVTHYSDPEILAEVSCGLGEAMVGINLSDTNVERFANRSE

SEQ ID NO: 24579 - protein, 511 aa, Oryza sativa
  misc_feature (339)..(339): Xaa can be any naturally occurring amino acid
  misc_feature (477)..(477): Xaa can be any naturally occurring amino acid
  unsure (1)..(511): unsure at all Xaa locations
MGGFEDDEPPSKRARASSVEPASLLDSFSCLKPAAPLGSTMARPLPSQGKEVMVGSKGVIKRDEFVRIITKALYSLGYEKSGAVLEEESGITLHSPTVNLFRRQVLDGNWDSAVVTLKKVGLLDENIVKSAIFLILEQKFLELLRNDNVMGAIRTLQSEITPLGVNKKRVHELSGCIISSPQHVLLGFSKLGIESSNSRLKLLEELQKVLPPTVMVPERRLENLLEQALTVQREACYFHNSIDGLSLYTDHHCGKDQLPSCTVQVLRAHRDEVWFLQFSNNGKYLASASNDKSAIIWKVDEDGELLLKHTLTGHDKPVMMVAWSPDDCQLLTCGMEEVXRCWDVESGKCLHVYEKSGIGLISCGWFPDGKHILSGLTDHNFCLWDLDGKEVDCWKGQRSSKTSDFAVSNDGKLIISMNRESTIRLFDRETKQERLIEEDNTITSFSLSEDGDFLLVNLISEAIHLWNIRNCPIRVNXRYAGHKRSRFVIRSCFGGSEQAFIASGSEDSQVW

SEQ ID NO: 24580 - protein, 297 aa, Burkholderia sp. 383
MNTRFEGIWLPIITPFHHGEVDHAALARLARHYAAAGIAGFVAGATTGEGVLLDAREQDAVFATLRDAAPGLPIVVGLTASATHFAAARARELAALRPDGLLVTPPVYVRPTQDGIRRHVEAIVDAADLPVLVYNIPYRTGVNVELETLQALARDPRVAGIKECGGSLDRMSRLVHDTPLAILSGDDNQNFAAMCTGAHGAIASSAHVLPEWHVRIHALLRDGRLADARRLSVALQPLVAALFAEPNPAPVKAVLAAQGWCEDGLRLPFVPASEGLRARLAAICAELETPTQAVAAA

SEQ ID NO: 24581 - protein, 255 aa, Klebsiella pneumoniae
MRHPLVMGNWKLNGSRHMVNELVANLRTELAGVSGCAVAIAPPEMYLDLAKRAAEGSHIHLGAQNVDVNLSGAFTGETSAEMLKDIGAQYIIIGHSERRTYHKESDELIAKKFAVLKEQGLTPVLCIGETEAENEAGKTEEVCARQIDAVLKTQGAAVFEGVVIAYEPVWAIGTGKSATPAQAQAVHKFIRDHIAKADAKIAEQVIIQYGGSVNAGNAAELFTQPDIDGALVGGASLKADAFAVIVKAAEAAKKA

SEQ ID NO: 24582 - protein, 474 aa, Oryza sativa (japonica cultivar-group)
MTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEACAFSIHNLLQAGKSYGLAAGSWVGPYAMCRAWQTLVCTNREHHEAVDGNGNFPMALYVVSGDEDGERGGAPVVCIDVAAQLCCDFNKNQSTWSPILLLVPLVLGLDKLNPRYIPLLKETLTFPQSLGILGGKPGTSTYIAGVQDDRALYLDPHEVQLAVDIAADNLEAGTSSYHCSTVRDLALDLIDPSLAIGFYCRDKDDFDDFCSRASELVDKANGAPLFTVVQSVQPSKQMYNEESSSGDGMDSINVEGLDGSGETGEEEWQIL

SEQ ID NO: 24583 - protein, 505 aa, Oryza sativa (japonica cultivar-group)
MTSLPGRGVSPSSSDPLCEGNAAPSSSSSSGQDLKQLKNSILSCVFSSPFSIFEAHQDSSANRSLKPHSGSYAWSRFLRRIACTGSMWRFLGASKALTSSDVWFLGKCYKLSSEELSNSSDCESGNAAFLEDFSSRIWITYRKGFDAISDSKYTSDVNWGCMVRSSQMLVAQALIFHHLGRSWRKPSQKPYSPEYIGILHMFGDSEACAFSIHNLLQAGKSYGLAAGSWVGPYAMCRAWQTLVCTNREHHEAVDGNGNFPMALYVVSGDEDGERGGAPVVCIDVAAQLCCDFNKNQSTWSPILLLVPLVLGLDKLNPRYIPLLKETLTFPQSLGILGGKPGTSTYIAGVQDDRALYLDPHEVQLAVDIAADNLEAGTSSYHCSTVRDLALDLIDPSLAIGFYCRDKGELLLPDKMLGHHLSSLQSWFSYLLCLSAYVDDFDDFCSRASELVDKANGAPLFTVVQSVQPSKQMYNEESSSGDGMDSINVEGLDGSGETGEEEWQIL

SEQ ID NO: 24584 - protein, 173 aa, Gibberella zeae PH-1
MWSNCKVTCTDLAFQVVAVLPSPLRSILSLSPSRNTAHRALSVPTEPISTTSNIIQEMSSRGGKLAPEVNRALFVKNLSYNVTPEELFDLFGKFGPIRQVRQGIANNTKGTAFVVYEDVTDAKQACDKLNGFNFQNRYLVVLYHQPDKMAKSKEDLEARRESLAQLKQQHGID

SEQ ID NO: 24585 - protein, 180 aa, Prochlorococcus marinus str. MIT 9211
MNEETQTSELTNTDQGPQIEPGPISKWLNQKGLIHKLLEPDEIGIENLGVDPQQLFKIVSELKMNGFNYLQCQGGYDEGPGLSLVCFYHLMEMKDFNEGDKPREVRLKVFLDRNGSLRVPSLYKLFRGCDWQERETYDMFGINFDGHPHPKRLLMPEDWRGWPLRKDYIQPDFYEMQDAY

SEQ ID NO: 24586 - protein, 844 aa, Pichia pastoris
MTFPLLPAYASVAEFDNSLSLVGKAVFPYAADQLHNLIKFTQSTELQVNVQVESSVTEDQFEELIDNLLKLYNNGINEVILDLDLAERVVQRMIPGARVIYRTLVDKVASLPANASIAVPFSSPLGDLKSFTNGGSRTVYAFSETAKLVDVTSTVASGIIPIIDARQLTTEYELSEDVKKFPVSEILLASLTTDRPDGLFTTLVADSSNYSLGLVYSSKKSIPEAIRTQTGVYQSRRHGLWYKGATSGATQKLLGIELDCDGDCLKFVVEQTGVGFCHLERTSCFGQSKGLRAMEATLWDRKSNAPEGSYTKRLFDDEVLLNAKIREEADELAEAKSKEDIAWECADLFYFALVRCAKYGVTLDEVERNLDMKSLKVTRRKGDAKPGYTKEQPKEESKPKEVPSEGRIELCKIDVSKASSQEIEDALRRPIQKTEQIMELVKPIVDNVRQNGDKALLELTAKFDGVALKTPVLEAPFPEELMQLPDNVKRAIDLSIDNVRKFHEAQLTETLQVETCPGVVCSRFARPIEKVGLYIPGGTAILPSTSLMLGVPAKVAGCKEIVFASPPKKDGTLTPEVIYVAHKVGAKCIVLAGGAQAVAAMAYGTETVPKCDKIFGPGNQFVTAAKMMVQNDTSALCSIDMPAGPSEVLVIADKYADPDFVASDLLSQAEHGIDSQVILLAVDMTDKELARIEDAVHNQAVQLPRVEIVRKCIAHSTTLSVATYEQALEMSNQYAPEHLILQIENASSYVDQVQHAGSVFVGAYSPESCGDYSSGTNHTLPTYGYARQYSGVNTATFQKFITSQDVTPEGLKHIGQAVMDLAAVEGLDAHRNAVKVRMEKLGLI

SEQ ID NO: 24587 - protein, 354 aa, Staphylococcus aureus subsp. aureus Mu50
MKNLVLLGGGYGNMRIMSRILTTSLPQDYTVTLVDRMPFHGLKPEFYALAAGTKSDKDVRMKFPNHPQVNTVYGEINDIDLDAQIVSVGNSKIDYDELIIGLGCEDKYHNVPGAEEYTHSIQTLSKARDTFHSISELPEGAKVGIVGAGLSGIELASELRESRSDLEIYLYDRGPRILRNFPEKLSKYVAKWFAKNNVTVVPNSNINKVEPGKIYNCDEPKDIDLVVWTAGIQPVEVVRNLPIDINSNGRVIVNQYHQVPTYRNVYVVGDCADLPHAPSAQLAEVQGDQIADVLKKQWLNEPLPDKMPELKVQGIVGSLGDKQGFAYIMDRTVTGRLASILKSGVLWLYKYHNG

SEQ ID NO: 24588 - protein, 811 aa, Oryza sativa (japonica cultivar-group)
MFGRMRCLVGGGVEDSPRGAVRRVSPALRRVHNANASAAAAAGAEGKSGLPFRSPDVMETVHEVAIYIHRFHNLDLFQQGWYQMKISATWEEGGSKTPASPARVVQYEASDVGADDALGIWKIDDADNSFYTQPFRIKYARQDIYLSVMVSFNIFNSEEEGPAASSVILKFELIYAPTLENGSDIQASSATSSAAVHEFRVPRRALLGSHSYCPVHFDAFHSVLVDLTLHIVYLKAGATKSSLKIPDQGLGPTSHHIVKALLTSREMLLEELKKISDAIGKTVEDLDVADLSLGKYEAVQPAKSGLPNSNKVFPATTKGVGHLAGILHDFLEKPNSAVDGANDAMLYTLPKEELLELFLTVSSQLSLLWNAFLKFHRINKTKILDYLRDIWALDRKSEWSIWTVHSKIEIPHRYLRSTDDESSHRHSLLRVSGSRKFHDDPVQNSASRAELHRKSIAQMKINTLSVQDMQIYADPSRVPVVLIEQHVMVVPQHGSSKDLATNSSEQKDTIVLPKLQGDSLALKSSAGKKGRILRAVIFVHGFQGHHLDLRLVRNQWLLLDPGAECLMSEANEDKTSGDFKEMGGRLAGEVVAFLKKKVDKLAKYGGCKELKLSFVGHSIGNVIIRTALAEPALQPYLKNLYTYMSISGPHLGYWYSSNSLFNSGLWLLKKLKGAQCIHQLTFSDDQDPQNTFFYKLCKLKTLENFKNIILLSSPQDGYVPYHSARIELCPAASSDNSRKGQVFTEMLNNCLDQMRAPTSETRIFMRCDVNFDQSAQGRNLNTMIGRAAHIEFLETDIYAKFIMWSFPELFR

SEQ ID NO: 24589 - protein, 267 aa, Bradyrhizobium sp. BTAi1
MSDHQRFAVVTGASSGIGVAYAERLAARGYYLILVARRRERLEETARNIRAKTNVTVEIVTADLGDSNDLSRVATLIEGREDIDLLVNNAGLGALGLTAQVSAAALDNLIKINVQALTRLTHAALPGFLRRDRGTIINIASIIALMPTPTGAGYSGSKAYVLNFTRSLQMELANTKVKVQAVLPGPVRTEFFEASGLKQAPFPDELFMTSEELVDTALTALDQDELICLPALQDLSAWTAYEAARGELIRALTQSGRPAARYAKRVG

SEQ ID NO: 24590 - protein, 219 aa, Prochlorococcus marinus str. MIT 9312
MTYSTNFSIEDLSFDNYGLIPAVAQDWLDGSILMLAWMNKESLTMTLETNNVHYWSRSRSEIWRKGATSGSTQILKDIRFDCDNDSLILLIEQNGSGACHTGEKSCFFNEIQINQNNKKEKKTTPFSNICSELFHTINERSINPSDKSYTNHLLKKGSNTILKKIGEESAEFIMACKDNNKDSISNEAADLIYHLQVALMHKGVEWRDVLAVLESRRKN

SEQ ID NO: 24591 - protein, 296 aa, Bradyrhizobium japonicum
MAAKTKFRGSFTALVTPFKNGSLDEAAFRSLVNWQISEGTNGLVPVGTTGESPTLSHDEHKKVVEWCIEEAKGRVPVVAGAGSNSTKEAIELAQHAEKAGADAVLVVTPYYNKPTQEGMYQHFKAINDAIGIPIIIYNIPPRSVIDMSVDTMKRLWELKNIAGVKDATASMVRVSQQRAAMGEDFNQLSGEVATILGYMAQCGHGCISVTSNVAPRLCSEFHTAWQKGDQRTALKLHDKLMPVHNNLFIESNPAPIKYAMSLLGKLDETLRLPMVPVTEPTRVAVRSAMVHAGLIN

SEQ ID NO: 24592 - protein, 429 aa, Geobacillus stearothermophilus
MELFKYMETYDYEQVLFCQDKESGLKAIIAIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEVVARAVEEFGAKAVDPNDIYGVECDIFAPCALGGIINDQTIPQLKAKVIAGSADNQLKEPRHGDIIHEMGIVYAPDYVINAGGVINVADELYGYNRERAMKKIEQIYDNIEKVFAIAKRDNIPTYVAADRMAEERIETMRKAASQFLQNGHHILSRRPRPLTAARAGLRRADDGGTTTMQEQKFRILTINPGSTSTKIGVFENERAIASKKRSATRAGASAI

SEQ ID NO: 24593 - protein, 377 aa, Deinococcus radiodurans
MSNIAKGLEGVLFTESKLTFINGSEGILTHLGIPIQEWAEKSTFEELSLALLDAKLPTAEELAKFDAELKANRAIPDQLVGIIRDMPKGVHPMQALRTAVSYLGLLDPQAEDITPEARRAISTRMIAQFSTIIAAINRAQEGQDIVAPRADLTHAGNFLYMLTGNEPTPEQARLFDIALVLHADHGMNASTFTAIATSSTLSDMYSCMVSAIGALKGPLHGGANEAVMTMLDEIGTVDKAEAYITGKLDNKEKIMGVGHRVYKYFDPRSRVLRDYAEHVANKEGKSNYYQILEAIEKIIVDRMGAKGIYPNVDFYSGTVYSDLGIKKEYFTPIFALARISGWCASVIEYSQDNRLLRPDAEYTGARDQHYVDIKDRQ

SEQ ID NO: 24594 - protein, 283 aa, Prochlorococcus marinus str. MIT 9312
MTHISTWIDEYHKGSRFGLNGEILIKQNSKYQEIIVIENEYYGRALMLDGCWMTSLKDEKYYHECLVHPALSSIDEKSNVLIIGGGDGGTARECVKYPQISKIDLVEIDEEVIKISKKFLKEIGGEAWSDKRLKIHIDDGVQWVKKTRDNFYDVIFIDCSDPSELSNLLFSDSFYRECKRILTKNGILATQSESPESFKNIHISILKTLKKFFRVSETMYSFVPIYPSGIWSWTFASEEVLHLSKRNCNEALRIEKSCEIWNLNFQNAAFKMMPNKIVKELNS

SEQ ID NO: 24595 - protein, 273 aa, Pseudomonas fluorescens Pf-5
MDQYVVFGNPIGHSKSPLIHRLFAQQTGQQLEYNTLLAPLDDFTGTARSFFAHGRGANVTVPFKEEAYRLCDSLTERAQRAGAVNTLSKQADGRLLGDNTDGAGLVRDLKVNAGVSLKGKRILVLGAGGAVRGALEPLLAEQPEALVIANRTVEKAELLAELFADLGPVSASGFDWLQESVDLIINATSASLSGELPPIAGSLIEAGKTVCYDMMYAKEPTPFCRWASEQGAALVLDGLGMLAEQAAEAFYLWRGVRPDSGPVLAELRRQLAQ

SEQ ID NO: 24596 - protein, 308 aa, Arabidopsis thaliana
MEMEKNQHISSLDIPVIDLSNPDEELVASAVVKASQEWGIFQVVNHGIPTELILRLLQVGMEFFELPETEKEAVAKPEDSLDIEGYRTKYQKDLEGRNAWVDHLFHRIWPPSRVNHKFWPKNPPEYIEVNEEYASHIKKLSEKIMEWLSEGLGLRHEALKEGLGGETIEYLMKINYYPPCPDPELVVGAPDHTDVNGITLLVANEALGLQAFKDNQWIDAEYTTSGIIVIIGDQFLRMSNGKYKSVEHRAKMDKEKTRISWPVFVESSLDQVFGPLPELITGDENVPKFKPYVYKDYKFRKLKKLLLD

SEQ ID NO: 24597 - protein, 568 aa, Oryza sativa
MASSALICDTEQWKGLQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLQWSGLSLLLGPDAVAKHMIAVSTNLELVEKFGIDPKNAFAFWDWVGGRYSVCSAVGVLPLSLQYGFPIVQKFLEGAASIDKHFRSSSFEKNIPVLLGLLSVWNVSFLGYPARAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 24598 - protein, 402 aa, Staphylococcus aureus subsp. aureus Mu50
MAQDRKKVLVLGAGYAGLQTVTKLQKAISTEEAEITLINKNEYHYEATWLHEASAGTLNYEDVLYPVESVLKKDKVNFVQAEVTKIDRDAKKVETNQGIYDFDILVVALGFVSETFGIEGMKDHAFQIENVITARELSRHIEDKFANYAASKEKDDNDLSILVGGAGFTGVEFLGELTDRIPELCSKYGVDQNKVKITCVEAAPKMLPMFSEELVNHAVSYLEDRGVEFKIATPIVACNEKGFVVEVDGEKQQLNAGTSVWAAGVRGSKLMEESFEGVKRGRIVTKQDLTINGYDNIFVIGDCSAFIPAGEERPLPTTAQIAMQQGESVAKNIKRILNGESTEEFEYVDRGTVCSLGSHDGVGMVFGKPIAGKKAAFMKKVIDTRAVFKIGGIGLAFKKGKF

SEQ ID NO: 24599 - protein, 208 aa, Prochlorococcus marinus str. MIT 9211
MSLQRTGEVHRVTKETNVTVRLGLDGKGKCKISTGVAFLDHMLQQLSSHGLFDLEVIAKGDTHIDDHHTNEDVGIAIGQALSESLGERQGINRFGHFSAPLDEALVQVVLDCSGRPHLSYGLNIPSQRIGSYETELVKEFFIAVVNNSGLTLHIRQLDGTNSHHIVEACFKAFARALRLATELDPRRGDAIPSSKGVLEQAGSKPKQI

SEQ ID NO: 24600 - protein, 206 aa, Ostreococcus tauri
MSQNVSARARDLRRNQIMSEGLPREEVERMLFFEDARQRAEIEHQQNPRDAQVLTRWGGALLELAHFRQGPEAVDMIEDAVEKFEQALAINPKKHDALWCLGNALTSQGFLFPDAREAMRYFEEAKSCFRRALAEEPTNEIYKKALEMTDKAPGLHAELQRYSYGAAGKGEGESDFWWDVAGWCTFGLIAASWVVMAQMQAPVGQP

SEQ ID NO: 24601 - protein, 628 aa, Campylobacter coli RM2228
MRYLTTPIYYVNDVPHLGHAYTTIIADTLARFYRLQGHETRLLTGTDEHGQKIEQAAKIRNSTPKEYADKISSEFKKLWDEFEITYDIYARTTDTRHVEFVKAMFLKMWQKGDIYKDEYEGHYCISCESFFAKSQLINECGCPDCGKDTSLLKEESYFFKLSKYQDKILQWYDKEDPILPKNKKNELINFVQSGLKDLSITRTSFDWGIEIPEEIKDDKHIIYVWLDALFIYISSLDYQSQGENAKFWPAHIHLVGKDILRFHAIYWPAFLMSVDLPLPKFIGAHGWWTKEGEKMSKSKGNVVKPKEVVDAYGLEAFRYFLLREVPFGNDGDFSESVLINRINTELGNEFGNLLNRIIGMSIKYNQGNISQEGVLEFYKNELDTAKEHLNNAINFLENLQCNRYLEELFKALSVANLAISKYEPWNLIKANKIKEANALIGLCANILAKTSLLLSPTLPKSCQKVGLALNFEISPTNYQKLILQNELLDFKASACEALFPKIEKPLLSQEEKQEVKKEEKPKIKIDDFAKIEIKVAKVIDCQNIEGSEKLLKFKLELDNKEIRQVLSGIAKYYKASDLIGKQVCVISNLKKAKIFGHESDGMILSAKSGDKLVLISPEQLVENGSLVG

SEQ ID NO: 24602 - protein, 343 aa, Kineococcus radiotolerans SRS30216
MRVGILTGGGDCPGLNAVIRAAVLAGTQRHGMEFVGFLDGWRGVLEGDTVPLDEAAVRPLLTTGGTILGSSRTNPLADGVEEGVARVRERLGALGVDALLVIGGEDTLGVATALHAAGVPVVGAPKTIDDDLSATDATFGFDTAVQTAVDACDRLATTGASHHRVMIVEVMGRHAGWIALHTGMAAGAHVTLLPEEAVDLDAVAGTVRAVLARGGAPLVVVSEGADVHGGPAGEDAPRDAFGHVRLRGAGEALEQELLARVPGVSTRVTVLGHLLRGGTPSAADRILATRFGLSAVEALASGDLGTMASLHGVEVSQVPLSEATGVLRTVPGARRAETAGIRW

SEQ ID NO: 24603 - protein, 176 aa, Oryza sativa (japonica cultivar-group)
MVSSQSEDELVSLLQSLADMDITYKALQETDIGRHVNGLRKHPSGEVRQLVKLLVRKWKEIVDDWVRLHNSGGDGGSSVLTDGDSPDKIQGRSYQNAQVSDFKYSPSPQRHNGLSSERSSNNNGVESMIEKRRTSPAPTYHNNKQNNSIGYSTTSSSAPVVRLIISSSYFVKPISY

SEQ ID NO: 24604 - protein, 323 aa, Vibrio cholerae O1 biovar eltor str. N16961
MNALVRLSSNHILRSDSMSRVWLTGDAVVDLIPDGQQHYLKCPGGAPANVAVAIARLCGRSAFFGRVGNDPFGRFMQQTLTDEQVDCQHLYFDPVHRTSTVVVDLDEHGERSFTFMVKPSADQFLQLSDIPSFQNGEWLHVCSIALANQPSRSSTFAAIAQMKEVGGYVSFDPNLREEVWSEPQELQATVMRAVGLADVVKFSEEELQFLTGTQSIEEGLQAIADFQIPLVVVTLGAKGALVVTPNSRQIVSGKAVKPIDTTGAGDAFVGGLLYRLSVAQDWHNQATILDAVKWANGCGALATTQKGAMTALPNQAALYAFLE

SEQ ID NO: 24605 - protein, 428 aa, Leuconostoc mesenteroides subsp. mesenteroides ATCC 8293
MMTPKHNRIMDHGLAGIQHVFVSNVWLDPIYVAAAAGLSLNLSTNLVNTIFIVSGLVTLTQATKLAKLPIVQGPSAAFDALMINAGKAGQLATASGSILLSALIVFLLSVTGLINKLIKLLTPAITGTLIFLVGISLSGFTLSEFLGGYPGDKGFSSPTTLILSVTTATIVILLSIFGKGFWKRFSFLIALIVGDILAVSLGVVDYSVLSTKSWFGMPHLLPYGSLKFNWVMFLTFFVAYVVAVVEALGVYQAAGDTLKENISPRRIQNGLIGESAGSMFSSLFGGFPTTAFAQNVGILNLTGNVSRIPVIIAGILFVVLGFVPKIGAFLAITPSPVIGGIFLPAATTLILTGFNILKRAPDNNENNMIIGLSIILAIALPNYATGWSGVTGELLSNSILVGALSAIILQFALVNLPRMIKNIRGSHD

SEQ ID NO: 24606 - protein, 518 aa, Fulvimarina pelagi HTCC2506
MTALPDTVLIVDFGSQVTQLIARRVREAGVYSEIVPFQSAEESFRKLKPKAVILSGSPASTGDIDSPKAPQVIFDSGLPVLGICYGQMTMCVQMGGKAEPSDHREYGRAFLNIEKDCALFKDLWPAGTRHQVWMSHGDRVIQMPPGFEIFAKSPGAPYAVFGNEERRMYGLMFHPEVVHTTDGAQLIANFVHKVAGLKGDWTMAAFRDKAIAEIREKVGDGKVICGLSGGVDSSVAAVLIHEAIGDQLTCIFVDHGLLRLNEAEEVVSMFRDHYNIPLVHVQAEDTFVDALEGEMDPEVKRKTIGRLFIETFEAEAKKLGGADFLAQGTLYPDVIESVSFTGGPSVTIKSHHNVGGLPERMNMQLVEPLRELFKDEVRILGKELGLPESFVGRQPFPGPGLAIRCPGGITRDKLRVLREADAIYLDEIRKAGLYDAIWQAFAVLLPVQTVGVMGDGRTYEFVCALRAVTSVDGMTADFYHFDMEFLGNAATRIINEVKGINRVVYDVTSKPPGTIEWE

SEQ ID NO: 24607 - protein, 365 aa, Streptomyces hygroscopicus subsp. limoneus
MTGSVPIVDLEAWRAADEENRASLAEIIDGALHTVGTFLLAGHGVPAELTARMRTAGRSFFDLPWEKKEPHAVQRPHDNGWRGLVKHRTDTIEGTGGAPDLHEAFHMGPTHRTGDDAFDALYYPANKWPAELPELRETALAYTAHMTRVAGAVMEMLAGVLGLEPAFFTSRCEHATWTQSVNWYPSLDTVGQTAEGQMRVGPHTDFGTITLLDRQQGVSGLEVWSEEDGWFAPPFVEGTLLVNLGDLMHQWTDGRWRSLRHRVLAPSASAPQEELVSLVYFFDADPEAELVPLAAPVGGGAGMPTVNVGETILKKNIQMLTDLKGHGLFQGELSLSRPGSADSPGSSPADDHPSRPGRHPAQGPQ

SEQ ID NO: 24608 - protein, 433 aa, Fulvimarina pelagi HTCC2506
MRLGGRLSAAIDILTDIEARHRPVAQSLKDWGISHRFAGSKDRSAIGNLVYDALRRKRSYAYRMGEDTPRGIVTAAALDGLGLDASELLAALEGDRFAPNLPDEDVMDRFLGRDASGAPDAVAADVPDWLAPKLQALFGDAWVREAAALSDRPPLDLRVNTLKAERAKVIEALKPFAAKASELSRTGIRIAPIAGDGRHPNVQVEAGFQKGWFEVQDEGSQLAAALCGAQPGNQVLDLCAGAGGKTLALAAAMENTGQIHSYDGDRQRLAPIYERLKRAGVRNVQVHDPRADLSDLEGAMDIVLVDAPCTGTGTWRRRPDAKWRLSEAALEKRVAEQDAVLDQAARFVKPGGRLVYVTCSVLPNENGDRISAFLERTNGFVVDELGEVWVGLVPGSHKDGIHRVSVGEGTALTMTPATTGTDGFFVCAIRKQP

SEQ ID NO: 24609 - protein, 373 aa, Streptomyces hygroscopicus subsp. limoneus
MDGVRAVLLAGGEGRRMGPLGRGRLKPLVPFGGTSRLIDFSIANVHRSGLRDVLLLSQYEERRLMDDLHLVWNGRHRGFRIDFGPYDAVYRRSPGKLPEQLPERIWPLERGTADALLTKAEYVFRQGDAEASEILVLHADHVYRFDYGDMIREHRASKAALTVSYQRIERRYVHLFGMVEFDGDGLLTAFEEKPDDPTSDLVFAAFCLFDAATLRRYLEQLRGTDWQHDISRDVIPAMLAGGELIRGYEVKSYWEDIGTVDRYHRAHRGLLRADPTLALSDMPLTVAPEVPRHLVPGGPGRRASVVAADVANEGEIVSSVVYPGARIGVDAHVVDCVVLPGARVPDGTHLASAIVLEDGSVQQCEAEREEVAL

SEQ ID NO: 24610 - protein, 250 aa, marine gamma proteobacterium HTCC2143
MRRSLVVGNWKMMGSRAGVTKLLEELKGYLVASDRASIAICPPYVFLPQVSEDLRESGLRWGSQNLSQYDEGAFTGEVSASMLKDFGCDYTIVGHSERRSLFGEGDADVAAKFVAAQSARLTPILCVGESLQQRDSGDALEWVKQQIIAVVDVAGIDAFADAVVAYEPIWAIGTGKTATPEQAQQVHAHIRGVIASLHPGVADSLRILYGGSVKADNASELFANPDIDGALVGGASLIAADFAAICRAAE

SEQ ID NO: 24611 - protein, 280 aa, Campylobacter coli RM2228
MQELISYIQKAVIEISNALKFPDTSYSQNQNSTGDTQLKFDVLSDEIITNTLSQCPSIKAIISEEKDEILNINENAKFIVAYDPLDGSSLMDVNFAIGSIFAIYEEKASAKNLKAALYSMYGARLELVICEDKPKLYRLDKNNEFVFVKDLQMQEKGKINATGGTQKFWEEKHAKFIKKLFDEGYRLRYSGAMVSDINQILLKGGGIFSYPATSDAPKGKLRAFFEVFPLAFIIEKAGGKTTNGKNHSLLELDFDEIHATTPCFFGSKYEISELLKAYNE

SEQ ID NO: 24612 - protein, 437 aa, Haemophilus influenzae
MEILMKSGDLNKYDLVKNALVLVLAGGRGSRLHELTDKRAKPALYFGGNRRIIDFALSNCINSDLNRIGVVTQYAAHSLLLHLQTGWSFLPQERGEFVDMLPARQQIDDSTWYRGTADAVYQNMAIIKNHYRPKYILILAGDHIYKQDYSVMLMDHVNSGAKCTVGCIEVPRSEAHEFGVMAVNENLKVKAFVEKPKDPPAMVGKPDVSLASMGIYVFDADYLYKMLEQEVNTPQTSHDFGKDVLPKCLEEGALYAHPFSRSCMGRNTEGEIYWRDVGTLDSFWQSNIDLVSENPQLDIYDQSWPIRGNPIQAYPSKFFYKHSNVHPVDNSLIGGGCVITDASISNSVLFDHIKIDAFSKVDHCVVLPQVKIGKNCVLKNCIIDRECEIPDGMQIGVDMEEDKKRFRISSTGKVILVTSKMLKILEGHEIGEEGHLD

SEQ ID NO: 24613 - protein, 482 aa, Polaromonas sp. JS666
MNNFNNLINGQWLAGNSTSANRNPSNLADVIGEYAQADAAGLDAAVQAAQAAFPAWSTSGIQARSDALDRIGTEILARREELGTLLSREEGKTKPEGIGEATRAGQIFKFFAGECLRLSGETVPSVRPGIGVEITREPVGVVGLITPWNFPIAIPAWKVAPALAFGNCVVLKPADLVPGSAWALAEIISRSGIPAGVFNLVMGPGRVIGDALVNHPGINAISFTGSVGVGSRIAEACAKNLKKVQLEMGGKNPQVILDDADLTQAVELSAQSAFYSTGQRCTASSRLIVTDGIYPAFVKALQERMTRIKVGDALTTGTDMGPVSSQAQLEQDLSYIAIGKAEGATLAFGGNRVPCHTGSGAEGYFMAPALFSESTAGMRINREEIFGPVASIIRVKDYEAALAAANDTPFGLSAGIATTSLKYATHFKRHSQAGMVMVNLPTAGVDYHVPFGGRKGSSYGPREQGRYAQEFFTTVKTAYTLA

SEQ ID NO: 24614 - protein, 561 aa, Bradyrhizobium japonicum USDA 110
MERIWLKQYPPGVPADIEPTQYASLVDLLEESFAKFADRKAFICMDKSISYRDLDQMSVALAAYLQGRGLQRGARVAIMMPNVLQYPIATAAVLRAGFAVVNVNPLYTPRELEHQLKDSGAEAIIVLENFAHTVEQVITKTSVKHVIVASMGDLLGFKGVIVNLVVRRVKKMVPAWSLPGAVSFNDALSAGRGLTFNKPKLSPGDVAFLQYTGGTTGVSKGATLLHRNIVANVLQNDAWLQPALAAPPHVDQLMIVCALPLYHIFALTACYLLAVRAGGCNLLIPNPRDIAGFVKELAKYQVNSFPAVNTLYNGLMHHPDFKKLDFSKLKISNGGGMAVQRPVAEQWKAVTGCFIAEGYGLSETSPTLTCNPATTNDFSGSIGIPVPSTYISIRDDDGNEVPLGQAGEICAKGPQVMSGYWNRPEETAKVMTADGYFRTGDIGVMDEKGYTKIVDRKKDMILVSGFNVYPNEIEEVIASHPGVLECAVIGIPDSKSGEAVKAFVVKKDQNLTAEAVIKFCHEQLTGYKVPKHIEFRTDLPKTNVGKILRRQLRDEKKAEAA

SEQ ID NO: 24615 - protein, 212 aa, Vibrio cholerae O1 biovar eltor str. N16961
MTNLLQKIGDAVTVVNFSLYEGFIFDMDGTLLDTMPAHLAAWEATAKHFDFPFDAQWLYGLGGMPSAKITTHINKKLGLALDPDRVAAYKMDWFASMGLQAEVIPATYELLCQWQGKKKMAIGTGSQRDSALRLLSNAQVLDKFDAVVTASDVQQHKPHPETFLMACEQLGLTPKQCLVFEDTQLGLQAAHAGGMDCMLVTEQGLVFYPFAH

SEQ ID NO: 24616 - protein, 414 aa, Staphylococcus aureus subsp. aureus Mu50
MTENNNLVTSTQGIIKEALHKLGFDEGMYDLIKEPLRMLQVRIPVRMDDGTVKTFTGYRAQHNDAVGPTKGGVRFHPDVDEEEVKALSMWMTLKCGIVNLPYGGGKGGIVCDPRQMSIHEVERLSRGYVRAISQFVGPNKDIPAPDVFTNSQIMAWMMDEYSALDKFNSPGFITGKPIVLGGSHGRDRSTALGVVIAIEQAAKRRNMQIEGAKVVIQGFGNAGSFLAKFLYDLGAKIVGISDAYGALHDPNGLDIDYLLDRRDSFGTVTNLFEETISNKELFELDCDILVPAAISNQITEDNAHDIKASIVVEAANGPTTPEATRILTERGILLVPDVLASAGGVTVSYFEWVQNNQGYYWSEEEVNEKLREKLEAAFDTIYELSQNRKIDMRLAAYIIGIKRTAEAARYRGWA

SEQ ID NO: 24617 - protein, 803 aa, Magnetococcus sp. MC-1
MGASRFVQAINPTGAIPRQPSMRATHPKPKILIVDDKPANLMALRRLLKNTHAELIEAESGNEALGLMLEHELALMLLDVDMPGMDGFEVSRMASGLDRTSNVPIILITAAYKDYSHRIKGYQAGAIDYIEKPIDDRILNAKVAIFLNLYNAHRESEQLRQDLTLNQERLELALEGANEGLWDWNILSNQVYYSPRWITMLGYATNEVNQDFSTWKTLIHPDDFESALACLERHFTTPEEPYRAEFRMRTKQGGWCWILARGKVVARTADGQPHRMVGAHQDISQRKQLEADLLAAKTEAEQANQAKSRFLANMSHEIRTPMNTILGMGEILLNAPNLTPKQHRYLSISQRAGDTLLGLINDILDLSKIEAGELHLEHTLFALHDELKSLITMLRPMARDKGLSMQCVIDPQLPTHVHGDPQRFRQIVLNLLSNALKFTDQGSITLHAKPIETGRLQFTVSDTGIGMPEQVITKIFRPFVQAEANTTRRFGGTGLGLSICRQLVTMMHGEIYANSQVGEGSQFIFEIELPAANSETVKQERLSPPTKQNIPMRLLLVDDMEDNRLLVKAFLEGTPHQIVEAEDGLDALEKSQQSQFDLILMDGMMPKMDGLEATRRIRARESEHNLTPVTIVALTANAMPQDVADSLAAGSDYHMAKPIRRAKLLQLLASIANERRLFSHEEVKQTTTLTSVETIAADILDALANDVGSGYRQSILRFYSTLPARVAQLTAHIGSEADSVLIEAQGLQQDASYFGAHKLAHLCTQIAQMARTKQPREMIASLCPLLQQALQTIERRLTNEGYF

SEQ ID NO: 24618 - protein, 345 aa, Prochlorococcus marinus str. MIT 9312
MNFLACDLGGTKVLLGIFKKDINDDSPKLIFKKKYISSDWNSFELILEDFLKNECKNIAHPYSACFAVAGPLSNNNAKIINLSWNISGNALQKKFNFKSCELINDFAVQIYGIPYLKENQYSTIQNGDFFAGTNNDLHAIVGAGTGLGIARGIISENNVKVLASEGGHVEYSPKSKLEWELKIWLKNYLKVERISCERIVSGIGLSRIAEWRLSKPDAKNHPLQKYFKEIKISDALRKEIPEKICTFSNKGDQLMIEVERIWLGAYASLLGDVALQELCFGGLWISGGTAPKHFKNFKSNIFMKQFFDKGRLKDILKTIPLKVILDEEFGLFSAACRAKMLLKTE

SEQ ID NO: 24619 - protein, 519 aa, Zea mays
  misc_feature (272)..(272): Xaa can be any naturally occurring amino acid
  unsure (1)..(519): unsure at all Xaa locations
MACAGARALFSGVTSDSTCVFCHHLLDEVMSKLKDPDAEFEIIQILIKECNKIEGHVQQCKRLVLQYIPLILVNGEKFLEKNDVCALVGTGFAGSRLNNDSSRHITWLADAGGIGLRMRKSRVNPSRQERSGGMATPRRLIRERAEAAVATLVAVRPHEIPPLMSAAATFFFILSAYFVVLPLRDEGAISLGLDTLPGLFAGSLLLTVVAAPIASLAFSLPSIPKPKLCLCYMLQDALMMIHRFFSISLLAFFVLWYTSTPGQSGPTSQYSXMIIDLNNSLHLKVALLNLITISSTWARVIDVMDSEFLISLLVQSGSRLFGFIGAGATLGQLFGSLFAASMAWLGPCFWLILRSPYLIYISLFLWLSAVVSSVFYFQGHILTVAGVTVAICASPFVAASNLVALAVWPTWVAVAVTETIRKVTTYVLTRPGRELLFTVVSQDEKYKAKVCIDVIVQRLGDATAAGIYRWLFSSLEKKTSKVTLFALPLCFLWLVIAFHLGRLQTNLARLQAASAPSYS

SEQ ID NO: 24620 - protein, 734 aa, Symbiobacterium thermophilum IAM 14863
MTGGISRRTFLQLSVAATAALGAAGAVAAGDGRSYVSGGFAPGHVEPDTWTYSTCGFCGTGCGIEIGTKDGVPVAIRGTKGYPVNDGLLCAKGIYQWKIITAPDRGKRPLIRKDGKMVPATWDEALTAMTDKLKQLLADYGPESIACYNTGQLCMEEFYTLGKLMRAGFRTPNLDGNTRTCMASAVMGHIRSFGTDGPVGAYADIEAAEVILIAGSNMAECHPILFGRVVKAVEKGARLICVDPRLTQVSRIATINLPIRPGTDVVLLNAMAHVIIREGLIDRAYIDAHTTGYPELEQHLRKYTPQYAAGICGVPAEDIEAAALLYGRAERSLSMWVMGINQSVNGTIANNCFHNLNLIQGKIGKPGCASFSITGQPAAMASREVGGSSSYPGYRAIGNAQHRAEIAALWGVDPATLPDKSPSITEIIDAILEGRIKALWVICTNPLMSLPDQNRVRQALEKLELLVVQDAFETVDTAQYAHIFLPAALWAEKSGIMVNSERRLNLLKPAVKPPGEARTDFEIFLDVADRMGFGHLFPYRTTEECFEEIKRVTRGRPNDYSGATYARIEASKGLQWPIPDERSPGTPRLYADGRFNTPDGRAVLWAVDPIELPEVPDGEYPFNLNSGRVQEHYHTGTKTRKVPELNALVPTAYVELNPRDAEALGVQYGDRVCIESRRGQIEAKVVVTSQVAPGSCFVPMHFGEGPVNRLTVWAVDPFSKEPNYKQQAVRLRRV

SEQ ID NO: 24621 - protein, 551 aa, Schizosaccharomyces pombe 972h-
MLFSRSILRGMPKAGIPKSPLALSASRNLRLANSVRFASDAASSPKSTTSKWKILKRTTLGLFATAVVLYGANVYRFRHPDPHQPLPDPSKKTLVVLGAGWGATSILRTIDTSLFNVIVVSPRNYFLFTSLLPSTATGSVHTRSIVQPIRYMLRHKSCYVKFYEAECTDVDADKKVIHIKKTTTDGVDLEQEIKYDYLVCSHGAETQTFNIPGIAEYGCFLKEIWDAQKIRARILHCLEQAQFKDLPAETRRRYVHTVVVGGGPTGMEFAGEMADFIEDDLKSWYPELADDFAVTLVEALPSVLPMFSAKLRDYTQSLFDSSHIKIRTNTALKKVTAENIHVEVKNPDGSKQEEVIPYGLLVWAGGNRARPLTKKLMEGSEEQNNRRGLVVDEYLKLKGYKDIFALGDCTHTAYAPTAQVASQQGAYLGQLFNKLGSLNFEKPSEDRHIALGDEMDSSTLISLANEKHASTKVFLPFKYSHQGSLAYVGHEKAIADIEVPWFGKQLHASGALAFYFWRSVYLSELYSLRNRTNVTLDWIRVKLFGRDISSL

SEQ ID NO: 24622 - protein, 302 aa, Burkholderia sp. 383
MSGGTFPAFVSAGDILTDMVRAGDAQWTSVPGGAGWNVARAVARLGVPSALAGSIGEDCFSDVLWHTSEAAGLDLRFLQRVARPPLLAIVHETRPPAYFFIGEASADLAFDPAQLPAGWTDHVKWAHFGCISLVREPLAGTLAALAADLHARGVKISFDPNVRNLMTAAFQPTLAKMAALADLIKVSDEDLRHLFGGDGPDAIGAVRALNPHAAVLVTRGAQAATLYADGDVHEASPPRVEVADTVGAGDASIGGMLFSLMAAPQRSWREHLVFALAAGAAACRHTGAHAPTLDEVVALIER

SEQ ID NO: 24623 - protein, 286 aa, Prochlorococcus marinus str. MIT 9312
MISSKTSFIALIGNPVSHSLSPIMQNAALQYLGLDLIYIAMPCKDEDLELVMNSLKKINCKGLNITIPHKEKVFDLCSEISPIANKLKAINTLKLNSAKEWSATNTDVEGFIYPLKTLNLTKKQSIVLGSGGAARSVIQGLINLNFSTISVVSRNKSSLDELIKNFENQITIEGLLNNDNRTETLIEEADLIVNTTPVGMKTTKHEMNVLPYGDVFWRSLNSKTIVYDLIYNPAPTPLLKFSAKKGCITIDGLKMLVAQGAKSLSFWTNGLEVPFHIMNDALKNYL

SEQ ID NO: 24624 - protein, 364 aa, uncultured marine group II euryarchaeote DeepAnt-JyKC7
MFDMAGDDAVQFGLGEPDFQPPDIAIEAFSKAMKDGHNKYTTTAGLPALRLKIAEGWQHLVPSLDASSVCMTMSGTNALLDIFLALVDPADEVLLPEPYFPLYPTDVVICGGEPILYPCLFERGFVPTVEDLESRVTDKTVAILYNFPSNPTGGNVTTEERDELVDFARRHDLWVITDEVYDRIVYDTEHVSFIGAGYDKVIMINSFSKTFAMTGWRIGYILSENAEAMEQIAKMQYYVTACSNDAMQYAVLEALNEASDYPEHMRDEFQARRDLICDRLNAMPGVSCHIPTGAFYVFPKVEAAGLNSEEIALALLEGGVLCSPGSAFGAAGEGHLRFAYTIGREGISRGMDRVEKVLAELRGE

SEQ ID NO: 24625 - protein, 424 aa, Campylobacter coli RM2228
MTNKKAFKIACSLIAGGVNSPVRAFANVQSEPRFISHGKGAHIFDIEGNSYIDYVQSWGPLLFGHCDKDILKACNEALKKGSSFGAPTLLETQLAELVLEDFPHLDKIRFVSSGTEATMSAIRLARGFTKKDKILKFEGCYHGHSDSLLVSAGSGAATFNSPSSLGVLADVAKHTLVATYNDIESVKELFEKNKDIACVIIEPIAGNMGLVPGKQDFLEELVKICKENDTLLIFDEVMSGYRASYLGSYGINHIQADIVTFGKVIGGGLPAAAFAARAEIMDILSPLGGVYQAGTLSGNPLAMAAGIASLSKAKKKKDLYTKLGKLAKRLTKGMKELANERGVALQTCYVGSMFGYFFTQDPVYNYKDALKSDLKLFSKFHQNMLKNGIYLAPSQFETGFICAKMNKELIDKTLQSTYESFKKL

SEQ ID NO: 24626 - protein, 366 aa, Oryza sativa (indica cultivar-group)
MGEVWSLFPFLVMCGGACARLPVVEEGGATPTFDALSVSCVQEEKVKEEAAAEKGKEAAVAEEEEAAAAGEEKKEDAPPPPPPPEEVVMRVFMHCEGCARKVKKILRGFDGVEDVVADSKAHKVIVKGKKAAADPMKVVHRVQKKTGRKVELLSPMPPPVEEKKEEEKKEEPEPPKPEEKKEPTVIAVVLKVHMHCDACAQVIRKKILKMKGVQSAEPDMKASQVTVKGVFEESKLTDYVHKRIGKNAAVVKSEPAPPPENAGDANAKDDKKAAEGGEEKDESKEEKKEGDDAGGDEKEKEKEKDDSNAAEVEEDKEKDPSALAAANLYMHYQRFSNPGGYGVPGYAYPYAPQLFSDENPNACVVM

SEQ ID NO: 24627 - protein, 351 aa, Oryza sativa (indica cultivar-group)
MWILASLFFDWAIFFFSSLNQLGIHASKFVTFEGAKELAYQYAAQGACLALVARRKKALEGVAAAALERGSPDVLVLPADVSDADQSRRAVEETVAHFGKLNHLVANAGIWSSCSFDEVTNITAFTKMMDVNFWGSVYPTYYALPHLKASKGKLVVSCSAAGTVATSRMSFYNATKAAQLRFYETLRTELGSEVGITVLTPGYVESEITKGKGIQSGGDVAVNEEARDEQIGVFPVGRVAELGEVAMDGIRAGDWYVTWPSLFRPLQLVACLAPGVLDWACRALYGTRKGARPPLGKRIMEATGMKRLFPEALRRNPAIKTEDEEYCDGEEGYGAADDAAAAYLLQCRKGL

SEQ ID NO: 24628 - protein, 240 aa, Polaromonas sp. JS666
MSQKPTSHPYKPNMTQDELKALVGQAALPYVEPGSIVGVGTGSTVNKFIDALATMKDRIAGAVSSSVASTERLQAIGIKVFDATEVDELAVYIDGADEIDHAGYMIKGGGAALTREKIVAAQSRKFVCIADESKLVQTLGSFPLPVEVIPMAARRIARQFAALGGTATLRSKGGAESGEPLVTDNGQHILDVTGLKITDPLGFESQVNQWPGVVTVGVFAFQKAHVCLLGASDGVRTLVF

SEQ ID NO: 24629 - protein, 386 aa, Oryza sativa (indica cultivar-group)
MGRVYLAIHGVLMHVVAALVVLVYIPLSVPVRLFLWAFVKPLRREQLRGKVVLITGASSGIGEELAYQYASKGASLALVARRKQALKSVAAAARERGAPDVLVLHADVSDAGQSRRAVEETIAHYGKLNHLVANAGIWSTCPFDEITNITAFTTIMISCTGYFEACNNKSKGIVYMNFKDVNFWGAVYPTYYALPHLKASRGKLVVCSSAAGTVATSRMSFYNASKAAVLRFYETLRAELGSEVGVTILTHGYVESEMTMGKAVQKDGVLVVDEEARDVQIGVFPVGSVSAMCRVAMDGIRRGDRYVTWPSMYRPLQLVACLAPEIVSWLSYAMYNTKAGGGAPLSKRALDATGARRFFPEGLRRNPVVIKTDEECDGDEGVAACN

SEQ ID NO: 24630 - protein, 500 aa, Methanosarcina acetivorans C2A
MKYISSLRMKAIDTNCSYLGLSPLQLMENAGAAIAQSVKEKLGSGKVLFVAGRGNNGGDAFVAARHLAGIPGYIVRVILLGKDRDIGTEEAYHNYSLLKFSRVQTLEIRDSGQLAVSELFSEADLLVDAIFGTGVKGNIKEPESTAIDLINNEGKAGKIIIAVDVPSGLDPDRGNFEKAVYADLTVTFHRMKAGLLDEQAKEYTGTIKVAEIGVCADAEHYTGPGDLQMLKKRKLEAHKGNAGRILVIGGGPYSGAPALAALAALRAGADLVTVAVPESVAGIVASYSPDLIVRKLFSSVLCPEDLSILPDLINSHDVVVMGMGLGRATETLETVRKLLPFCRKAVLDADALAALSGTLFETLAGNCEIIVTPHAGEFARLRDMETPDSPETREKAVREFAAEKGVVTLLKGKVDIISDGKQTLLNRTGNPGMTVGGTGDVLAGITGSLFSRNPAFLAAACAAYINGAAGDLAFEKAGNALLATDVIGKISEIIKEAGIG

SEQ ID NO: 24631 - protein, 210 aa, Glycine max
  misc_feature (121)..(121): Xaa can be any naturally occurring amino acid
  unsure (1)..(210): unsure at all Xaa locations
MPNISSCTRNFSDVISFNSRLGWPVIGVHGQKPSMKYLNVSEPKKQGLQTPSPPIRTNVNGKGEGTTREVKKKRSEESSDAMLKKPKQDTSTASSSKVQAPKVKLGDKITALQQIVSPFGXDTASVLFEAIGYIKFLQEQVQLLSNPFLKANSHKDPWGSLDRKDHKEDTKLDLRSRGLCLVPTSCTPLVYRESSGPDYWTPAYRGCLYR

SEQ ID NO: 24632 - protein, 829 aa, Vibrio cholerae O1 biovar eltor str. N16961
MKMTRRAFVKANAAASAAAVAGITLPASATNLIASSDQTAIHWDKAPCRFCGTGCSVLVGTQDGRVVATQGDPEAPVNKGLNCIKGYFLSKIMYGQDRLKTPLLRMKDGQYHKDGEFTPVSWDTAFDVMAEKWKASLKTKGPTSVGMFGSGQWTVMEGYAAVKLMKAGFRSNNIDPNARHCMASAVVGFMRTFGIDEPMGCYDDFEHADAFVLWGSNMAEMHPVLWTRITDRRLSHPHVKVNVLSTYYHRSFELADHGYIFHPQSDLAIANFIANYIIQNDAVNWDFVNKHTHFKQAVTDIGYGLRDDHPLQKKAKNANSGDVSDISFEEYKKSVAPYTVEKASEISGVSPDKLITLAKQYADPNTKVMSLWTMGMNQHTRGVWMQSLVYNLHLLTGKIATPGNSPFSLTGQPSACGTAREVGTFAHRLPADMVVANPKHRAIAEKVWKLPEGTIPEKPGFHAVQQDRMLKDGVLNCYWVQCNNNMQAGPNINEERLPGYRNPENFIVVSDAYPTVTAQAADLVLPTAMWVEKEGAYGNAERRTQVWYQQVKTVGESHSDSWQVIEFSKRFKVEDVWPEELLAKAPQYRGKTLYDVLFKNGQVDKFPLSEARELNDDAHHFGFYIQKGLFEEYAEFGRGHGHDLAPYDVYHQVRGLRWPVVDGKETKWRFKEGSDPYAKAGSGWDFYGKPDGKAWIISSPYEAPPEMPNEEYDLWLCTGRVLEHWHTGTMTRRVPELYKAVPDALCFMHHEDAQARGLRRGDEVLISNSRGEVRVRVETRGRNKPPKGLVFVPFFDARILVNKLILDATDPLSKQTDFKKCPVKITKVA

SEQ ID NO: 24633 - protein, 388 aa, Arabidopsis thaliana
MTKTLSSYLQRGENIRNRKASSSSSSPISLLLAQGFYFSRVYLSHSAIMESLGKLQLHHQPFHLSFTHTSSSTFPKNLFKSSIQPISSLKSASIKASSSKFQNSITPLPKSTPFRLFKSTCITLTTAAALLLANLHLKSPAIAAPIAPPPSVESKENVTLEEEERALDEHLITHPSDVDALRSLMEVKIKSRKLTEAVEVIDRLIKLEPEEKEWPVLKANIFTYSGDLDLAKTGFEEILAKDPLRVEAYHGLLMAYSDAGLDLKEVESRIEEAMLKCKKENNQNDFRDFKLLVAQIRVIEGKHSEALKLYQELVKEEPRDFRPYLCQGIIYTLLKKKDKAEEQFDNFRKLVPKNHPYREYFMDNMIATKLFSEKAQREMAEEMAGSTS

SEQ ID NO: 24634 - protein, 381 aa, Zea mays
MSSSPSPANRRPRGPLALGLESSANKIGIGVVSLSGDILSNPRHTYVTPPGHGFLPRETAQHHLAHLLPLLRAALAESGVAPADLACVCYTKGPGMGGPLQVAAAAARALSLLWRKPLVAVNHCVAHIEMGRAVTGAVDPVVLYVSGGNTQVIAYSEGRYRIFGETIDIAVGNCLDRFARVLELSNDPSPGYNIEQLAKKGEKFIDVPYVVKGMDVSFSGILSFIEAAAIEKLKNNECTPADLCYSLQETIFAMLVEITERAMAHCDSKDVLIVGGVGCNERLQEMMKIMCSERGGRLFATDDRYCVDNGAMIAYTGLLAYAHGMTTPLEESTFTQRFRTDEVHAIWREKEMPVLNNTHSDAIAEVSKDEASMATPIVIDY

SEQ ID NO: 24635 - protein, 568 aa, Gibberella zeae PH-1
MPIESRFSVQVPNCSIQQWIFGSSSGPLPDKKAFIDADHPQDRYFTYSQARLLAKRIAVGLTDNGLRPGDRVLLFAHNSIFFPTIVMGIWMAGGIFTGANPGYVARELVHQLKDSQAMFIISDHGALGVALDASSQVGMKPSQVFVLDSTWPDTSIEIQPSKGSRHWTELIAAKSRGETFEWTEPEDSKNSICSINYSSGTTGIPKGVEISHYNHVANSRGVTLFHQLHPEFEARRDRAAALCFLPMYHAFSQGYFITSFPYERVPVYIMPSFEFPKILTHIQTFRITKLLAVPPILVLISKHPLARSADLSSIDMIASGAAPLARDTQREIAGMIPLGEAVVRQGWGMTEATCTALSWDPNKAPSSAAGELTPDSQARLVDIETGEEINTANTPGELWITGPTVTRGYWRNPIATQEAFVVDSDGTQWLRTGDVAYVEEYAKGTLFHIVDRVKELIKVKGMQVAPAELESLLLEREDVADAAVVGVVIDGEEFPRAYIVKTPNGKNTSKQDIADWLASRVVKYKQLIGGVVFVESIPKVPSGKILRKVLRERAKREVSNGLEVRAKL

SEQ ID NO: 24636 - protein, 176 aa, Medicago truncatula
MEKKHAAEVKSLTDKVQEMETIHRKDMAAMEEKLQVLLRVMLNQSNTGIDMGDLGAFLSTRNDDNNVRHSSTSNHEIMDVKTNIEDIQEKDNYPCRQQLLIHNGKVLKDETTLADNEVSEDGFLVVMLSKVNNRSMGGECFVDNYEEEDEEHFFDESDEEDEEKFFDDLDEDEDEE

SEQ ID NO: 24637 - protein, 304 aa, Fulvimarina pelagi HTCC2506
MTTVVADTGDYEAIKALKPIDCTTNPSILLKVIQSPTSEEMVAREIESGRANGKTPLQIADALTIAVGTELAKIVPGRVSTEVDAELSFDKERSLEKARNIVAAYDRQGVSRDRILIKLASTWEGIRAAEVLEGEGIQCNLTLLFCLEQAVACADAGVFLISPFVGRITDWYSKREGKSFEAAEDPGVKSVKRIYDYYKSNGVETVVMGASFRNTGQIKALAGCDRLTISPNLLQELSEDESNLPRQLSEDQAKPMDKLPMGESEFRWGVNGDPMATEKLAEGIRNFDADHKKLLKLIADKLAA

SEQ ID NO: 24638 - protein, 263 aa, Hordeum vulgare subsp. vulgare
MPHNVFLHSALVQSRKIDTKKKSRVQEAVYYYNIESILALIISFFINICVTTVFAKGFYGSEQADNIGLENAGQYLQEKYGTALFPVLYIWAIGLLASGQSSTITGTYAGQFVMGGFLNLRLKKWLRAVITRSFAIIPTMIVALFFDTEDPTMDVLNESLNVLQSIQIPFALIPLITLVSSEQLMGSFVVGPITKVISWIVTIFLMLINGYLILSFYTEEVRGAVVRSSLCVVLAVYLAFIVYLILRNTTQYSRLRSSVSKSS

SEQ ID NO: 24639 - protein, 359 aa, Zea mays
MDRGERLGRALDAFGGNLWALVDAALDAAARDRPDELRARRDSIVERLYAAAAGCSNCAGRPPSVAALAAAGLEEEDGEEAAPASPWAEADAQAGGAEAQTEVLGAGEPDLESKIVAIRDFLEDPNQPENELVSLLQNLADMDVTYNALQETDIGRQVNGLRKHPSAEVRRLVKQLIRKWKEIVDDWVRLDNSGGDGSASVMTDGDSPHKIQGRSHQSPRVSGFQYSPSPQRFNGSTSEMANNGFESTMDAKRRASPVPAHHNSRQMNNNHHSTTITTSTSSAPAFSVQKVTREQKQSLVDLDRLDSARKRLQENYQEAQNAKKQRTIQVMDINDIPKPKSRNAFIRKSGSGGLPARHR

SEQ ID NO: 24640 - protein, 236 aa, Pseudomonas fluorescens Pf-5
MAASAPAPTEVAETADAALQHIVDGFLHFHHEVFPQQEELFKKLATAQRPRAMFIACADSRIVPELITQSSPGDLFVTRNVGNVVPPYGQMNGGVSTAIEYAVLALGVHHIIVCGHSDCGAMRAVLNPQSLEKMPTVKAWLRHAEVARTMVHENCDCADESSSMHVLTEENVIAQLQHLRTHPSVASRMANGQLFIHGWVYDIETSSIKAYDADKGCFLPLDGSHPIPVATPKARF

SEQ ID NO: 24641 - protein, 222 aa, Rickettsiella grylli
MEIQNLERLKKKLAETTLAYISPGSILGLGSGSTINHLITALAAIRHKIEGVVPASLETEKRLKELHIPVLDLNSAGELMLYIDSADEVNPHLQLIKGGGGALTREKIIASASQNFMCIIDESKYVGMLGQKGLPLEVIPMARSYVAREIVKLGGFPFLRDKFITDNGNIILDTQHWDFTDPIKLERLLNNIPGVVSNGLFAQRPANKLLIANKNGIKIIES

SEQ ID NO: 24642 - protein, 1589 aa, Metarhizium anisopliae var. anisopliae
DPRTGAHRAATFNNKFPFSKKTRPQRPFDYTDETIGPTDYNDPGHVYHLDTNLNDMEGILTKPPPLTPMDSSFINSIESDRRESTLEGPKGRWDAPDSWAVRRNTEDNTEDVPEVDEIGSPPRPDEKLTSYFIRIFRSDGTFSTHSMALDSTVTDVISQVIKKTYVVDGLENYHIIMKKHDLIRVLAPAERPLLMQKRLLQQVGYEEKDRIEDLGREDNGYLCRFMFLSARESDFHAKTMDLGISRSQKLNYVDLSGRNLVTIPISLYKKAADIISLNLSRNLSLDVPRDFIQSCKQLRDIKYNNNESRKLPLSLGRAGRLTFLDVSNNRLEQLEHAELNSLTGLLKMNLANNRLTHLPPYFGAYQALRSLNISSNFLDKFPPFLCQLHSLVDLDLSFNAIASLPDELGNLKNLEKLLITNNRLADEVPEGFRQLLSLRELDIKYNSITSIDIISELPKLEILTAAHNHISSFVGKFETIRQLKLNSNPLNKFEIVEPVPTLKTLNLSHAQLASIDSAFSNMINLETLVLDKNYFVSLPQQIGTLSRLEHFSIANNSVGELPPQIGCLTELRVLDVRGNNISKLPMEIWWANKLETFNASSNVLDAFPKPASRPPRVPGEEPTGPPTVQNGKPLPPNPIPSTPSSEDLSDERNPSQASSTLLSVGPSPVLATADRKSSVVSVYGKGGRKTSVVSRAASQATNSTTPPPTTARKDSGLSSRLTNTFAGSLRNLYIADNRLDDDVFDQIILLSELRVLNLSYNDEISDMPQRSIKNWPQLVELYLSGNGLTSLPADDLEESSLLQTLYINGNKFTNLPADISRAKKLAVLDCGNNYLKYNISNVPYDWNWNLNPNLRYLNLSGNKRLEIKQTAWGGPDGPGAVNREQYTDFSRLLNLRILGLMDVTLTQPSIPDQSEDRRVRTSGSLAGHLPYGMADTLGKNEHLSTVDLVVPRFNSSETEMLLGLFDGQALSSGGSKIAKYLHENFGHIFAMELKAIKNRPDDTPTDALRRAFLCLNKDLVTVAVQHTEERPKAAHRGSAQPVVLSKEDLNSGGVATVLYLRGTELYVANVGDVQAMVIKTDGKHEILTRKHDPAEPSERSRIREAGGWVSRNGRLNDLLQVSRAFGYVDLMPAVQAAPHVNKMTIKEHDEIILLATSELWEHLAPSLITDIARSERQDLMRAAQKLRDLAMAYGASGKIMVMMISVADLKRRVERSRLHRGTSMSLYPSGIPDDTQVLSTRRRGKAKGDVLDSSLNRLEAEIPAPTGNVSIVFTDIKNSTTLWEMYSSAMRSAIKLHNEVMRRQLRRIGGYEVKTEGDAFMVSFPTATSALLWCFAVQMELLDVSWPSEVLNSMSCQPIFDKDGALIFKGLSVRMGIHFGDCVSETDPVTRRMDYFGPMVNKASRISAVADGGQITVSSDFISEIQRCLENYQDTERNASGGSDEAFEDESFAATIRKDLRSLTSQGFEVKEMGEKKLKGLENPEVVYSLYPHALAGRIDQHQQHERRDEGLDRPAILAPGSELSFDPESIWALWRVSLRLEMLCSTLEEVRGSGLQPPETELLERIKSRGGEVTQKFLLNFMEHQVTR

SEQ ID NO: 24643 - protein, 915 aa, Chlorobium tepidum TLS
MPNSHANEESAAAKKYIYSFAGGAAEGDASMKNLLGGKGANLAEMANIGLPVPPGFTLSTEVCAYYYDHQKTYPANLFETEIPAALKKVEDYLGKKFGDPENPLLVSVRSGARASMPGMMDTILNLGLNDKTVEGLARKSGNPRFAWDCYRRFVSMYGDVVLDLKPADKKQIDPFEEILEQKKQELGIHLDTELGVDDLKDLVGKYKKAILEKTGKTFPENPEEQLRGAISAVFNSWNNERAIVYRKLNHIPGWWGTACNVQAMVFGNMGEDCGTGVAFTRDAATGDNIFYGEFLMNAQGEDVVAGTRTPLKIEQLAQEKPAIYNQLEEIRSILEKHYRDMMDIEFTIENDKLFMLQCRVGKRTGLAAIKIAVDMYNEGLIDEKEVLRRIEPEQLNQLLRPVFDLKEKKAAIDSGRLLATGLNAGPGAATGRVYFNADDAMEANARGEKVILVRIETSPEDIKGMNAAEGILTERGGMTSHAALVARQMGKVCVAGCGTLRIDYKAGEMRVAGKDIVIKEGEYISIDGTTGEVIAGEVKTKNSEILEVLIDKTLDPADAPTFRIYNQLMQWADKYRKLNIRTNADQPDQAEIAITFGAEGIGLCRTEHMFFGGDRIDAMREMILADDIAGRKVALDKLLPYQRDDFYGLFKAMGSRPVTVRLLDPPLHEFLPHTDAEIDDLAGKIGKTSAEIKARIESLHEFNPMLGLRGCRLGILHPEIIVMQVRAIIEAACRIKQEGQEIVPEIMVPLVSTVKELEITSEVIHKTARSVISEQGVGVKYLVGTMIEVPRAAITSDQIAQAADFFSYGTNDLTQMGLGMSRDDSGQFLPIYQQQEIFARNPFESIDIDGVGRLVSISAKEGRSVKPDLKLGICGEHGGDPATVEFCHKTGLNYVSCSPFRVPIARLAAARAALL

SEQ ID NO: 24644 - protein, 1107 aa, Synechococcus sp. CC9605
MPRRSDLRRILLLGSGPIVIGQACEFDYSGTQACKALRAEEFEVILINSNPASIMTDPEMADRTYIEPLTPDVVTRVIEKERPDALLPTMGGQTALNLAVTLAENGTLERFGVELIGADLKAIQKAEDRLLFKQAMERIGVKVCPSGIASSQEEAEAVGAAIGSFPRIIRPAFTLGGSGGGIAYNPEEYAAICKSGLEASPVSQILIEQSLLGWKEFELEVMRDLADNVVIVCSIENLDPMGVHTGDSITVAPAQTLTDREYQRLRDQSIAIIREIGVATGGSNIQFAINPDNGDVVVIEMNPRVSRSSALASKATGFPIAKIAARLAVGYILDEILNDITGKTPACFEPTIDYVVTKIPRFAFEKFRGSPAVLTTSMKSVGEAMAIGRCFEESFQKAMRSLETGFSGWGGDREEPELTDGELDRQLRTPSPERILSVRTAMVRGRSDEEIHQISRIDPWFLAKLRRIIEAEARLIKGKSLDQLDADSLFEAKQLGFSDRQIAWHTNSDELSVRQRRHQLEVRAVFKTVDTCAAEFASSTPYHYSSYERPLQTLQADGSLKPLPASTEVSRREGGRKMMILGGGPNRIGQGIEFDYCCCHASFAGQDQGITTVMVNSNPETVSTDYDTSDSLYFEPLTLEDVLNVIEAERPDGVVVQFGGQTPLKLAIPLLRWLDSDEGRATGTSIWGTSPESIDRAEDREQFEAILRDLNIRQPRNGLARSEEEARAVATRVGYPVVVRPSYVLGGRAMEVVFDEEELNRYMREAVQVEPDHPVLIDQYLDNAVEVDVDALCDHTGAVIVGGLMEHIEPAGIHSGDSACCLPAVSLGEAALNTIREWSRSLAQTLEVRGLINLQFAVQRNTDGSEVVYIIEANPRASRTVPFVAKATGQPLARLATRLMAGETLTDIGMTSEPKPPLQSIKEAVLPFRRFPGADTVLGPEMRSTGEVMGSANSFGAAYAKAELGAGEALPTQGTVFLSTHDRDKQALVPIAARLIELGFDVTATSGTAQALANAGLKVQSVLKVHEGRPNIEDQIRSNQVQLVINTPIGRQAAHDDKYLRRAALDYAVPTVTTLAGARAAVEAISALQQQPRLSIHALQDVHAIQR

SEQ ID NO: 24645 - protein, 691 aa, Yarrowia lipolytica CLIB122
MTLQVCKDDPWLKPFEEELLRRQALVGQWKDHFAKEGGLAEFAASYKRYGLHVNKDNSVTYREWAPGASEAVLTGDFNGWDRQQYHMTRDEYGLWSVTVPPTSDGQVAIPHNSKVKLALKTSNGQWVDRLPAWSTYVVQDLSKSPIYEAVFWNPPESEKYQWKNKSPPTPANAQIYEAHVGISSSEPRVGTYKEFTKNILPRIHKLGYNVIQLMAIMEHAYYASFGYQVTSFYAISSRYGTPEDLKELIDTAHGMGITVLLDVVHSHACKNVDDGLNNFDGTDHQYFHGGAKGDHPQWDSKLFDYGKYEVLRFLLSNLRFYIEEYHFDGFRFDGVTSMLYKHHGLGTGFSGGYHEYFGDEHVDQQAVVYLMLAHELMRELQPLLRPGEDAGNFLSIAEDVSGMPALCRPVSEGGVGFDYRLAMAIPDMWIKLVKETRDEDWDMGNIVFTLTNRRHREKTIAYAESHDQALVGDKTLAFWLMDKEMYTSMSVLSDPNPIIDRGIALHKMIRLITHSLGGEGYLNFEGNEFGHPEWLDFPREGNGSSFHYCRRQWPVVDDKLLRYQHLNEFDAAMQHRGDHYGWLSADQAYVSLKNEDDKVVVYERAGLVFVFNFHPNKSFTDYRIGVDQPGTYTLVLDSDSPEFGGFGRIDHEKTRCHTEPLEWNGRANCMHIYIPSRVALVFAREDDPRRK

SEQ ID NO: 24646 - protein, 248 aa, Synechococcus sp. CC9605
MGKQGVRRPVIAGNWKMHMTCAQSREFMEAFLPLIADTPDDRDLVLAPPFTALSTMAELSRNSRVCLSSQNVHWEGQGAFTGEISPAMLKEHGVTHTIVGHSEPRKYFSESDEQINHRARSSQSNGLIPIVCVGESDEQRERGEAERVIRRQIEQGLEGLDAEKLVVAYEPIWAIGTGKTCAAEEANRICGLIRSWVGSPDLVIQYGGSVKPSNIDELMGMSDIDGVLVGGASLEPESFGRIANYQAA

SEQ ID NO: 24647 - protein, 302 aa, Actinidia chinensis
MEAFEKLEKVGEGTYGKVYRAREKATGKIVALKKTRLHEDDEGVPPTTLREISLLRMLSRDPHVVRLIDVKQGQNKEGKTVLYLVFEYMDTDLKKFIRPFRQTGENLPTKTVKSLMYQLCKGVAFCHGHGVLHRDLKPHNLLMDRKTMMLKIADLGLARAYTLPIKKYTHEILTLWYRAPEVLLGATHYSTAVDMWSVGCIFAELITKQALFPGDSELQQLLHIFRLLGTPNEQVWPGVSKLMNWHEYPQWSPQKLSSSVPNLDEDGLDLLLKMLQYEPSKRISAKKAMEHPYFDDLDKAYL

SEQ ID NO: 24648 - protein, 436 aa, Vibrio cholerae O1 biovar eltor str. N16961
MKIVPMVQPIQAMEIDQAYRHWRIHLMISMYVGYGVFYLTRKSFNFAMPQMLSELGLDYSDLGFLSTLFYLTYGVSKFVSGLMIDRSRSPYFMGLGLMATGIINIAFGFSSSLLAFTLLWTANAFFQGWGWPACAKVLTHWYSRSERGFWWSIWNTCHNLSGALIPIVIGFISLTFGWRYGFLFAGGVAIFVGLWLCYRIQEKPSEMGLPSVGEWRGDALELEHEKEGQGLAFRVAVYRYVLTNRYIWLLCGSYLLVYVVRIGINDWGSLYLVERHAYNILSANSAVAMFEVGGFLGSLLGGWGSDYYFRGNRAPMNLIFALGIFASVAALWLTPIDHLWFLAGCFFCIGFFVFGPQMMIGMAAAECARKDLAGTATGFVGLFSYLGAALASYPMSLAIEAWGWEGFFCLITAAAAVISLQLLPFIKAQQPVTEDE

SEQ ID NO: 24649 - protein, 488 aa, Oryza sativa (japonica cultivar-group)
MGARCSKLSVCWWPPHFKSPLLENGAAADDGSGVPVFAEYSLDELRVATDGFSPERIVSEHGEKAPNVVYRGTLFSTGRTVAIKRFGRSAWPDSRQFLEEARAVGQLRSVRLANLIGCCCENGERLLVAEFMPHETLAKHLFHWETKPLSWAMRVRAAFYVAQALEYCSSKGRALYHDLHAYRVLFDVDGNPRLSCFGLMKNSRDGKSYSTNLAFTPPEYLKTGRVIPESVVYSFGTILLDLLSGKHIPPSHALDLIRGKNYLVLMDSCLEGHVSSSDGTELIRLASRCLQYEGRDRPNLKSVVSALGNLQKDASAPSHALLGIQHDKENTERISLSAIAKVYARADLDEVHEMLENDGYCEDERATFEVSFHSWTGQQVSDSILVKKHGDSAFQSKDFATAVECYSRFIDTGVMVSPTMLARRSFVYMVLGKLQEGLADAKKAADISPEWPTAHYLQGMAYLAMGMEPEGHEELKQGAALEAERNAR

SEQ ID NO: 24650 - protein, 407 aa, Arabidopsis thaliana
MNRGVLESSPVQQLMAAGNPNWWNVSGGMRPPPPLMGHQQAPLPPHMTPNNNYLRPRMMPTPFPHFLPSPATSSSSSSSSPSLPNNPNLSSWLESNDLPPESWSLSQLLLGGLMMGEEERLEMMNHHNHHDEQQHHGFQGKIRLENWEEQVLSHQQASMVAVDIKQEGNINNNNGYVISSPNSPPNKSCVTTTTTTSLNSNDDNINNNNNMLDFSSNHNGLHLSEGRHTPPDRSSECNSLEIGGSTNKKPRLQPSPSSQSTLKVRKEKLGGRIAALHQLVSPFGKTDTASVLSEAIGYIRFLQSQIEALSHPYFGTTASGNMRHQQHLQGDRSCIFPEDPGQLVNDQCMKRRGASSSSTDNQNASEEPKKDLRSRGLCLVPISCTLQVGSDNGADYWAPALGSAGFH

SEQ ID NO: 24651 - protein, 1537 aa, Frankia sp. EAN1pec
MRPTAQRLEDVVPGGSQQPVQAPREGLPRLAALHQRQQRPLADDDVPVGGDRGPVQAEIGSEGVALRVAAGRGPLDGLERDMTQPAQDGGEPPGGSRARPPFQTGIQETGPAWLRRPGQGDRGGQGTGHGELQVRAQCRRTCEHRQLARHGEGRRAGRQLTSCRGHCHHAGPPSTRNAFPCVSSRRTPRIPVDRAMTGVRGLDPPPPLVPHVVTPTPAEGLVRGPRGPNVPAGHGRWSGPRRAWSARPAPSVAGRPRTGHVPRIPAVRPRWSCRADWSCRADWSRRADWSRRADWSDRAGRTSRTRWAGCPATDVEQAAWPGQATEGGGELAGDDPQLAGLALCQPREHLQVLVGEELLVRVALVDGAEDGADGLRLALGGEDLGLPVAFRPQDRGLLLALGPQDLARLDTLGGQDRGPPVAFGPHLLLHRVLDGAGRVDGLELHPVDPDAPPAGRVVEHPAQLPVDLVARGERALEVHPADHVAQRGHGELLDGADEVGDLVGGRARVGDLEVDDGVDPDDEVVLGDDRLGREADHLFPQVDPLPDPVDDRQHDRQARRQRAVVAPETLDHHRPGLRHDPHGPRQEDQDHQCRDRGGDDSAHVHSSSSRRAVSPRSTSSCTITWAPSTRSTRTVAPISNSSVAGYDRADQTSPASRTRPVDPSTRSRTTAGVPTRASVPVRSTGPLVRWRRATGRRPNVSPPAATANPTSCTIRSAPRTARPAPTSAASANMTRTRSSVSNSPTTSAPATMIHTTSSAMTITLIRSTILRSTKPQWRQWTNRSGFARPQVTDGARAVGFVRMSQVWPGSPYPLGATFDGSGTNFAIFSEVAERVELCLFDAVGAERRIELRERDAFVWHAYLPTVLPGQRYGYRVHGPHDPARGHRCNPNKLLLDPYAKAVDGEVDWNQAVFGYDFGDPDSVNTTDSAPHMMKSVVISPFFDWNGDRPPRRPYSETVIYEAHVRGLTMRHEGLPEEYRGTYAGVAHPVMIEHYRRLGVTAIELLPVHQFVHDEHLVSRGLRNYWGYNSIAFLAPHNGYSAAGGDGRQVQEFKGMVRNLHEAGIEVILDVVYNHTAEGNHMGPMLCFRGIDNAAYYRLVDDDPQYYMDYTGTGNSMRVRHPHVLQLIMDSLRYWVTEMHVDGFRFDLAATLAREFYDVDRLSSFFDLVQQDPVVSQVKLIAEPWDLGEGGYQVGNFPPLWTEWNGKYRDTVRDFWRGQDHGIAEFASRLTGSSDLYEDSGRRPWASINFVTAHDGFTLHDLVSYNDKHNEANGEENRDGSDDNRSWNCGVEGPTDDVAVNRLRDAQTRNLLATLLLSQGVPMLVAGDEMGRSQQGNNNAYCQDSPISWLDWSDAERNAGLIDFTAQLSHLRRTHPVFRRRRFFQGESIRGSAGGEDNTGSRPDGAAVVDLAAKDIVWLRPDGSEMSDTDWESGTARSLGCFLNGHGIPDPNTLGEAIVDDSFLLFFNAHHEPIQFRVPPVDFGTTWEIIVDTRSSSAEISAVLGGTDLDPVDVDRVVKAEDPLEVDARATLVLRRVN

SEQ ID NO: 24652 - protein, 359 aa, Hydrogenophilus thermoluteolus
MSWAHTPTLTQYLIEERRRYPQASGDFNALILDMARACKAIARQVAYGALAKSNHAVTTTINVQGEEQKPLDVISNECFMRLTEWGGYLAAMASEEMDEPYLIPEQYPRGRYLLLFDPLDGSSNIDVNVSVGSIFSVLRAPEGKTEITVDDFLQPGTQQVAAGYAIYGPTTMLVLTVGRGVVGFTLDPDFGEFMLTHPNIRIPESTKEFAINTSNARFWEPPVKRYVDECLKGKTGPRGKDFNMRWVASLVAETHRILSRGGVFLYPRDNKEPKKPGRLRLLYECNPIGMIVEQAGGRASTGYGPVLEVQPTELHQRIGFVFGSREEVERIEQYHNDPDASPVDLPLFAERTLFRDETL

SEQ ID NO: 24653 - protein, 276 aa, Hydrogenophilus thermoluteolus
MTEPIQTQMANALRFLAVDATNAANSGHPGAPLGMAEMAVALWRDHLRVAPQAPTWPNRDRFVLSNGHASMLIYALLHLTGFDLPLDELKRFRQLGSKTAGHPEYGHTPGVETTTGPLGQGFANAVGMALAEKLLAAEFNTPEHPLIDHFTYVFLGDGCLMEGISHEAASLAGTLRLSKLICLYDDNGISIDGAVSDWFSDDTAQRFAAYHWNVIGPIDGHDVAAVSAAIAQAKAQAATPDGKPTLIICRTTIGKGSPVKEGTCDIHGAPIGTEAA

SEQ ID NO: 24654 - protein, 445 aa, Synechocystis sp. PCC 6803
MNSPTSPRRPHVVIVGGGFAGLYTAKNLRRSPVDITLIDKRNFHLFQPLLYQVATGSLSPADIASPLRGVLKGQKNIRVLMDKVIDIDPDKQKVVLEDHAPIAYDWLVVATGVSHHYFGNDHWAALAPGLKTIEDALTIRQRIFAAFEAAEKESNPERQQAWLTFVIVGAGPTGVELAGAIAEIAHSSLKDNFHRIDTRQAKILLIEGVDRVLPPYKPQLSARAQRDLEDLGVTVLTERMVTDINPEQVTVHNNGQTETIVTKTVLWGAGVRASSLGKIIGDRTGAELDRAGRVVVNPDLSVASFDNIFVLGDLANYSHQGDQPLPGVAPVAMQEAAYLSKLIPARLAEKEQIMVPFRYIDYGSLAVIGQNKAVVDLGFAQFTGLVAWMIWVWAHVYYLIEFDNKLIVMLQWGWNYFTRGRGARLITDTPNPQSTSTVQKELVRP

SEQ ID NO: 24655 - protein, 368 aa, Arabidopsis thaliana
MGKHKSFRSKAVHFVTDLTAGLLNPISDKPSSAHPPPPLPVPKDEEDESKRNQLESTTAEQPKDLVDEPDTSSFSAFLGSLLSSDPKDKRKDQDPEDEEDEEEDEEEDSEAETSDTSSSSANPTRTMKETTSGGAAKKSFLSKYKQHFRNFYQAVKFPGVKERKGNSDVIPDDEETEYYDGLEMKPMQNNNVKEEVTVVVQAIIPEISEPSLLLSEQSRRSLYTSLPALVQGRKWILLYRKGSVFGGLVEAPLIPTDKKYQGTNSTFVFTNKSGQPTIYRPTGANRFYTLCSKEFLALGGGGRFALYLDSELLSGSSAYSETYGNSCLADSQDFDVKEVELWGFVYGSKYDEILAHSKTMEPGLCRWS

SEQ ID NO: 24656 - protein, 375 aa, Chondrus crispus
MSAFVPAATVARLSSTRTSSRTALSSKSSSLVASRPLGLRVGVALRTPTPSPRAAISMIATGEPLEDWLQRAEKDLGKCTRGIFAACKEVAYKIRTASCDKMSCFNDFGDEQLAIDVLADKVIFDNLTESGVVAVASSEELPIEKPITPGGKFAVAFDPLDGSSIIDTNFSVGTIFGVWKGDRFVGQDGHGVVCAGLTIYGPRTTITLAIDGVDGAHEFLLIDDFSAKHGSWIHTAAFSTVNEGKLFAPGNMRAAQDNPGYAKLLEHYYSNKYQLRYTGGMVPDVNQILVKGKGVFCNPASPSAKAKLRVLYEVLPIGYVIEKAGGKSSNGAGSVLDIKIKSCEDRSQVCYGSADEVARFEELVGVTYAVEEATV

SEQ ID NO: 24657 - protein, 306 aa, Thermotoga maritima
  misc_feature (173)..(173): Xaa can be any naturally occurring amino acid
  unsure (1)..(306): unsure at all Xaa locations
MGSDKIHHHHHHMFRGVGTAIVTPFKNGELDLESYERLVRYQLENGVNALIVLGTTGESPTVNEDEREKLVSRTLEIVDGKIPVIVGAGTNSTEKTLKLVKQAEKLGANGVLVVTPYYNKPTQEGLYQHYKYISERTDLGIVVYNVPGRTGVNVLPETAARIAADLKNVVGIXEANPDIDQIDRTVSLTKQARSDFMVWSGNDDRTFYLLCAGGDGVISVVSNVAPKQMVELCAEYFSGNLEKSREVHRKLRPLMKALFVETNPIPVKAALNLMGFIENELRLPLVPASEKTVELLRNVLKESGLL

SEQ ID NO: 24658 - protein, 1020 aa, Lactobacillus plantarum
MPKNNAIHSIAVIGSGPIKIGQAAEFDYAGTQACLSLKAAGYHVILINSNPATIMTDTATADEVYLEPLTLTSVTKILRAAHPDALLPTLGGQTGLNLAMALDQAGVLNELKIQLLGTSLATINQAEDRAAFKTLMKRLHQPIPASTTVHHVTSALSFAEKIGYPVIVRPAFTLGGSGGGIANNAAELTQTLQRGLTMSPVTECLIEQSIAGFKEIEFEVMRDNQGTKIIVCSMENFDPVGIHTGDSIVYAPVQTLTDTEYQQLRTAALTIVEALDIRGGCNVQLAQDPNSRQYYVIEVNPRVSRSSALASKATGYPIAKIAADIAIGLNLSEIKNPVTQTTYAAFEPALDYVVAKIPRFAFDKFPTADAHLGTQMKATGEVMAIGSTLEEATLKAIASLEIDPKTQASLTPDHHVTTTEYIDQLTHPTDQRLFYLLAALQAGWPLAKLATLTQITPFFLSKLQHIAQLIRNIKQVPTSQHLLSAKKYGVSLATMAHYAQTSVATIAAMTADLPFVYKMVDTCAGEFASVTPYFYSTAFGQTNESHPLGHSILVLGSGPIRIGQGIEFDYTTVHCVKAIQQAGYHAIIVNNNPETVSTDFSTSDKLYFEPLTIERLMPIIALEQPAGVIVQFGGQTAINLAHQLTKLGVTVLGTSVSATDLTEDRQSFADCLRLLKIAQAAGTTVTELSGARQAAHAIGYPLLVRPSFVLGGRAMAIVHNDHELTPVIKSAVAAGHGAPILMDQYLAGTECEVDVLSDGTSCFIPGIMEHIEGAGVHSGDSITVYPPQHLSPAVQDKIVTIATKLAQHLHCVGMMNIQFVVTDDVYVIDVNPRASRTVPYMSKVTHLPLAQLATRLILGQSLATLGLVPGLLTPAPQQIAIKAPVFSFNKLPQSPVVLSPEMKSTGETLGIGPTFTTAWHAAMADSYHLETWQTVDGLITDIATVAQPAVQELFAANHLTVTTIANTTDWPAKTKAVGFTLNDQPDNPVAIAALNHGQPLITAIDTLKTLLAVTPTPATI

SEQ ID NO: 24659 - protein, 392 aa, Cytophaga hutchinsonii ATCC 33406
MESSEPLVLDVGNLKRGEIIINMGPQHPSTHGVLRLEILTDGEIVKDVIPHMGYLHRCYEKHAEKLPYNQVIPFVDRMDYLAAMNSEHAYAMGVERMLGIENDIPKRVEYIRVLVAELNRISSHFVAIGTYGLDIGAFTPFLWVMRDREHINRLLEWVSGARMLYNYIWVGGLFYDLPVGFEERCKDFISYLKPKLAELQKVIIDNKIFIERTANIGVLPLDLAINYGITGPMLRASGLKFDLRKVDAYSVYPEIDFDIPVGTGAVGTTGDCWDRTHVRVAECFESVKIIEQCLEKLLGEHKRTREFDPQAIVPKKIRPKVMDFYVRAENPKGELGFFFRTTGNTDIPFRCKVRAPSFVNLSVLQAISKNVMIADLVAILGSFDIVMGEIDR

SEQ ID NO: 24660 - protein, 809 aa, Ostreococcus tauri
  misc_feature (282)..(289): Xaa can be any naturally occurring amino acid
  unsure (1)..(809): unsure at all Xaa locations
MTAKWRARLSGNPTGGGGNPTGGGAGVAPPPCTPLRATANHPKNRYISITGYTASALRLPGTAALTNGTLARHDHATARPTTTVRKYLFSLAKHAAAANTNGTTQYPNSATLCKNIILPPSNSTFAVSATAPIPTVAKTTLNVSLAFFVPALSSALSAKTKNSGPQRSHSRSLRAPSAWKFVGNSTATQFFRTSSASRASVSQMDSSSVLHDDASTSMFPLPSSPALAADARMALVKSGSTAPSNAPLDIPIDPWARTNPSTRARCARPRARDARGRSKGTXXXXXXXXRGVAAGACKLTTSVVAPSVPIALLDVEEAIELGADVVELRMDFLERRGREATEALLRKCERPAIVTNRPIWEGGRNDGDEDERLDSLWEAYELGAAYVDCELLAAERFFARAPDSFKSGGNGKTKIILSSHNYEETPSDVELAKIHAACVAAGADIVKIACVCKEIEDVERLERLLRERGGEKETIALGMSEHGQVSRLLAAKFGSYLTFGAIRRGAESAPGQPLLGELRDMYRVPTQTSSTKVMGVIGNPIGHSKSPALHNPCLAAANVDACYVPLLVKDIKQFLASPLFGSEDFVGFSVTIPHKEAALEACAEVDPVAKQIGAVNTLVRQPDGSLKGYNTDYAAAIDAIEVAMEKKTGTPAAKALEGKTVVVIGAGGAGKALAFGAKFKGANVIIANRSVERAQALADACGGRAVSLEDLAEGRASGDVLANTTSVGMQPYIAESPAPASVLGDFSVVFDAVYTPLDTRLLREAKEAGCEIASGLDMFVGQAARQFELFTGETADISLMREAVLSSMK

SEQ ID NO: 24661 - protein, 437 aa, Glycine max
MAEDFQAAICGENWWNNINPTRSVFPLMPSTCSVAAADHAGNYSTWQSTTDFVDLKGTRSCAELETDNNLSFLDAEKPQQSESGSILINSTLQMMGFGKSSSTSSNWNQSLLGSGFDSVLQEETGIGGGSQVSTVDALKPMNQEFSLDQQSLNSVVTSTGSLSGGFPVVSASYGYPSTLIQSLYEPEPQPQQQNSLFTNPSMSYSSSSANYGICSNELSPTWSKVSSLPKPSMPKQQLSGLHFSNNTAFWNSSAEALNDIRAGVFTSSQAQYQMAKFEEKPNCPNTLLNKLKREESPDAAKKNSPEPAFKRQRIETPSPLPTFKVRKEKLGDRITALQQLVSPFGKTDTASVLHEAIEYIKFLHDQVSVLSTPYMKNNGAPIQHQQDCDNLKDSEGAKQDLRSRGLCLVPISSTFPVANETSVDFWTSTFGGALIGR

SEQ ID NO: 24662 - protein, 307 aa, Zea mays
MAGRLAGRGGRPLLGGSGGGGKRGGRPSMAVVAALLLACAALLLLLALGALSLPGASDGSGGRGAGLSLSRPRSRFRRSAFDSGLETRGEKGEPWTEVLSWEPRAFVYHNFLSKEECDHLISLAKPHMKKSTVVDSATGGSKDSRVRTSSGMFLRRGQDKIIRTIEKRIADYTFIPVEQGEGLQVLHYEVGQKYEPHFDYFHDDYNTKNGGQRIATLLMYLSDVEDGGETVFPSSTTNSSSSPFYNELSECAKGGLSVKPKMGDALLFWSMKPDGSLDPTSLHGGCPVIKGNKWSSTKWMRVHEYKV

SEQ ID NO: 24663 - protein, 218 aa, Chlorobium tepidum TLS
MIEAILWDNDGLLVDSESLFFEMTRTFFAEAGLQVEAEYWGVEYLGNAKHSYQIAAELGLAPELIPSLLDRRNEAFVQRLRHSVPLMPKVRETIEALAGTVRLAIVTGSPRDKVLLMHGNNGLLDHFEVIVTDDEISNPKPHPEPYLKAMEMLGVKPERCLAVEDSQRGLDSAVAAGLRCIAVPNALTKVQRFDRAHAVEADVSGVLKHVNATKRLAR

SEQ ID NO: 24664 - protein, 522 aa, Clitoria ternatea
FLLREIGVSILIFMITHLVIRLVLKEKEQRKLPPGPKGWPIVGALPLMGSMPHVTLSEMAKKYGPVMYLKMGTNNMAVASTPSAARAFLKTLDLNFSNRPPNAGATHLAYDAQDMVFADYGSRWKLLRKLSNLHMLGGKALEEWSQVREIEMGHMLRAMYDCSGGGDGNNDNDGNKKKGTRHEPIVVAEMLTYAMANMIGQVILSRRVFETKGSESNEFKDMVVQLMTVAGYFNIGDFIPFLARFDLQGIERGMKTLHNKFDVLLTTMIHEHVASAHKRKGKPDFLDVLMAHHTNESHELSLTNIKALLLNLFTAGTDTSSSIIEWALAEMLINPKIMKKVHEEMDKVIGKDRRLKESDIENLPYLQAICKETYRKHPSTPLNLPRISSQACQVNGYYIPKNTRLSVNIWAIGRDPNVWENPLEFNPERFMGANKTIDPRGNDFELIPFGAGRRICAGTRMGIVLVQYILGTLVHSFDWKLPNGVVELNMEETFGLALQKKIPLSALITPRLPPTAYNVINS

SEQ ID NO: 24665 - protein, 172 aa, Synechococcus sp. CC9605
MDLQSHIRSIPDFPKPGILFRDINPLLRSPEAMAEVISQFGRICDQVKPDLIVGIESRGFIFGAPLASDRRLGFVPVRKPGKLPGEVVGLDYALEYGTDRLEIQADALEHSPRVLVVDDLLATGGTAAATGQLVEQAGGCLVGFAFVIELEGFGGRRALPAGQPVEALLRYG

SEQ ID NO: 24666 - protein, 561 aa, Ostreococcus tauri
MRETTIDLVAYLSGMNLEPERPARPCETGRYVIAYSPRYDPIISGLISTVLNTLPLYTPTTEPTISGMMGMLRRCVRTVSGFSIPTTAALALRSFLIKFLCFMVKPLRLKRRRMRALNNTFQVDPAVGELLVRVLLTRLPDEGIFFGLRGLRSENAFVEVSLSPPRALAQPSQVIPSAASTSEGARDAFGAFERWASDAAGAVDGSSAERGWRRVDEAYVLAPKGDAKATRVIHFCGGAFVGASPQVTYSEMCETLVREGNAIVIATPIAMGLDHLRVADEAWQRYERCARELRRNVDGFDELPVYGVGHSFGALLTVLIASRYETKRRGNVMMSFNNKPATDAIPLFADVLAPGLRGLSPILDAANKSPLRSLQRNADTQLREFAPPLVRELLPILDTLEPVILEIADGRAEFTPTPTESGKLIQKYYSTKKNLLIKFQDDTIDETSALAATLAGAVAASDLDLTVRARPGDHVFPLWRDTGIEIPTEIYDVAEQGGDILAAFGDAFGIRPDASPLGVLRESFDRARAQAREARDAPGSDENRARMRALVADVLVWMDTP

SEQ ID NO: 24667 - protein, 514 aa, Verbena x hybrida
MTFSELINILFWDLTAAILLYVALILVCSLYSKPSTVSRNLPPGPKGFPVVGALPLLGNMPHIALAKMAKTYGPVMYLKVGTWGMAVASTPDAARAFLKTLDTTFSDRPPNAGATLLAYNAQDMVFAHYGPRWRLLRKLSNLHMLGAKALEDWADVRSSEVGHMLQAMLTSSLRHEAVALPEMLIYSMANMIGQVILSRRVFETKGKEVNEFKDMVVELMTSAGYFNIGDFIPALAWMDLQGIEKGMKSLHKKFDDLIGRMLDKHLESAHKRNAKPDFLDVILANRHNSEGESLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSGKNAKIDPRGNNFELIPFGSGRRICAGARMAMVLVEYILGTLVHSFDWELPVGVDEMDMEEAFGLALQKAVPLAAMVSPRLPPHCYAP

SEQ ID NO: 24668 - protein, 516 aa, Verbena x hybrida
MTTFSELINILFWDLTAAILLYVALNILVRSLYSKPSTVRRNLPPGPKGFPVVGALPLLGNMPHIALAKMARTYGPVIYLKVGTWGMVVASTPDAAKAFLKTLDTTFSNRPPNAGATLLAYNAQDMVFAHYGPRWRLLRKLSNLHMLGGKALEDWADVRSSEVGHMLQAMLSSSLRHEAVALPEMLIYSMANMIGQVILSRRVFETKGKEVNEFKDMVVELMTSAGYFNVGDFIPALAWMDLQGIEKGMKSLHKKFDDLIGRMLDKHLESAHKRNAKPDFLDVILSNHDNSEGERLTTTNIKALLLNLFTAGTDTSSSTIEWALAEMIKNPTILKTAHNEMDRVIGRDRRLLESDLPKLPYLQAICKEAYRKHPSTPLNLPRISSQPCIVNGYYIPENTRLSVNIWAIGRDPDVWENPLDFNPDRFLSEKNVKIDPRGNNFELIPFGAGRRICAGARMAMVLVEYILGTLVHSFDWELPVGVDEMDMKEAFGIALQKAVPLAAMVTPRLPPHCYAP

SEQ ID NO: 24669 - protein, 407 aa, Vibrio cholerae O1 biovar eltor str. N16961
MQDTLAVILAGGMGSRLSPLTDDRAKPAVPFGGKYRIIDFTLTNCLHSGLRRILVLTQYKSHSLHKHLRNGWSIFNPELGEFITVVPPQMRKGGKWYEGTADALFHNMWLLARSDAKYVVVLSGDHIYRMDYAAMLEEHISKNATLTIACMQVPRHEASAFGVMAIDDDSRITCFVEKPADPPCIPNRPDHSLASMGIYIFNMDVLKKALTEDAEIEQSSHDFGKDVIPKLIATGSVFAYSFCSGKGRVARDCYWRDVGTIDSFYDANMDLLQPVPPMNLYQKNWAIRTYEQQYPPARTVSSATGNEGIFINSIIANGVINSGGSVQHSIISSNVRINDSALIVDSILFDDVEVGEGCKLIHCIIDKHVKIPPYTEIGLNPIEDRKRFHISERGVVVVPESYQFSTE

SEQ ID NO: 24670 - protein, 248 aa, delta proteobacterium MLMS-1
MDALLYSFLAGGSTVFGALLFVFVGAPGKRTMALLLGFAGGIMLALSVFELMPEALELGTMTSTIIGFIFGCALLYLLDIYLPHAHMSTSDEMVVENAERTPTFDKSILRMGYLVFFGIALHNVPEGLAIGAGLEASPELGAAIALAIALHNIPEGIAVAGPLRAGGLSVTKVAIFTFAAGMMTVVGAALGLFLFALSPIFIGGALAFAAGAMVYIVNDELIPQANSLHSHLANTGLIVGLLIGFVVL

SEQ ID NO: 24671 - protein, 146 aa, Mesembryanthemum crystallinum
SVWRAINKQTGEVVAIKKMKKKYYSWEECINLREVKSLRKMSHPNIVKLKEVIREHDILHFVFEYMECNLYQLMKDRGRPFSEVEVRNWCFQVFQGLAYMHQRGYFHRDLKPENLLVSKDLIKVADFGLAREISSAPPYTEYVSTR

SEQ ID NO: 24672 - protein, 156 aa, Zea mays
MKLEVMPKPKQRVLEAQQREEAMEMSGLDLWKHEKPPRICPLPPSLPPPPPAFDEAALVPPLNFAVVDDGIFRSGFPGTANFRFLKSLNLRSIVYLCPEPYPGTNTEFLEKNGIRLHQFGIEGRKVNPKSINNRATCFQRNLLLLCGRLAMVHGGV

SEQ ID NO: 24673 - protein, 430 aa, Gibberella zeae PH-1
MGQTLSEPVVEKTSEKGEDERLIYGVSAMQGWRISMEDAHTTVLDLDTAKTHDSKLSFFGVFDGHGGDKVALFTGQNIHNIIFKQDTFKSGDYAQGLKDGFLATDRAILNDPKYEEEVSGCTACVSLIAGNKLYVANAGDSRGVLGIKGRAKPLSQDHKPQLENEKNRITAAGGFVDFGRVNGNLALSRAIGDFEFKKSAELSPENQIVTAYPDVEQHDLTDEDEFLVLACDGIWDCQSSQAVVEFVRRGIAAKQELEKICENMMDNCLASNSETGGVGCDNMTMCIIGFLNGKSKDEWYEEIARRVANGDGPCAPPEYAEFRGPGVHHNFEDSDSGYEMDPENKGRSFGVGGYRGRIIFLGDGTEVLTDSDDTEMFDNADEDKDLASQVSKNPTSAEKDTAPVAAPGAAENASADTKPADSAKTEVKKE

SEQ ID NO: 24674 - protein, 396 aa, Arabidopsis thaliana
MFAQGSLPFLSLTGVSPNTHSRRGARFTVRADTDFYSVLGVSKNATKAEIKSAYRKLARSYHPDVNKDAGAEDKFKEISNAYEILSDDEKRSLYDRYGEAGVKGAGMGGMGDYSNPFDLFESLFEGMGGMGGMGGGMGSRGSRSRAIDGEDEYYSLILNFKEAVFGIEKEIEISRLESCGTCNGSGAKAGTKPTKCKTCGGQGQVVASTRTPLGVFQQVMTCSPCNGTGEISKPCGACSGDGRVRRTKRISLKVPAGVDSGSRLRVRGEGNAGKRGGSPGDLFAVIEVIPDPVLKRDDTNILYTCKISYVDAILGTTLKVPTVDGEVDLKVPAGTQPSTTLVMAKKGVPVLNKSKMRGDQLVRVQVEIPKRLSKEEKMLVEELADMSKNKVANSRR

SEQ ID NO: 24675 - protein, 299 aa, Triticum aestivum
  misc_feature (80)..(80): Xaa can be any naturally occurring amino acid
  unsure (1)..(299): unsure at all Xaa locations
VTYEKWVQKSRLPPSPEFPGYRRPTRPRAHGITIAPFVPPIVVEIAKSPQVTAGDLASIRMVMSGAAPMGKRPQDAGRAXIPNAVLGQGYGMTEAGPVLAMCLAFAKEPFKVKSGSCGTVVRNAGLKIVDPDTGASLGRNQPGEICIRGEQIMKGYLNDPESTKNTIDKDGWLHTGDIGLVDDDDEIFIVDRLKEIIKYKGFQVAPAELEALLITHPEIKDAAVVSLKDDLAGEVPVAFVMRIEGSEITEDDIKKFVAKEVVFYKRIHKVFFTDSIPKNPSGKILRKDLRARLAAGIPS

SEQ ID NO: 24676 - protein, 859 aa, Magnaporthe grisea 70-15
MERLTLPRIRKLSRLPSALTRATTLWTCSSCRHQANSGWRRMASTEAAKKPFYVTTPIFYVNASPHIGHLYTLVLADVFKRWRVLQGEKALLCTGTDEHGMKIQRAAAASNMTPKQLCDANSEVFLDLAEKAGIDNDFFIRTTDPDHKEAVQYFWDRLWDRGYIYEATHKGWYCVSDETFYPESTIEKRKDPMTGEVFLASKETGNAVEWMEEKTYHFRLTALKDRLLKFFEENPEWIVPAPRMKEVVDWVENSLEDLSVSRPTSRLDWGIRVPNDESQTIYVWIDALVNYVTKAGYPYWTPETVQKDGWPADIHIIGKDIVRFHCVYWPALLMALDLPLPRRILTHSHWTLGGKKMSKSLGNVVNPFLAMDRFGVEVIRYFLISNGRLLQDASYDNKILVDIYKRQLQGGVGNLLGRVMRSKKWNVREIVERCSKEGRPTNSNVEPKYSSFEQRLFQLPGTVVDAFGELDPGAALRSIADMATETNKFITDCAPWSVTNENDADAAELNVRSCIYLCAESLRIMGILLQPFVPNKSSELLDMLGVKETHRDLSHARLGADSTYGVPQVALGSSGVHSGLFPALVVEGISTPVYTPTQKVRFEIDACFILVHLTGFWHLMLLTPPSFLPAISTDQILLVPYDKHHVVTYHRWMEDPAIQEATASEPLTLEEEYENQQSWRDSHDKLTFILCQPAKAEENKMEAGQCDSPDRMIGDINFFLYPWDEGEEDDQQTTNPEKAEYVGEIDVMVADTSQRGKGIGKAAVDAFMHYICCNQKPILQEHHGVTGEPSLRKFMVKIKADNRASIALFRGVGFQQDGDVDYFGEVKMVLDDFGGVASKAVPGFRELTYCRTLALGGST

SEQ ID NO: 24677 - protein, 491 aa, Ostreococcus tauri
MGTTARDAGAVTTRARRRGTGATSEASRVVHAVDADARTYTAAEVATHARADDCWVIVRGGVYDVTAFVPRHPGGNMIYVKAGGECTALFDSYHPEKARGVLEKYRIGDLTREEGSAADGDIVEYAKDDLKDGAFFADCKAGAAKYFKENKLDPRVHWEMYAKTAAILVGIVVGHYYSFFAPGVSFGAALAFAALHGTCKAEVGVSIQHDANHGAYGNSRTWLHAMQLTLDVVGASSFMWKQQHVAGHHAYTNVEGIDPDIRCSEKDIRRVNEHQPHEPYHVFQHVYLAFMYGLLSLKSCFVDDFNAYFSGRIGWVKVMKFTRGEAIAFWGTKLLWAAYYLALPLKMSHRPLGELLALWAVTEFVTGWLLAFMFQVAHVVGEVHFFTLDAKNRVNLGWGEAQLMSSADFAHGSKFWTHFSGGLNYQVVHHLFPGVCHVHYPALAPIIKAAAEKHGLHYQIYPTFWSALRAHFRHLANVGRAAYVPSLQTVG

SEQ ID NO: 24678 - protein, 268 aa, Pseudomonas fluorescens Pf-5
MLRSNAHSRFIALVNFILRWDKAHTKSAALYTGVTETETTPLAASTLGIAPIGNPMQLKNPILGLCQQATFMLSAAKVDQCPDDEGFEVAFAGRSNAGKSSALNTLTHASLARTSKTPGRTQLLNFFKLDDDRRLVDLPGYGYAKVPIPLKQHWQRHLEAYLGSRESLKGLILMMDIRHPMTDFDLLMLDWAVASGMPMHILLTKADKLTYGAAKNTLLKVQSQIRKGWGEAVTIQLFSAPKRMGLEEAYTVLAGWMELADKGAEAEA

SEQ ID NO: 24679 - protein, 372 aa, Pseudomonas sp.
MIKSRAAVAFAPNQPLQIVEVDVAPPKAGEVLVRVVATGVCHTDAYTLSGADSEGVFPCILGHEGGGIVEAVGEGVTSLAVGDHVIPLYTAECRECKFFKSGKTNLCQKVRATQGKGLMPDGTSRFSYNGQPIYHYMGCSTFSEYTVLPEISLAKIPKNAPLEKVCLLGCGVTTGIGAVLNTAKVEEGATVAIFGLGGIGLAAIIGAKMAKASRIIAIDINPSKFDVARELGATDFVNPNDHAKPIQDVIVEMTDGGVDYSFECIGNVRLMRAALECCHKGWGESVIIGVAPAGAEINTRPFHLVTGRVWRGSAFGGVKGRTELPSYVEKAQQGEIPLDTFITHTMGLDDINTAFDLMDEGKSIRSVVQLSR

SEQ ID NO: 24680 - protein, 80 aa, Zea mays
  misc_feature (29)..(29): Xaa can be any naturally occurring amino acid
  unsure (1)..(80): unsure at all Xaa locations
HTRMLDRMGNNMAASRGFFSGPVDKFKMXFERKSTRRMAPMVASFIAVFLLKNPLTKNQPGCLAIRFPVPAPVVSLGVIM

SEQ ID NO: 24681 - protein, 465 aa, Verbena x hybrida
MAALSRVYGPLMHLKMGFVHVVVAASAGAAEQFLKVNDANFSNRPPNAGAKYVAYNYQDLVFAPYGPRWRLLRKICALHLFSAKALEDFRTVRQEEVGILTRALASAGQTPASLGQMLNVCATNAIARVMLGRRVVGHSSGGGDEKAEEFKEMVVELMKLAGVFNIGDFIPPLERFDLQGVTANMKKLHKRFDAFLGAIVEDHKINSLGRSGEPHVDLLSTLISLKDEDDGEEGKINDTEIKALLLNLFSAGTDTTSSTVEWAIAELMRHPKILAQAQQELDSVVGQNRVVSESDLTQLPFLQAIVKETFRLHPSTPLSLPRIAEKSCEINGYFIPKGSTLLVNVWAIARDPNVWADPLEFRPERFMPGGEKPNVDVKGNDFELIPFGAGRRICAGMSLGIRMVQLLTANLIHGFDFELGNGLSAQQLSMEEAYGLTLQRAEPLVVHPKPRLAPHVYQSSVASVG

SEQ ID NO: 24682 - protein, 171 aa, Triticum aestivum
  misc_feature (36)..(36): Xaa can be any naturally occurring amino acid
  misc_feature (53)..(53): Xaa can be any naturally occurring amino acid
  misc_feature (77)..(77): Xaa can be any naturally occurring amino acid
  misc_feature (93)..(93): Xaa can be any naturally occurring amino acid
  unsure (1)..(171): unsure at all Xaa locations
HSTVSISWIFGASRFFSVTIFLVPGLLLFLLFLCLXAGLNEKLLPLIKRFFSXPGPIGLISALAQLGVGPPVFPIPXAPLALAERPEFPRPVXPPGRDNFLGQKDLPVLAHEDFVLICPDPPKHFIVAPGRDEHQKFSFYHFISCSTPPSFICTVIAPKHCNPEGNLCTLN

SEQ ID NO: 24683 - protein, 398 aa, Polaromonas sp. JS666
MKIAQRAQRIEPFYVMEVAKAASALAQEFAGSGKPMIFLNIGEPDFTAPPLVQEAAARAIAQGTTQYTQATGLPALRERISGWYASRFGVQVAPSRIIVTAGASAALQLACLALIEAGDEILMPDPSYPCNRHFVSAAEGNAVLIPTTAEERFQLTREKVQAAWNDKTRGVLLASPSNPTGTSIAPEELQRIHEFVHGQGGVTLIDEIYLGLSYEEHFGHSALAMPGELGQSVISINSFSKYFNMTGWRLGWLVVPEALAPVVERIAQNLFICASTVAQYAALACFEPDSLQEYERRRAEFKARRDYFIPELNRLGLRVPVMPDGAFYAYADCTETAARLGVSGSWDLAFELMKRAHLAVTPGRDFGQAAPEKFVRFSTANSMEQLREAVARLRTLLA

SEQ ID NO: 24684 - protein, 187 aa, Oryza sativa (indica cultivar-group)
MAAKAAFPAPAGDEPAIGIPYHPAAAGAQGGYYYAPDPYAAGMPPPNAIYAGAPKGVPLQQTMFRDTPAPFHCQACGAAAVSSLRRIHDWLSVKLSFYRGGPKIQFFSQSMGGIVWQRSKPSLASVVACMMPFMMGVCFLCPSMDCLWHKYHYCPSCGEKVAEFKKSDPCLVVDPTRWSEPSFAVPA

SEQ ID NO: 24685 - protein, 144 aa, Glycine max
  misc_feature (11)..(11): Xaa can be any naturally occurring amino acid
  unsure (1)..(144): unsure at all Xaa locations
GFPSGLWTQLXTVCLVLDDHGYAISPRKLQFNTKLSAFFEFLATSVVGDGRTFVSTGGGRKYPVRFHLWRPEKNRFDWATSLRAPRSGVAIRFTRSSPRFFIWGARISTNPPDAQKVGVNFFSSCKPTLGGSPGKGYAQVCFFE

SEQ ID NO: 24686 - protein, 269 aa, Oryza sativa (indica cultivar-group)
MTAPNIEMIASSLRNCSLNGGGGGGGGRRRGRRAAAAEGSDDSEGVTVELNSEVALPYHWEQCLDIRTGQVYYINWEDGTRTTIDPRSSSAYSPSPASRSASSSSRRCSRARGRGGGGGAAAAASTTTSSGYTSVSSVGAVTAAAAAWRSHDSSGHGYGYGSYGYGYGYDGRDGDDEESSSSSSSSSSSSSASSSRGSAVSSTLSSFSPTDESASGAGSGYAVGDNGAHVLVAAGCRACFMYFMVPKTADVCPKCGSSGLLHLSRNGYV

SEQ ID NO: 24687 - protein, 328 aa, Petunia integrifolia subsp. inflata
MAVNGVSSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 24688 - protein, 336 aa, Ralstonia metallidurans CH34
MTDRAMSYPRILADVGGTNVRFAMETAPMRIGEITAYKVAEHASLEAAMRLYMLTRSGAARPRHAAIGLANPVTGDQVKLTNHNWAFSVEAMRRALDLDTLVAINDFTSLALALPYLPDASLVQVRDGTAVATAPRALIGPGTGLGVSGLIPAPGGAVALAGEGGHIEIMPVTDDEWIAWRAAHDQFGRVSAERLLSGMGLSHIHAALSAEMGTPLEVPLAPAQVTDGAMRAGDPVCRRAFDAFCGMLGSVAADVALVLGARGGVYLGGGIVPRFVDALRASTFAERFVAKGRMGSFLADVPVYVITAEYPALPGLARALADRLEADARRAETSQS

SEQ ID NO: 24689 - protein, 166 aa, Mesembryanthemum crystallinum
LVFLARIKPPSPNRGKSIAIKKFKQSKDGDGISPTAIREIMLLREISHENVVKLVNVHINSADMSLYLAFDYAEHDLYEIIRYHRDKVNQAINQYTVKSLLWQLLNGLNYLHSNWIIHRDLKPSNILVMGEGEEQGVVKIADFGLARIYQAPLKALADNGVVVTIW

SEQ ID NO: 24690 - protein, 494 aa, Verbena x hybrida
MSIESLPLFLVLFSILCTVITLILTTNYSRKSSKLPPGPFQYPIIGNIFELGSQPHRSLAKLSQKYGPVMSLKLGSITSIIISSPETAKSVLQKHDSVFSSRTVPASLQSVHHHKFSMGWLPDDNQWRKLRKISKEQMFSVQSLNASQELRMEKLQKLGDYVQECSETGRVVDIGDAAFTTSLNLMSGTLFSAEFAQFDSDSSQEMKDVFWGVMKCIGTPNFADYFPVLRVADPQGILREIKFYFQKLFDIFDDIIDGKLKSRGEQKSHDLVEALIDINQRDEAELSRKDIKHLLLDLFVAGTDTTSTTVEWAMSELLRNPEKLSRVRDEITDLVGKDGQIQESDISQLPYLQAVVKETFRFHPPAPFLAPHKAKADVEINGYIIPKNAQILVNVWASGRDPNVWPNADSFVPERFLDSNFDQIDFRGNDFELIPFGAGRRICPGLPLAYRMVHLMLVTLVHKFSWKLEKMDMNEKFGLTLQKAVPLRATPTKL

SEQ ID NO: 24691 - protein, 380 aa, Nicotiana tabacum
MSSTVGQVIRCKAAVAWEAGKPLVMEEVEVAPPQKMEVRLKILYTSLCHTDVYFWEAKGQNPVFPRILGHEAAGIVESVGEGVTELAPGDHVLPVFTGECKDCAHCKSEESNMCSLLRINTDRGVMIQDGQSRFSINGKPIYHFVGTSTFSEYTVVHVGCVAKINPLAPLDKVCVLSCGISTGLGATLNVAKPTKGSSVAIFGLGAVGLAAAEGARIAGASRIIGVDLNASRFELAKKFGVTEFVNPKDHNKPIQEVIAEMTDGGVDRSVECTGHIDAMISAFECVHDGWGVAVLVGVPHKEAVFKTHPMKLLNERTLKGTFFGNYKPRSDLPSVVEKYMNKELELEKFITHKLPFAEINKAFDLMLKGEGLRCIINMED

SEQ ID NO: 24692 - protein, 172 aa, Mesembryanthemum crystallinum
IGEGTYGKVYRAREKATGKIVALKKTRLHEDDEGVPPTTLREVSLLRMLSRDPHVVRLMDVKQGQNKEGKTVLYLVFEYMDTDLKKYIRSFRSMGQTVPPQNVKSLMYQLCKGVAFCHGHGVIHRDLKPHNLLMDRKDMTLKIADLGLARAFIIPIKKYTHEILTLWYRTPE

SEQ ID NO: 24693 - protein, 523 aa, Frankia sp. EAN1pec
MMPPAGRRHRGWHSTRGTEATDHAHVMARTARLGDNRTSEPARALRTGRAPEGGRRRHPAVPWREEPGVTEQVSSLTVTDNRTGRTYEVPVADGTIRASAFRAIKVDDDDFGLMAYDPAFTNTASCRSAITYIDGDAGILRYRGYPIQELAEKSSFLEVAYLLLAGELPTSDELSTWEDEITHHTLVHESIKKFIDGFHHDAHPMGMLVSTVGALSTFYPDAKTIDDPGLRRLQIVRLIAKITTLAAFSYRHSVGFPYVYPDNDLSYAGNFLNMMWKATELKYEPDPNLEHALDVLFILHADHEQNCSANAMRAVGSSQADPFSAAAAAIAALYGPLHGGANEQVLRMLADIGSVENIPAFIAQVKDGKKKLMGFGHRIYKNYDPRARVIRQVADEVFKVTGTNPLLDLAMELERIALEDEYFISRKLYPNVDFYTGIIYQAMGFPVEMFPVLFAIGRMPGWLAQWEEGLLDPEQKIARPRQLYIGYDERPYVPMHVRSAATDAETDPIAAQAAQAAPSRPLR

SEQ ID NO: 24694 - protein, 459 aa, Vibrio cholerae O1 biovar eltor str. N16961
MLNFFKTRPDLPLLSSSKAEMLKRYKSYQWQVFIGLIFGYAMFYVVRMALGVVKKPMLDAGIVTLEELGIMGSAFFFTYAFGKFLNGFLSDYANIGRFMSFSLLLSGVASIFMGMNTVAFFFVLLWGLNGWFQSVGSAPSCVSIYQWFSPKQRGSRYSIWGGSRNIGEGITWILTASLVSYFGWRAGFIGAGIAGVVASLIMFKLLKDRPQTYGMPDPGTAFEEGTEIKKANDPKETRRAQMFILKQPVVWLIALACAAMYISRYAMSSWAVLFLQEQKGYSLIDAGFAMSMYPTAGLAGAILSGILSDKVFKGNRNIPNLLYGLTNIAGMCLMFFGPDNRIVDAVALSMIGFSIGGLVVFLAGLIACDLMPKNAVGAVKGLIGLCSYIAASAQELISASLITVTEVEGVKHYDFGNAQYFWLAAGVVSVLLALTVWNAKKVVDIDEAEGKPLKTQTAS

SEQ ID NO: 24695 - protein, 487 aa, Bradyrhizobium japonicum USDA 110
MSADFSRRHFAKLAGLAALGAATGVGAAESETPASAGRGAPFPKDFLWGTATSSYQIEGAVNEDGRGKSIWDVFSHTPGKIEDGSTGDRANEHYHRYREDVALIKALGVRAYRFSIAWPRVFPDGTGQPNPKGLDFYNRLVDELLASGIEPYATLYHWDLPQALQDRVGGWQSSDTSKAFADYAAYVAARLTDRVKNVFTVNEVGRFVNFGYGWGIDAPGLKLPAVQLNQARHHVALAHGLAVQAIRASGRAGTRVGAAENIAACVPAIATAENIRAAEIATRELNAGFLGVVLEGRYTDGFLAYAGADAPKFTAEELKIIGAPTDFVGLNIYAPQFYVTASDRAPGFHVLPFPTSFPHMNSEWLRVGPEVIYWAPRLAAKIWNIETIYISENGTSSEDRIAADGQVYDLDRIMFLRNYLTQMQRAVAEGVPIRGYFLWSLMDNFEWIFGYGKRFGLYRVDFETQARVAKLSAAFYRDVVARNAIGV

SEQ ID NO: 24696 - protein, 1089 aa, Dehalococcoides ethenogenes 195
MRKQKGICEVMNKPKKVLIIGSGPIIIGQAAEFDYAGTQACKAMREEGVESILVNSNPATIMTDENVADRVYIEPLTVESITKIIEKERPDGLLPTLGGQTGLNLAVDLADAGVLAKYNVRSLGTPINTIRTAEDRELFKELLAKIGEPVPPSETVTTAEDALKVAREIGLPVVIRPAYTLGGTGGGFANNWEEVEEVAQTGLNASPIHQILVEKSVAGWKEIEYEVMRDGADNCITICNMENFDPMGVHTGDSIVVVPVQTLTNKESQMLRTASIKIIRALGIEGGCNVQLSLNPNGNEYYVIEVNPRVSRSSALASKATGYPIARVASKIAIGKRLDEIPNAVTGKTLACFEPAVDYIVAKIPRFPFDKFALGDRGLGTQMKATGEVMAIDRSFEAAIHKSIRSLEFGKKTILWEDRSWIMGDNLSTYPLHAHDTRLWAILAALRRGHTPEAIHEKTKIDNWFLYKLKNITDMEKRLLKENLTPELMLQAKKLGFSDEEIATLSGKLAEQIRQMRLEWNIKPVFKMVDTCAAEFDAATPYFYSTYDEENEALPENIKKAVVIGSGPIRIGQGIEFDYCSVHAAWALEKAGLQSIMINSNPETVSTDFDTSNRLYFESLDEESVRDILENENISAPESTPSIVQFGGQTAINLASPLTRSGNPIIGSSAEAIDLAEDRRRFERLLSEMGIPQAPGAGITTLDEALSIAESIGYPVVVRPSYVLGGRAMEIVSDASDLIRYMSAAIELNTGHPILIDKYLVGKEVEVDAIADGETVFIPGVMEHIERAGVHSGDSMAVYPTQNLNAHDLATISDYTIRIGKALNVRGLMNIQFVVSKDPEGGDNIVYILEVNPRGSRTVPFLSKVTGVPMVDIAVNVMLGKTIKEQGYQNGIMPHTDLVAIKAPVFSMAKLVGVDTYLGPEMKSTGEVMGVDHTFNKALVKTLQAASIMLPEKGTLLFSVADRDKAEALPLIRTLHGLGYNFYATEGTAAMMTAAGITVKQISKKLDEGHPNIVDIIRNGTVCGVINTMTGGRVPLRDGFYIRRAAAERKVPCFTSMDTAKAAVEALANGNRQITVLPLNEYRQGKSGS

SEQ ID NO: 24697 - protein, 295 aa, delta proteobacterium MLMS-1
MSSQFSGTFVAIATPFNDDGSIDEPGLVELIEFQLAGGTNGIVPCGTTGESATMNHEEHHRVVELTVKTVAGRVPVLAGAGSNSTSETIELTRHAQNAGADGVLLITPYYNKPSQEGLYQHFKTVAESVEIPMVLYNVPGRTAVNMLPTTVARCAALKNIVGIKEASANLQQVSEVILLCPEDFMVLSGDDFTSMATVLVGGHGVISVSSNVDPRRMAEMIAAARQGEVSRANELHYQLLPLMQAMFFDTNPVPAKTALALMGRIKSPRVRQPLWQMNDEAQGRLQRVLKERGLL

SEQ ID NO: 24698 - protein, 783 aa, Candida albicans
MDKIRAVISGGEKPPVDTDNDHNTDFEADRKMPDLDIVVSKSQEFDPVTSHLVNDIMEDEYAAVHVEDDSPYPEVRAAVPSTDDPTLPQNTIRAWVIGLILTTVGCGMNMLFSFHSPSFAITTFVTSILAWPIGNFWAWIVPDWKIFGASLNPGPFNVKEHTIITIMANVSFGTGAAYATDILLAQNMFYKSNFGWGYNLLLIWSTQCIGFAFGGVLRRFVVDSPGAIWPSNLVTATFLTNMHINENHTANGWKISRLAFFVIVFVASFVWYWFPGYIFQALSYFSWITWIKPNNVIINQVFGSSSGLGMIPNNIALDWNQIAGYIGSPLIPPASVIATIFGSIVVIFWIVVPAIHYSNTWYSQYLPISSTGSFDRFQQTYNVSKIIDHKTLSFNEAEYKKYSPLFLSTTFAISYGLSFASILATITHTICFHGRDLIASLKAKEKPDVHNRLMKAYKPVPEWWYLIVFLVFFGMSIATVRAWPTEMPVWGLVFALIIAIIFLLPVAIIYAKTNIAVGLNVVTEFIVGYVLPGRPIAMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 24699 - protein, 390 aa, Leuconostoc mesenteroides subsp. mesenteroides ATCC 8293
MLAKRVDSLEASPTLAMGKKAKDMIADGIDVVNLSQGEPDFNTPDNIGRAARIAIKDHLTDSYTATNGLVELKNAVVAAAKRDYNVSLLTDQVVITTGAKLALYALMQILVDPGDLVITSAPFWVSYSEQVKLAGGSFKAIVSSDPQFKLTIDVLNKLEEKPKVVILNTPNNPSGAVYSKNELESIISWTKTNDVYLILDEIYGKLVYGDTVFHSGLSLESLVNSKMIIINGVSKAYAMTGWRIGWAIADVSITHAMTKILGHLTSNPTVVAQYAAIEALNGQQKSVETMRKSFESRLNFLYRDLSEIDNISIPFKPSGSFYIFFKIDSKFMKKNNFKNTNEISMALLSEEKLAIPSGEGFGMPGYLRLSYAKSEAELIEAVKRLKHFFS

SEQ ID NO: 24700 - protein, 288 aa, Lilium longiflorum
MEGKEEDVKLGANKYSERQPIGTAAQTQDRDYKEPPPAPFFEPGELKSWSFYRAGIAEFVATFLFLYITILTVMGVSKNATNKCVTVGIQGIAWSFGGMIFALVYCTAGISGGHINPAVTFGLFLARKLSLTRAIFYIIMQCLGAICGAGVVKGFQKGLYESNGGGANVVNHGYTKGDGLGAEIIGTFVLVYTVFSATDAKRNARDSHVPILAPLPIGFAVFLVHLATIPITGTGINPARSLGAAIIYNKSHAWHDHWVFWVGPFIGAALAAVYHQIVIRAIPFKSRS

SEQ ID NO: 24701 - protein, 377 aa, Zea mays
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALEYDQELENAKSSSSVEKSYELPDGQVITIGAERFRCPEVLFQPSFIGMEAPGIHETTYNSIMKCDVDIRKDLYGNIVLSGGTTMFPGIADRMSKEITALAPSSMEIKVVAPPERKYSVWIGGSILASLSTFQQMWISKAEYDESGPGIVHRKCF

SEQ ID NO: 24702 - protein, 472 aa, Arabidopsis thaliana
MDLLSSLPDEVRCLILSFLTTKESASTSVLSKKWRNLFALVPNLDFDDSEFLHPEEGKRERDGILQSFMDFVDRVLSLQGNSSIRKFSLKCETGVPPARVNRWLCEVLQRDVSDIDLTIDLGYGYYLPEELFVSETLVNLKLKSAFNIDWWPGAEGTSLPMLKSLCVYGVRVFCDDELQELLPCFPVLEELQMSNMQWLDSDETVSSATLTTLHITGIRSENPKSISFDTPNLLSFVYTDFVAEDYPLVNMKNLSLARLALRANDDQIKRVRGPSNDLLEYDVVRHFGNVVKLMNGIQNVQELHLCPDTLELLSVCCESMPVFNNVKKLLIYSDEDRGWQAVPVLLRNCPRLETLIFEGIVHHVTDKCGDACDCIFRKDKGRSLKSCPVKVVEINGFGVTMKEKYLIEHFLDYFSCLKEMKIYINCEEDGVTQQVMKNREVSKLVLDEMEEYNEFYSCNVKLFLCKKKSIPQ

SEQ ID NO: 24703 - protein, 645 aa, Clostridium thermocellum ATCC 27405
MKNGFFRVGAAVPRLKVGGCRYNSDQIIGLIGKGEKAGIQILVFPELSITGYTCGDLFHQETLLDDAKVQLGRILEETKNSSCISLIGMPLGIDNQLFNCAVAIQKGRILGVVPKTYVPNYSEFYEQRWFSSGRNALRDTIMLCGQEVPFGDDLLFEDEKGEMCFGIEICEDLWVPVPPSSFQAMAGALVIFNLSASNEIVGKYEYRKELARQQSARCIAGYVYTSSGVDESTTDVVFGGHAMIFENGSLLCESERFLIDEQLIFSEIDIQKLMNDRRKNTSFMELWRDNVREFRKVKFEIEEFEAENITRYVPPHPFVPSDGSSRDRRCSEIFAIQTSALAKRIRHTGLKRAVIGISGGLDSTLALLVTAKAFDLLNIPRKNILAITMPGFGTSDVTYTNAMEFMKSMDVEIREINIKDACLQHFKDIGHDPSIHDITYENVQARERTQILMDIANKEGGLVIGTGDLSELALGWCTYNGDHMSMYAVNASIPKTLVSFLVRWVADNMLESKAKDVLYRILDTPISPELLPPDAKGEINQKTEDIIGPYELHDFFLYHMLRYGAAPGKILILAKKAFEGKYTDDTIKKWLKVFVKRFFSQQFKRSCLPDGPKVGTISLSPRGDWRMPSDAVADSWLSELESMQE

SEQ ID NO: 24704 - protein, 357 aa, Verbena x hybrida
MFSTVAPSPRVEILAGSGIKTIPKEYVRPDEELESIRDVFAEERSIDGPQVPTIDLAEINSENEEIRKKCHDELKKASMEWGVMHLTNHGIPDELINRVRKAGQGFFDLPVEEKEKHANNQEAGNVQGYGSKLANNASGQLEWEDYFFHCVFPEDKRDLSIWPKNPADYIPATSEYARQLRSLATKILSVLSIGLGLEQDRLENEVGGMEELILQKKINYYPKCPQPELALGVEAHTDVSALTFIIHNMVPGLQVFYEGKWVTAKCVPNSIIMHIGDTIEILSNGKYKSILHRGLVNKDKVRISWAVFCEPPKEKIILKPLPEMVSEAEPPLFPPRTFAQHLKHKLFRKTDDEEIDE

SEQ ID NO: 24705 - protein, 373 aa, Glycine max
MEAKSSNQIKEESNDSNYDRKAEIKAFDDSKTGVKGLVDSGVKKIPRMFLSGIDITENVASDSNLSIPVIDLQDIHNNPALHNEVVTKIRSACQEWGFFQVINHGIPISVMDQMIDGIRRFHEQDTDVRKQFYSRDLKKTILYNSNTSLYLDKFANWRDSLGCSMAPNPPKPENLPTVFRDIIIEYSKEIMALGCTIFELLSEALGLNPSYLKEMNCAEGLFIQGHYYPPCPEPELTLGTSKHTDSSFMTIVLQGQLGGLQVLHEKLWFNVPPVHGALVVNVGDILQLITNDNFVSVYHRVLSNHGGPRVSVASFFSNSHDPAKGASMVYSPIKELLSEENPAIYRDTTIGEIMAHHFAKGLDGNSALQPFRL

SEQ ID NO: 24706 - protein, 601 aa, Bradyrhizobium japonicum USDA 110
MLDRTKDISVAAQAWLDEFAGALGNPEPAAALDLLFLPDSFWRDVLALSWNLQTLAGRRAIAQALAALASRAAPTHFEIAPNRAPPRWVTRAGTSNIEAIFNFETALGRGSGILRLVPDSTDGDRLKAWTLLTALDELKGFEEQLGTSRPRGQAYSRDFRGPNWLDQRNTSRDYADRDPAVLVVGGGQAGLAIAARLKQLKVDTLIVDREARIGDNWRKRYHALTLHNQVQVNHLPYMPFPANWPVYIPKDKLANWFEAYVDAMELNFWTGTEFEDGAYDEAKGRWTVTLRRADGDKRTMHPRHVVMATGVSGIANVPDIPTLDNFRGTLVHSSRYEDGENWTGKRAIVIGTGNSGHDIAQDLYSSGAEVTLVQRSPTLVTNIEPSAQLAYATYNEGTLEDNDLIATSMPTPLAKKTHVMLTEQSKELDRELLDGLSRVGFKLDFGEAGTGWQFKYLTRGGGYYFNVGCSNLIAEGAIKLRQFSDIESFVAEGVRMKDGTTIPADLIVLSTGYKPQEYLVRKLFGDGVADRVGPVWGLAKASSCATCMRARSSPACGSSPAASPSAGSTRNISRSRSRPSRKGFWGVRWIQGNTHVIPGRA

SEQ ID NO: 24707 - protein, 505 aa, Gibberella zeae PH-1
MPSKTRTYNWFIAMVAASCMTLYGFDSSVFNALQASENWLNWFNLDLKEDSYTVGLINTCYTIGAIVSGFFIGGPLADWLGRRAGMGIGCIITIVAAIIQAFAPKGKLGVFILGRVLIGIGQGTALTAGPVYIGEVAPAEIRGQVMTFWQLFYSVGAFIAYWINYACGKNREKLGEWDWRMVVIFQVLVPIFVVILLPFQPESPRFLIKKGKVDDARAALRRIRDTEEEVEEEVMGILAAIEYEKEAISPGYRALFKDPSLRKRFGIAVVLNVGQQLTGQGTLNTYSTSIYKQVWTSTEKINLINALWATMGILFTLNAVWTADRFGRRWIFMVGAIGMAVCMLIVPIIGLATPTPKTEPSAIGIVVMLYLFIFFYKPSWGAGVWMWTSEVFSANVRTQAVGMASQCQNVANTIFQQFFPTFLAKTGLKCLFFFFGVNILLAIFVFFFVPETKGIALEHMDTVFGGVDHSEKGAQMLGTDVPHNDTQQFKDGAEIQQSEKKPESV

SEQ ID NO: 24708 - protein, 173 aa, Zea mays
RAQELANLIGGPALTLADLENYHPEEGMILANTTAIGMHPNVNETPLSKQALRSYAVVFDAVYTPKETRLLREAAECGATVVSGLEMFIRQAMGQFEHFTGMPANNTPFQQCLRVLTPLIKAARIVRSLICANSWTDREESQNQPVCIGLLSVHIKEQRESFAWDFVPVRNMQ

SEQ ID NO: 24709 - protein, 175 aa, Ashbya gossypii ATCC 10895
MGSAPSKILEDLLDDTNFDREEIERLRKRFMKLDRDSSGSIDKNEFMSIPGVSSNPLAGRIMEVFDADNSGDVDFQEFISGLSVFSGRSDKEEKLRFAFKIYDIDKDGYISNGELFIVLKIMVGNNLEDEQLQQVVDRTIMENDVDGDGKLSFEEFKSAVETTEVANSLTLQCDI

SEQ ID NO: 24710 - protein, 582 aa, Ashbya gossypii ATCC 10895
MSEAALVPPALSTNQTEETFNFQQYELLRQDRAAHLGPGITDLASLKERIRSYYAIESLADHLNSHAEYRSITLQFPDDLLFDSALVAEELQALLPDLQCARTDAPAQADTTCSCGTQKTCADSKDSADGRKIWILADTAYSPCCVDEVAAEHVQADVVVHFGDTCLNPVETLPVVYIFGEPYLDRAKVISLFTERYDKDAKVCLMANAPYSRHLESLSGELSQLGYSNLVFTDVALPDTPNAAATILGVSDSHPISHKLYASGDRVYYGAKEQLLCEEQLQSFELFHIGLPPDPRLLFLSTKFQGVTAYDTQKRQIAKGPFPAMMRRYRFMHVARTASTIGILVNTLSLKSTRSLISSLVELIRSCGKKHYMFVVGKPNVAKLANFEPVDVWCVLGCGHGGIVLDHANEFYKPIVTPYELTLALAPELSWTGAWVVDFNTVIDGISADLGLQAGAIPAENVPEFDAVTGKYVGNSRPLRELNHLEIESPQESITTGSTELVKKFSGALTIGSTVSTSAQFLQARQWTGLGSDFNAEDSYEEEGATVEEGLSGVARGYQYDVSNAEHTDADVPKTSGRVMNT

SEQ ID NO: 24711 - protein, 416 aa, delta proteobacterium MLMS-1
MHHFEYKDGVLHAEEVAVPEIAAAVGTPFYLYSAATLRRHFTAFDGAFAGLDHLSCFAVKASSNIAILRLFARLGGGADIVSGGELFRALKAGIAPERIVYSGVGKTRAEIRQALVAGILMFNLESAQELTAIQQCAAELGQTARVSFRVNPDVDPQTHAYISTGLAENKFGIAIEEALAVYKEARQMANVEIVGLSCHIGSQLTQVSPFVDTVDKLKKFMAELNGAGINIRYLDLGGGLGINYQGENPPEPAEYGMALRQALGDLPCTLILEPGRVIVGNAGILVTRVLFTKSGRKNFVVVDAGMNDLARPSLYDAYHAIQPVTRREDGQMVADVVGPICETGDFLARGREIARAVPDDLLAVMSAGAYGFTMASNYNSRPRVPEVLVSEDQFVEIRRRETYEDLVRGETIPDLV

SEQ ID NO: 24712 - protein, 783 aa, Candida albicans
MDKIRAVISGGEKPPVDTDNDHNTDFEADRKMPDLDIVVSKSQEFDPVTSHLVNDIMEDEYAAVHVEDDSPYPEVRAAVPSTDDPTLPQNTIRAWVIGLILTTVGCGMNMLFSFHSPSFAITTFVTSILAWPIGNFWAWIVPDWKIFGASLNPGPFNVKEHTIITIMANVSFGTGAAYATDILLAQNMFYKSNFGWGYNLLLIWSTQCIGFAFGGVMRRFVVDSPGAIWPSNLVTATFLTNMHINENHTANGWKISRLAFFVIVFVASFVWYWFPGYIFQALSYFSWITWIKPNNVIINQVFGSSSGLGMIPNNIALDWNQIAGYIGSPLIPPASVIATIFGSIVVIFWIVVPAIHYSNTWYSQYLPISSTGSFDRFQQTYNVSKIIDHKTLSFNEAEYKKYSPLFLSTTFAISYGLSFASILATITHTICFHGRDLIASLKAKEKPDVHNRLMKAYKPVPEWWYLVVFLVFFGMSIATVRAWPTEMPVWGLVFALIIAIIFLLPVAIIYAKTNIAVGLNVVTEFIVGYVLGGRPLCMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 24713 - protein, 361 aa, Oryza sativa (japonica cultivar-group)
MSVDNSSVGSNESRTVMLKHPGLRDMPAPSYSVHNSVIHPNRAMAPTLNEDALARVLMDPSHPTEILSNYEEWTIDLGKLDMGAPFAQGAFGKLYRGTYNGEDVAIKLLEKPENDPERAQLMEQQFVQEVMMLSTLRHPNIVRFIGACRKSIVWCIITEYAKGGSVRQFLARRQNKSVPLGLAVKQALDVARGMAYVHALRFIHRDLKSDNLLISADKSIKIADFGVARIEVQTEGMTPETGTYRWMAPEMIQHRPYDHKVDVYSFGIVLWELITGMLPFTNMTAVQAAFAVVNRGSRPAIPQDCVDSLSKIMTCCWDANPEVRPSFAEIVVMLENAEIEVMRNVRRARFRCCIAGPMTTD

SEQ ID NO: 24714 - protein, 436 aa, Vibrio cholerae O1 biovar eltor str. N16961
MKFTSLALQCPANSIPRTVMPKLALQPLYSPDVATLAPDRLIDQLAPRFDRPSVRLTPSPALTEQQVMKRWQKLAAPEAQALLLDEQTERTMQAYQKNIEYFIGTVKLPVGIAGPLRVNGSHAQGDYLVPLATTEAALVASYHRGSQLITAAGGASALLLNEGVTRTPVFAFLSLAQAGQFVGWVTSQFEQMKEIAQSTTAHGKLKDIQVNIEGNHVYLVFEYTTGDASGQNMVTIATHAVFEFIMRHSPVAPVQAFLDGNLSGDKKANSYTLRSVRGKKVSAEVHLSAELVKKYLHTTPEQMVQFGQMTTVGGALSGAIGVNAHYANALAALYIACGQDAACVAESAIGMTRMEIHPHGGLYASVTLPNLMVGTVGGGTHLPSQHACLSLMGLAGQGHARALAEVAAALCLAGELSIVGAFCAGHFSRAHHKLAR

SEQ ID NO: 24715 - protein, 530 aa, Herbaspirillum seropedicae
MSTHSHSKILILDFGSQVTQLIARRVREAGVFSEVFPHDVTDEFVRNYGAAGVILSGGPNSVTEGDTPRAPQAVFELGVPVLGICYGMQTMAEQLGGKVDNGHLREFGYAEVRAHGHTKLLDNISDFTNAQGHGMLKVWMSHGDKVNEMPAGFKLMASTGNCPIAGMADEERRFYGVQFHPEVTHTVQGKAMLGRFVHEICGCQSDWNMPDYIAEAVEMIRQQVGSDEVILGLSGGVDSSVAAALIHRAIGDQLTCVFVDHGLLRLDEGKMVMEMFAKNLGVKVIHVDATAQFMGHLAGVTDPEAKRKIIGREFVEVFQAESAKLTSAKWLAQGTIYPDVIESAGKGKKTAHTIKSHHNVGGLPETLNLKLLEPLRELFKDEVRELGVALGLPPEMVYRHPFPGPGLGVRILGEVKKEYADLLRRADAIFIEELRNTKDEDGQTWYEKTSQAFAVFLPVKSVGVMGDGRTYEYVVALRAVQTQDFMTAHWAHLPHELLGRVSNRIINEVRGLNRVVYDISGKPPATIEWE

SEQ ID NO: 24716 - protein, 294 aa, Gibberella zeae PH-1
MSNEEITHPTIVDGWFREISDMWPGHAMTLRVEKVLVHEKSKYQDVLIFKSTDFGNVLVLDNVIQCTERDEFSYQEMIAHLALNSHPNPKKVLVIGGGDGGVLREIVKHDCVEEATLCDIDEAVIRLSKEHLPSMACGFDHPKSKTHVGDGFKFLNDYKNEFDVIITDSSDPDGPAEALFQKSYFQLLHDALREGGVITTQGSESPWLHLPLIARLKKDCGAIFPVAEYAYTTIPTYPSGQIGFMVCSKDPKADVKNPIRSWTKEEEDEKLRYYSSEIHKASFVLPKFAAKALE

SEQ ID NO: 24717 - protein, 203 aa, Prochlorococcus marinus str. AS9601
MSIFVGNLPFRAEREDVIQLFAPFGEVLNCSLPLERDTGRKRGFAFIEMADEAIESTAIDGLQGRELMGRPLRINKAEPRSSGGSRRGGRGGGYGGGNNSGGYGGGYGGGNNSGGYGGGYGGGNNSGGYGGGYGGGNNSGGYGGGYGGGNNGSNSSYVNKSSGAEGWEDRSYGNSSENSEYENGRSRRKRGVSNENNASNETN

SEQ ID NO: 24718 - protein, 108 aa, Glycine max
  misc_feature (11)..(11): Xaa can be any naturally occurring amino acid
  misc_feature (31)..(31): Xaa can be any naturally occurring amino acid
  misc_feature (36)..(36): Xaa can be any naturally occurring amino acid
  misc_feature (62)..(62): Xaa can be any naturally occurring amino acid
  misc_feature (92)..(92): Xaa can be any naturally occurring amino acid
  unsure (1)..(108): unsure at all Xaa locations
NLMTLDAAPLXNQRTWAKETLEIFAPLSNRXEFLLXKEQLQNLCFKHINPSHHDELSSKLVXSYDDPMITFAIERLQEALKDECISYNVISXLHKILYKVYRTMLKKK

SEQ ID NO: 24719 - protein, 310 aa, Burkholderia sp. 383
MRQNHIESARQVFEIESRALAGVAARLDANFDAAVETILGSRGRVVVCGMGKSGIVGRKIAATLSSTGTPGFFMHPGEAYHGDLGMVTPDDTFLAISNSGETDEVIKLIPFLRNNGNDLIALTGNPSSTLASAARVHLDIGVEREACPLQLAPTASTTATLAMGDALAVTLMRARGFQPEHFARFHPGGSLGRRLLSTVDDEMACRDLPFVTEDTSTLDVLDAMTRGRLGLAIVKRDAGWGIVTDGDVRRAIERHGDGVLRRTAADMMSIEPSTVPPGTRVEDALLLMQQQRIGALLVSDGTRIVGVFKK

SEQ ID NO: 24720 - protein, 408 aa, Buchnera aphidicola str. APS (Acyrthosiphon pisum)
MISKKTLITRDNFDKLILPIYNPIPFIPIKGKGSRIWDQKGKEYIDFSGGIAVTSLGHCHPILNKTLKNQSKMLWHLSNIFTNEPALRLAKKLLSSSFASRIFFANSGAEANEAAFKLARYYSSKIYNFKKNKIISFYNSFHGRTFFTVSVGGQSKYSNNFGPKPAGIVHASFNDINSVKNLIDHDTCAVVVELIQGEGGVIPANLTFVQALKELCKQYNVLLIFDEIQTGIGRTGKLFYYEYYAITPDILTIAKSLGGGFPISAMLTTNEVASVIAPGIHGTTYGGNPLACAVAESVIDIINTKKVLSGVEKKSKKIISELNIINKRFKLFTEIRGRGLLIGIVLKPNVSRNIHKILNFSLSEGVIFLTAGNNVIRLAPSLIIKELDIIEGMKRFYRALEKYLSRKE

SEQ ID NO: 24721 - protein, 434 aa, Streptococcus thermophilus LMG 18311
MSIITDVYAREVLDSRGNPTLEVEVYTESGAFGRGMVPSGASTGEHEAVELRDGDKARYGGLGTQKAVDNVNNVIAEHIIGFDVRDQQGIDRAMIALDGTPNKGKLGANAILGVSIAVARAAADYLEVPLYSYLGGFNTKVLPTPMMNIINGGSHSDAPIAFQEFMIVPAGAPTFKEALRWGAEIFHALKKILKERGLETAVGDEGGFAPRFDGTEDGVETIIKAIEAAGYVPGKDVFIGLDCASSEFYDAERKVYDYTKFEGEGAAVRTAAEQIDYLEELVNKYPIITIEDGMDENDWDGWKALTERLGDKVQLVGDDFFVTNTAYLEKGIAEHAANSILIKVNQIGTLTETFDAIEMAKEAGYTAVVSHRSGETEDSTIADIAVATNAGQIKTGSLSRTDRIAKYNQLLRIEDQLGEVAEYRGLKSFYNLKK

SEQ ID NO: 24722 - protein, 298 aa, Streptococcus thermophilus LMG 18311
MLLRTCVGLGRFWMRIDGHTRLAAVVASPIKHSISPFIHNLAFEKTHVNGVYVAWEIPESDLAETVENIRRYNMFGINLSMPYKEKVIPFLDGLSPEAQLIGAVNTVVNRDGRLIGHNTDGFGFFASLKNFNPKDTHIMILGAGGAAKSIVTQAVLDGAKKVSIYVRPQSLVKAKENFRTLLDQTDCYLEFHDLTDADHFQKELRQTDLLVNATSVGMDGESLPISIDTSFPKELLVADIIYQPFETPFLALARKQEIEAVNGLGMLLYQAAGAFKLWTGENMPTGAIWQELENIYNS

SEQ ID NO: 24723 - protein, 247 aa, Streptomyces clavuligerus
MPSALQGKVALITGASSGIGEATARALAAEGAAVAIAARRVEKLRALGDELTAAGAKVHVLELDVADRQGVDAAVASTVEALGGLDILVNNAGIMLLGPVEDADTTDWTRMIDTNLLGLMYMTRAALPHLLRSKGTVVQMSSIAGRVNVRNAAVYQATKFGVNAFSETLRQEVTERGVRVVVIEPGTTDTELRGHITHTATKEMYEQRISQIRKLQAQDIAEAVRYAVTAPHHATVHEIFIRPTDQV

SEQ ID NO: 24724 - protein, 357 aa, Synechococcus sp. CC9605
MAQHRVVLLPGDGIGPEITAVARQLLEVVSRRHGFSLSFEEQPIGGSAIDATGEPLPASTLDACKAADAVLLAAIGSPCFDSLPREKRPETGLLGLRAGMELFANLRPVKIVPALIDASSLKREVIEGVDLMVVRELTGGIYFGQPKGRIETEGDERGFNTMTYSASEVDRIAKVAFEIAQERRGRLCSVDKANVLDVSQLWRDRVDAMAPSYGPVEVSHMYVDNAAMQLVRDPRQFDVLLTGNLFGDILSDEAAMLTGSIGMLPSASLGSEGPGLFEPVHGSAPDIAGQDKANPMAMVLSAAMMLRIGLKQAAAADDLEAAVDAVLAGGFRTGDLMAEGCTQLGCRAMGEQLLKAL

SEQ ID NO: 24725 - protein, 244 aa, Photobacterium sp. SKA34
MLTDKVCLVTGGAQGIGRCIVETFANQGAKQVFVCDMNFGAMADLEQQFPNVTALELNVCDRANVSEAITKIAQQYGTIDVLVNNAGITRDNLIENMSENDWDLVVDVNLKGVFNMTQAIAPLMMASGSGSIITMSSVVGTDGNIGQTNYAATKAGVIAMTKSWSKEFARKGAKVRANCVAPGFIETPMTVDLPEKVIDYMVSKTPLKRMGQAQDIANGVLFLASDNSSFITGQTLKVDGGLVI

SEQ ID NO: 24726 - protein, 421 aa, Bradyrhizobium japonicum USDA 110
MNHFDYRNGVLHAEAVNLSELAATVGTPFYCYSTATLERHYRVFADAFAGEKVLVCYAMKANSNQSVLRTLARLGAGADVVSGGELKRALAAGIPARKILFSGVGKTEDELRAALAADILCLNVESEPELELLSRLATEMGKTARISVRVNPDVDAGTHAKISTGKSENKFGIPIAHAREVYARAAKLPGIQVTGTDVHIGSQITDLSKMETAFRILSEFVQTLRADGHDISHVDFGGGLGIPYYMDREAPPAPDAYAAMVKRVSHNLGCTLMFEPGRMIVGNAGILVAKVIYVKHGDGKNFVIIDAAMNDLIRPTLYEAHHDILPVTQPARDAATMVADVVGPVCETGDYLALDRTLPTPKAGDLLAIMTAGAYGAVQAGTYNTRPLVPEVLVKDDQYAVVRPRIDVEQLIAMDTPAPWL

SEQ ID NO: 24727 - protein, 418 aa, Prunus persica
  misc_feature (404)..(404): Xaa can be any naturally occurring amino acid
  misc_feature (414)..(414): Xaa can be any naturally occurring amino acid
  unsure (1)..(418): unsure at all Xaa locations
QLQSWEKTVDCHSPGQGLMPASFKVKTVPLDGMNGEFEEVLDPDFGESAIGRVAPVDSGLWWIILLRAYGKITGDYALQERVDFQTGIRLVLNLCLKNGFDMFPTLLVTDGSCMIDRRMGIHGHPLEIQALFYSALRCSREMLIVNDGTKDLVAAINNRLSALSFHMREYYWVDMKKINEIYRYKTEEYSTDAVNKFNIYPDQIPSWLVDWIPEEGGFLIGNLQPAHMDFRFFTLGNLWSIVSSLGTHKQNEDILNLIEAKWDDFVAQMPLKICYPALEYEEWRIITGGDPKNTPWSYHNGGSWPTLLWQFTLACIKMGRTELAQKAVDLAEKRLSADQWPEYYDTKSGRFIGKQSRLFQTWTIAGYLTSKMLLENPEKASLLLWEEDYELLETCVCALTKTGXKKCSRLAAKXQIVV

SEQ ID NO: 24728 - protein, 331 aa, Burkholderia pseudomallei K96243
MRRCAPQYSPPFSMAHDGSQMNHHNYLDSARQVFDIESRALASLSARVGDSFGDAVDAILRSSGRVVVCGMGKSGIIGRKIAATFASTGTPSFFMHPGEAYHGDLGMVTSADTFLAISYSGETDEVIKLIPFLKSNRNYLVALTGNARSTLAQAAHSHLDAGVEQEACPLQLAPTSSTTAALAMGDALAVTLMKARGFRPENFARFHPGGSLGRRLLSKVDDEMTVDGLPFVDERAPAIDVLQAMTRGRLGLAIVRRETGFGIVTDGDVRRAIEAYGDTLFRRAASDLMSADPAMVPLGTRVEDALLMMEARRINALLVFDGEDVVGVFKK

SEQ ID NO: 24729 - protein, 137 aa, Glycine max
  misc_feature (71)..(71): Xaa can be any naturally occurring amino acid
  misc_feature (110)..(110): Xaa can be any naturally occurring amino acid
  misc_feature (131)..(131): Xaa can be any naturally occurring amino acid
  unsure (1)..(137): unsure at all Xaa locations
KNKLLRTNNEKLTAGSMISCAAVTTVNRAGGDMVATFTGLMSMAGLPTTKTNDDISSIASNGGRVQCMQAXPPVGKKKFETLCYLPDLDDAQLAKEVEYLLRKGWIACWXFELDHRFWYREHNTSAEYYYXRYWTMW

SEQ ID NO: 24730 - protein, 339 aa, Mycobacterium sp. MCS
MNRQIVLRRRPVGLVEPSDTELVESPAPEPADGEALLRTTFVGIDAAIRTWLNDQRGYLPPVQLGEVIRAAGIGEVVRSRCDAFAVGDVVTTLTGFQEYAIIRDDLFSTPIAGREKVDQRAVMSVYGPTGATAYFGMTDIGRPRPGETVVVSAAAGATGSVAGQIAKIAGARVVGIAGGPQKCRTVVEDFGFDACIDYRSADLAAALKEHCPKGVDVYFDNVGGAILDAVLGRLAQNARVVLCGVISSYLTGEHPGPANYVNLLSRTALMQGFNALDQWGRFEEAFAALRSWDEQGLLVHREHVFEGIGSCVDALNGLFAGVNIGKMLVKIGEPTVETA

SEQ ID NO: 24731 - protein, 360 aa, Physcomitrella patens
MSPSVDCLASLYCAEDVSGTAWNESEMCGAADRVFESQPAVFMDFPVEDDEAIATLLMKEAQFMPEADYLERYQSRKLSLEARLAAIEWILKVHSFYNYSPLTVALAVNYMDRFLSRYYFPEGKEWMLQLLSVACISLAAKMEESDVPILLDFQVEQEEHIFEAHTIQRMELLVLSTLEWRMSGVTPFSYVDYFFHKLGVSDLLLRALLSRVSEIILKSIRVTTSLQYLPSVVAAASIICALEEVTTIRTGDLLRTFNELLVNVESVKDCYIDMRQSEIGPYCVRMGLKRKILHASEPQSPVGVLEAADVSSPSGTVLGFSSRESSPDVTDSPPSTNSQRKRRKLCLHNESCLHVESASL

SEQ ID NO: 24732 - protein, 307 aa, Gibberella zeae PH-1
MSVILCTAGYDHTIRFWEALSGICSRTIQHPDSQVNRLCISPDKRYLAAAGHHTVKLYDIKSTNPNPLLTFEGHTGNITGVAFHCEGKWMVTSSEDGTVKIWETRTGTIQRSYNHGCPANDVVIHPNQGEIISCDRSGSVRVWDLAENNCSHELIPEEDVSVSSVTVASDGSLLCAANNASFDRTQLVPVTHFNAHKEYITRILLSPDVKKLATCSADHTAKIWEVKNIEPTPDQEPKPYPLEATLTGHQRWVWDCAFSADSAYLVTACSDHYARLWELHSQQIIRQYNGHHRGAVCVALNDYSETR

SEQ ID NO: 24733 - protein, 374 aa, Prochlorococcus marinus str. AS9601
MADFYQILGVSRDADADTLKKAYRKLARQYHPDVNKEPGAEDKFKEIGKAYEALADPETRARYDQFGEAGLGGAAGMPDMGDMGGFADLFETFFNGFGGQNPQGGRTQRRGPQQGDDLRYDLNVEFKDAIFGQQREIKIPHLETCEVCRGTGAKQGTGPKTCSTCGGSGQVRRATRTPFGNFTQVAECPSCNGAGQIIADPCVNCGGNGVKQVRKKLRINIPAGVDTGTKLRVSGEGNVGLKGGPPGDLYVFIKVKNDSKLKRDGVTIYSEIAVSYLQAILGDTVKITTVDGEVNLKIPSGTQPNTTLSLENKGVPRLGNPVARGNHEVLVKVKLPTRITDGERELLEGLASQYSDKNINSTSGLFSKLFGKDS

SEQ ID NO: 24734 - protein, 484 aa, Mycobacterium smegmatis str. MC2 155
MNYQDAIAGLDAKHGILIDGNARGADATFDVHDPATGEVIAAVSDGSAADAVAAVDAAQKAFGAWAATSPRERSEILRRAYELILADIDRLSALVCAENGKSQADARAEVTYAAEFFRWFSEEAVRTDGAFGSNPAGNARTLVTHKPVGVAALVTPWNFPAAMATRKIAPALAAGCTVVLKPAAETPLTALAIAAILTDAGVPAGVVNLVPTSDAGAVVSAWLADARVRKISFTGSTGIGRVLLKQAADRVVNASMELGGNAPFVVTADADIAKAVEGAMLAKFRGAGQVCTAANRFYVHASVHDEFVAAFAAKIEALRVGPAADPASEIGPLVSPRAAQRVSAAIDAAVADGAVVAAKAPTPTEGWFVAPTLLTDVAPDAAILTDEIFGPVAPVVAWEDEDELLRWANDTEYGLAAYVFAGRLQDALRIAERIDAGMVGVNRGAVSDPSAPFGGMKQSGLGREGAREGLQEFQETQYFSVAFD

SEQ ID NO: 24735 - protein, 340 aa, Prochlorococcus marinus str. AS9601
MTLRVAINGFGRIGRNFMRCWLSRGAYTNIEVVGINVTSDPKTNAHLLKYDSVLGQLDGVDIQYTDDTFVINNKTIKCFSDRNPMNLPWKEWGVDLVIESTGVFNTDVGASKHLEVGAKKVILTAPGKGDGVGTYVVGVNADTYKHKDYDILSNASCTTNCLAPVVKVLDQTFGINKGLMTTIHSYTGDQRILDNSHRDLRRARAAATNIVPTSTGAAKAVALVYPEMKGKLTGIAMRVPTPNVSAVDFVFESSKSVTAEEVNTALKEASLGSMKGIIKYGDEPLVSSDYAGTNESSIVDSDLTMCIGDNLVKVLAWYDNEWGYSQRVVDLAEIVAKNWE

SEQ ID NO: 24736 - protein, 181 aa, Vigna radiata
MASSMISSPAVTTVNRAGAAGMVAPFTGLKSLGGFPTRKTNNDITSVANNGGRVQCMQVWPTIGKKKFETLSYLPDLTEEQLGKEVDYLLRSGWIPCLEFELSHKDAFPHRENNRSPGYYDGRYWTMWKLPMYGCTDSSQVLKELREARTLYPDGFVRIVGFDSVRQVQCISFIAYKPPGY

SEQ ID NO: 24737 - protein, 202 aa, Magnaporthe grisea 70-15
MNPEYDYLFKLLLIGDSGVGKSCLLLRFADDTYTESYISTIGVDFKIRTIELDGKTVKLQIWDTAGQERFRTITSSYYRGAHGICVVYDVTDMDSFNNVKQWLQEIDRYATEGVNKLLVGNKSDMADKKVVDYTVAKEFADSLGIPFLETSAKNANNVEQAFLTMARQIKERMGTTTTNNSKPSVQVGPGQGVGSNQSNSCC

SEQ ID NO: 24738 - protein, 600 aa, Phanerochaete chrysosporium
MLVSVDALALRTLVYELTYLLYPAVPTAAALLLLQRLGSVWLPTWTIVLLSLCSVPVAHRILLWLKDWRAARKAASMGAILPPRLKGRWPGSIDLLRQLTKTFETGFLSEMLWGYMHVLGQTFEVYILWDSNYVTSDANVIKTILATDFDNFVKGEKLDVCVRPVLGTGVFNSDGEMWKFHRSMTRPFFTRERISHFDLFDRHADATMAKMKARLAEGFAVDFQDLISRFTLDSATEFLFGQCVHSLASVLPYPHDAPAHLQTTGASRTEDFARAFAEAQDAVSFRLRMGWLWPWFELFGSRTKAPMAVVDAFLDPILRDAVARADKIKRENGGRVPEVKGEIEEDETLLDHLVNVVQTKILHDEVLNIMIAGRDTTGGTLTSAVYFLSQYPEVLRRLREEILEKVGPTRRPTYDDIREMKYLRAFINETLRLYPAVPWNVRYPVKDTTIPGPHPDKPYFIPANTPVSYSVHCMHRRTDYWGPDAEAFDPDRFLDARVQRYLTPNPFIFLPFNAGPRICLGQQFAYNEMSFFVIRLLQHFDEVQLCEDALAPDCRVPDAWRGAPGRKGVERFWPKAHLTLYAKGGLWVKMREASTSEAVV

SEQ ID NO: 24739 - protein, 268 aa, Crocosphaera watsonii WH 8501
MTNSHSPTLNPINTNQATEIIETLMNLAQQGEIDPWDVQVIDVIDRFLNELGINEYGDNIYEQATLPRSGQAFLWASMLVRFKADSLEQLERDDSEQEFPCEPEEMTEEGHRPFRISDLEKHLRRRTAAPPPRQRRVTLQELITHIEEIAQEIETATPSRRRKVTPKPHSQREAMKMVTQLAHQENLTELAQQLEVFFGQQWPNSPEIERKLDLDDLLQRWHQINPPHDGEQKQDRVGVFWALLLLSSQSKVELSQEEFYQDLTIQVL

SEQ ID NO: 24740 - protein, 186 aa, Forsythia x intermedia
MVSKTQIVALFLCFLTSTSSATYGRKPRPRRPCKELVFYFHDVLFKGNNYHNATSAIVGSPQWGNKTAMAVPFNYGDLVVFDDPITLDNNLHSPPVGRAQGMYFYDQKNTYNAWLGFSFLFNSTKYVGTLNFAGADPLLNKTRDISVIGGTGDFFMARGVATLMTDAFEGDVYFRLRVDINLYECW

SEQ ID NO: 24741 - protein, 388 aa, Crocosphaera watsonii WH 8501
MKAMILAAGKGTRVRPITHTIPKPLIPILQKPVMEFLLELLRKHGFDEIMVNVSHLAEEIEGYFRDGQRFGVQIGYSFEGKIVDGDLVGEALGSAGGLRRIQDFNPFFDDTFIVLCGDALIDLDLTAAVKYHRDKGAIATIITKSVPKESVSSYGVVVSDEEGRIKTFQEKPSVEEALSTNINTGIYIFEPEIMNYIPPNQKYDIGGELFPMLVEKGAPFYAVNMDFEWVDIGKVPDYWHAVRGVLSREIKNVQIPGIEVKPGIYTGLNVSVNWDKVNIQGPVYIGAMTHIEDGATIIGPSMIGPNCWVCSGATVDNSVIFEYSRLGPGVRLLDKLVFGRYCVDKTGAAIDVQAAALDWLITDSRQTFPDDTQIPQQAIAELLNQDNG

SEQ ID NO: 24742 - protein, 430 aa, Polaromonas sp. JS666
MPSNQPTTNAALMARRKAAVARGVGQTHEIFVSRARNAEFWDVEDRRYIDFAGGIAVLNTGHLHPQVIAAVKTQLDLYTHTCFQVVAYEPYVELSEKLNALAPGNFAKKTLLLSTGAEAVENAVKVARAYTKRPGIIAFTGGYHGRTNMTLGMTGKVAPYKLGFGPFPGEVFHALYPNVLHGVSVDQALHSVELILKNDIEAERVAAFILEPVQGEGGFYIAPPEFITGLKALADRHGILLIADEVQTGAGRTGTWFASEQWPVAPDLITTAKSMAGGFPISGLVGRADVMDAPAPGGLGGTYAGSPIGCAAALAVLKVFEDEKLLERSKALGAHLLKGLRAIAEKEVTIGDVRGLGAMVAMELFENGDVARPNAALTQRVVAEAARRGLILLSCGTYGNVIRILVPLTANDALLDEGLKILADSFSALR

SEQ ID NO: 24743 - protein, 185 aa, Forsythia x intermedia
MAAKTQTTALFLCLLICISAVYGHKTRSRRPCKELVFFFHDILYLGYNRNNATAVIVASPQWGNKTAMAKPFNFGDLVVFDDPITLDNNLHSPPVGRAQGTYFYDQWSIYGAWLGFSFLFNSTDYVGTLNFAGADPLINKTRDISVIGGTGDFFMARGVATVSTDAFEGDVYFRLRVDIRLYECW

SEQ ID NO: 24744 - protein, 415 aa, Clostridium thermocellum ATCC 27405
MSRLEGACIFGQSGGPTSVINASAAGVIQEALKQDCITAVYGAAHGIKGILEENFFDMSKEDPYELELLKTTPSSALGSVRYKLKDADEDETDYKRLLEVFKKYNIRYFFYNGGNDSMDTCNKVSKYMQKVGYECRVMGVPKTIDNDLWGTDHCPGYGSAAKYIATSIMEVYHDARVYDTGMITILEIMGRNAGWLTAAAALASYKGNGPDLIYLPELSFDIDKFVEDVTRIYKENGKVIVAVSEGIKDKNGKYISEYGSDLAKTKDSFGHAQLGGLASTLANIVKEKTGAKVRGIEFSLLQRCAAHVASLTDVNEAYLAGQAAVQYAVEGKTDYMVAFERAEGPEYKCNIKLLNLSEVANTEKKVPLEWIKPDGAGLTEDFIKYALPLIQGESRPPIEDGLPRFAKLKKVLARK

SEQ ID NO: 24745 - protein, 189 aa, Thuja plicata
MSRIAFHLCFMGLLLSSTVLRNVDGHAWKRQLPMPCKNLVLYFHDILYNGKNIHNATAALVAAPAWGNLTTFAEPFKFGDVVVFDDPITLDNNLHSPPVGRAQGFYLYNMKTTYNAWLGFTFVLNSTDYKGTITFNGADPPLVKYRDISVVGGTGDFLMARGIATLSTDAIEGNVYFRLRVNITLYECY

SEQ ID NO: 24746 - protein, 192 aa, Thuja plicata
MAMKAAKFLHFLFIWLLVCTVLLKSADCHRWKKKIPEPCKNLVLYFHDILYNGSNKHNATSAIVGAPKGANLTILTGNNHFGDVVVFDDPITLDNNLHSTPVGRAQGFYFYDMKNTFNSWLGFTFVLNSTNYKGTITFNGADPILTKYRDISVVGGTGDFLMARGIATISTDAYEGDVYFRLRVNITLYECY

SEQ ID NO: 24747 - protein, 492 aa, Polaromonas sp. JS666
MDMKTSPISLLKDPSLFKTDALINGQWVAGGSRFDVNDPSNGQKLADVANLGSQDAEAAIAAANAAWPAWRSKTGKERHAILMKWYQLLMANQEDLGRIMTAEQGKPFAEAKGEVAYGASFVEWFAEEAKRVNGETLPQFDNNRRLMVIKQPIGVCAAITPWNFPLAMITRKVAPALAAGCPVVIKPAELTPLTALAAAELAVRAGIPAGVLNVLTADSANSIAVGKVFCASDVVRHISFTGSTEVGRILMAQSAPSVKKLSLELGGNAPFIVFDDADIDSAVEGAMASKYRNAGQTCVCANRIYVQDGVYDQFVEKFAAKVKLLKVGNGFEDGVVQGPLIEDSAVDKVQRHVADALAKGGKLQAGGHKLQGQFFEPTVISEATADMLCAREETFGPFAPVFRFKAEQEAIDAANNTEFGLASYFYSRDIGRIYRVAEALEYGMVGINAGVIATEHVPFGGVKQSGLGREGSSHGMEEYVEMKYLCLGDILK

SEQ ID NO: 24748 - protein, 359 aa, Dehalococcoides sp. BAV1
MVNKRDYYEVLGLERSASDEDIKKAFRKMAMKHHPDRNHEEGAADKFKEVNEAYEVLSNPEKRAAYDRFGFSAGADSFGQGGFENFDFGGLGSIFETFFGGATQGAKRGPRRGPDMSYDIKISLEEAATGVEKDITTERLEYCTECSGTGAKAGTSPVKCTSCNGTGQVYQVQKSVFGRFTSVTPCPKCRGEGTIIGEPCTKCRGTGKEYVKRTVQVKIPAGVADGNQIRLNGYGGVGDKGASAGDVYINVGIAEHADFKRDEDDVIYELEINFAQAALGTEVNVPGLNTEHKLKIPSGSQNGKYFVLKGKGIPHLNRFGSGDEMVHLNVVTPEKLSRKQKQLFEELEKSFAEDKKQAT

SEQ ID NO: 24749 - protein, 456 aa, Rhodococcus opacus
MVVDVTELRARARRHLGPHFTRKDTWESDFPVFVRGEGSYLIDTEGDRFLDGLAGLFCVNIGHGRDDIAKAASEQIGTLAYASNWGSAHIPAIEASALIADLAPGDLGTTFFVNSGSEAVETAVKFARQYHRSQGNPQRTKIISREMAYHGTTLGALSVTQLPKIKDPFGPLLPGVRSVPNTLGYLGDCGPANELDCIAAIEAVIEEEGAETIAAVFAEPVQNGRGALVPPDGYWAALRALCDKHGILLVSDEVICSFGRLGHWFGHGLTGVVPDMITFAKGSTSGYAPLGGLIVREQLVRELYDSPKGGVFTHGATWGGHPVSTAVAVANITAMRDENVLGNVSARGPKLRSALDSLMSSHRCVKDVRGTGFFYAIELMADSDSGREFTEQESLTVLRKVLPEAFARTKVILRGDDRGATMLMISPPLVADDEVLSELLHGIDSMLTDIEKAIQP

SEQ ID NO: 24750 - protein, 1116 aa, Magnetococcus sp. MC-1
MRRHSGHILFAASDLNGFLGCRHSTFLDLKDLDERLPRAEVSAQDRLIQERGHEHEAEYLESLKQSGLSVVEIPSEGGLSDRVQMTADVMADGPDIIYQAAFLDGQWHGYADFLQRVDRPSELGSFSYEAVDTKLTKHPKPKFVIQLCLYSDFIAKMQGTRPHSMSLVLGDFSQLHLRLDDFAYYHAIVKQRFEEYVAAPPAESQAMPCGFCELCKWRELCGEQWLQDDHLSQVANIKRDQVLKLETAGISTMATLAKVGEKSTVPSMTQETLDKLRAQAKLQLHKRDTGENKVELLDAAPGRGFSKMPKPSDGDLFFDMEGDPLYPDGLEYLFGFYFTESGQPVFKPFWAHDHKEEKRALQEVMDFLVTHLRAHPDAHIYHYNHYEETALKRLASQYATREAEVDDLLRGRKLVDLFKVVREAIRVSEPKYSIKNLEAFYMEKRDAEVATAGDSIVVYEEWRQSQDPQLLQNISDYNEDDCRSTLLLRDWLLTLRAADMPWFDLTAGAPSEEKLQAQQDAEENRVRYEQNLTRGHEGQDYEFRELVAQLLDFHRREAKPQWWAMFDRQERTDEELVDDAECLGGLKADPNQPPYKEKRSMVYTYRFPAQVTKLKKGSQCLRADSLESAGTIVDLSWDQRTVSIKKGPKGGPLPDVLSITPPGPINNSVLKDAVYRFADAIIAGSGKYQALASFLRRGKPEIAGHEADTPIVPDGDNSLPAIFEAVGNLQNSFLFIQGPPGAGKTYTSSHVIVELLRRGKRIGISSNSHKAINNLLDGIEKAAIKEGITFRGQKKCSASNPDSVYLGEMIESVSDNGGMDPESDIIAGTAWLFARDEYHEVLDYLFIDEAGQVSLANLVSMGLSARNIVLVGDQMQLGQPIQGTHPGDSGMSILDYLLEGESTIPADRGIFLGTTWRMHENVCRFISDAVYEGRLHPEAGTRNQALILSESAHPELRPNGIRFIEAKHEGCSQKSEEEGRIIQELIASLLEQRYRDRDGNEHSVAPDNILVVTPYNVQVNYLASILPEGVQVGTVDKFQGQEAEVVIISMVTSGAEDLPRDIEFLYSKNRLNVAISRARTLAMIVANPNLLEIPCQTVEQMRLVNTLCWVKSCSAE

SEQ ID NO: 24751 - protein, 580 aa, Bordetella parapertussis 12822
MYVYDPVDQQLVEERVEQFSDQTRRFLDGQLTEDEFRTLRLQNGLYIQRHAPMLRIAIPYGMLAARQLRKLAHIARTWDRGYGHFSTRQNMQFNWPRLEDVPAILAELASVQMHSIQTSGNCIRNTTSDHFAGVAPDELVNPLVWCEIIRQWSTLHPEFAFLPRKFKIAVSGAVEDRAAVGVHDIGLQAVERDGQLGFRFWVGGGLGRTPIVGHLINPFVPWQHLLTYLQAALRVYNLHGRRDNKFKARIKILVKDLTPEVYAREVEQEWQSLKDGPDTITEDQLNTIAGRFVWPDYDSAAASEPDPTDARAQADPRFARWLRTNVRAHKVAGYAAVTVSLKATGVPPGDITADQMDAVADLSERYGFGELRVSHEQNLVLADVRRARLHDLWQELQQLNLATPNIGLLTNIIACPGGDFCALANAVSIPVAESIQRRFDDLDYLFEIGELDLNISGCINSCGHHHVGHIGILGVDKAGEEWYQVTLGGRQNGAAKPLPDLESPRGGGAAIGRIIGPSFARTQIPDVIDRLIRTYLELRDSDAERFIDVVDRVGIDPFKRDVYADPAVAKPASQQEPAHA

SEQ ID NO: 24752 - protein, 508 aa, Oryza sativa (japonica cultivar-group)
  misc_feature (16)..(16): Xaa can be any naturally occurring amino acid
  misc_feature (35)..(35): Xaa can be any naturally occurring amino acid
  misc_feature (52)..(52): Xaa can be any naturally occurring amino acid
  unsure (1)..(508): unsure at all Xaa locations
AAAEKRRRYGGGCGDXGVRGDPGRGKCTGTTPTGXWRVSASGKSVAIVNPTXRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 24753 - protein, 466 aa, Oryza sativa
  misc_feature (29)..(29): Xaa can be any naturally occurring amino acid
  unsure (1)..(466): unsure at all Xaa locations
MNSLQSFLALNPPAAAAALGGARLRPSRXVTACLATPTPTPPTPTSAPLAPAAAAARRELSAASRAVVEDEARYIGRTYNRSRVVLVAGRGCELYDADGREYLDMAAGIAVNALGHADPDWVAAVSAQAATLVHASNVQYTVPQVALAKRLVEASFADRVFFANTGTEANEAAIKFARKFQRVARPDGDAPTEFMSFTNCFHGRTMGSLALTSKVQYREPFAPVMPGATFAEYGNLEEAKKVIQSGKIAAVFVEPVQGEGGIHSATKEFLQGLRDACDEAGALLVFDEVQCGLGRTGYLWAYEAYGVLPDIMTLAKPLAGGLPIGVVLVTEKVASAINFGDHGTTFGGGPLVCQAALTTLDKIQKPGFLAEVAKKGENFKQLLSTKLSGNAHVKEIRGIGLIVGIELDVPAGPLVDACLDRGVIVLTAGKGNVVRLVPPLIISEKELEQAAEVIRDCLPALDASTS

SEQ ID NO: 24754 - protein, 356 aa, Herbaspirillum seropedicae
MKIAILPGDGIGPEIVNEAVRVLNALDEKFEMETAPVGGAGYEAHGHPLPDGTLKLAKEADAILFGAVGDWKYDKLERALRPEQAILGLRKHLQLFANFRPAICYPELTGASSLKPELVANLDILIVRELNGDIYFGQPRGMREAPDGPFKGAREGFDTMRYSEPEIRRIAHVAFQAAAKRGKRLCSVDKANVLETFQFWKDIVTEVGKEYPDVELSHMYVDNAAMQLVKAPKNFDVIVTGNMFGDILSDAAAMLTGSIGMLPSASLDANNKGLYEPSHGSAPDIAGRGIANPLATILSAAMMLRFSLNKAEQADRIENAVKKVLAQGLRTADIYEEGCTKVNTQQMGEAVVKALA

SEQ ID NO: 24755 - protein, 153 aa, Herbaspirillum seropedicae
MKVSEILKVKGNILFTVTPDTPIQEAVAAMAEKDIGSLVVMEYGDLVGMLTFREVLLTLHKNGGELGGSTVRKHMNDAPITVTPDTDLNEVRRIMLEKHARYVPVMEARTVLGVMSFYDVAKAVLDAQGFENKMLKAYIRDWPAEEEEREGNA

SEQ ID NO: 24756 - protein, 321 aa, Escherichia coli
MTKYALVGDVGGTNARLALCDIASGEISQAKTYSGLDYPSLEAVIRVYLEEHKVEVKDGCIAIACPITGDWVAMTNHTWAFSIAEMKKNLGFSHLEIINDFTAVSMANPMLKKEHLIQFGGAEPVEGKPIAVYGAGTGLGVAHLVHVDKRWVSLPGEGGHVDFAPNSEEEAIILEILRAEIGHVSAEACLSGPGLVNLYRAIVKADNRLPENLKPKDITERALADSCTDCRRALSLFCVIMGRFGGNLALNLGTFGGVFIAGGIVPRFLEFFKGSGFRAAFEDKGRFKEYVHDIPVYLIVHDNPGLLGSGAHLRQTLGHIL

SEQ ID NO: 24757 - protein, 527 aa, Mycobacterium sp. MCS
MTAPARRRGGQLTVQGWLNVVLAVMGILVLAGAFAGAILMNRTDAVSRELIEEIQPSRVAAYRLQAALRDQETAVRGYAIAADEQFLEPYYEGQQTEREAAEEIREHVGDHANLIADLDAVEQATAEWRANYAEPFIRSVGPGAPVDNDLVQRGKERFDNIRALFHVQNVDLAAARTAGVKELDEVRGWRDRVLAGIIVTFFVTALALAILARSALVRPLSALAASCRRITEGHFDERIVAQGPRDVRSMASDVEDMRQRIVEELEASRAAREQLDEQAVELRRSNAELEQFAYVASHDLQEPLRKVASFCQLLEKRYGDKLDERGVEYIKYAVDGAKRMQVLINDLLTFSRVGRLSAAHTDVELDEALDAAVSNLETSIEESGAEIVRPEEPLPQVLGDPTLLTMLWQNLIGNAVKFRKPDTTPRIVIECQRGTDDRDGQWVFTVSDNGIGIAEEFSQKVFVIFQRLHGREAYSGTGIGLALCKKIVEYHGGSIWIDNTYTEGTRFRMTLPVAVHEQPEVVLEGAQ

SEQ ID NO: 24758 - protein, 519 aa, Kluyveromyces lactis NRRL Y-1140
MLSLSQTRNLAVRRLSSVSLAVRHSSTSTVHSAKDGSKVPAGSASFTTTKLIENNADNKPNVVILGSGWGAISFLQHIDAKKYNVSIVSPRNYFLFTPLLPSTPVGTVDEKSIIEPVVNFALKKKGNVSYYEAEATSINPDRNTVTIKSVSTVSQLYQPEKHLGLSQEDTAEIKYDYLLTAVGAEPNTFGIPGVEQYGNFLKEIPHSLQIRKRFLANIEKANLLPKGDPERKRLLTIVVVGGGPTGVETAGELQDYVDQDLKRFMPSIAEEVQIHLVEALPNVLNMFEKKLTSYAQDVLSKTNINLMLRTAVGKVEKDHLIAKTKDADGNVTEQTVPYGTLIWATGNKARPIVTDLFKKITEQNASTRALNVDEHLLVKGSNNIFAIGDNAFAGLPPTAQVAHQQAEYLAKVFDKMAKIPGFQQELATRKEKIDLLFEENGFKPFKYVHLGALAYLGAEKAIANITYGKRSFYTGGGLITFYIWRVLYVGMILSARSRFKVIADWLKLAFFKRDCFKEL

SEQ ID NO: 24759 - protein, 659 aa, Neisseria meningitidis MC58
MSQLANAIRFLSADAVQKANSGHPGAPMGMAEMAETLWTKFLNHNPANPKFYNRDRFVLSNGHASMLLYSLLHLTGYNLSIEDLKNFRQLHSKTPGHPEYGYTDGVETTTGPLGQGIANAVGMALAEKILAAEFNKDGLNIVDHYTYVFMGDGCLMEGVSHEACSLAGTLGLGKLIVLYDDNNISIDGKVDGWFTENIPQRFESYGWHVVPNVNGHDTAAIQAAIEAARAETGKPSIICCKTLIGKGSANKEGSHKTHGAPLGADEIEATRKHLGWTYPAFEIPQEIYDAWNAKEQGAKLEADWNELFAQYQAKYPAEAAEFVRRMDKKLPDNFDEYVQAALKEVCAKAETIATRKASQNSIEILAKELPELVGGSADLTPSNLTDWSNSVSVTRDKGGNYIHYGVREFGMGAIMNGLVLHGGVKPFGATFLMFSEYERNALRMAALMKINPVFVFTHDSIGLGEDGPTHQPIEQTATLRLIPNMDVWRPCDTAESLVAWAEAVKAADHPSCLIFSRQNLKFQARSEQQLNDIKRGGYVISEAQGNAQAVIIATGSEVELALEAQKALAAQNIAVRVVSMPSTNVFDRQDAAYQAAVLPEGLPRIAVEAGHADGWYKYVGLNGAVVGINRFGESAPADLLFKAFGFTVDNVVDTVKSVL

SEQ ID NO: 24760 - protein, 80 aa, Glycine max
  misc_feature (49)..(49): Xaa can be any naturally occurring amino acid
  misc_feature (53)..(53): Xaa can be any naturally occurring amino acid
  misc_feature (60)..(60): Xaa can be any naturally occurring amino acid
  misc_feature (71)..(71): Xaa can be any naturally occurring amino acid
  unsure (1)..(80): unsure at all Xaa locations
ATLATLAAVQSTTINGLAGRSFSGTKLSFKPSRHSAKSKNFTSGARVTXYGDXSEFFDFXDLGYTTGQWDXYGSYAPSPL

SEQ ID NO: 24761 - protein, 115 aa, Casuarina equisetifolia
ACLNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVP

SEQ ID NO: 24762 - protein, 122 aa, Brassica napus
CLSLTSNFTIPISQILFSQCCVQVDVVLRLSSLSFHDDVSKTIIELKKHLITASYVDDETSMLHEMAKNASITVLSETTSHNLAFSMNLSPLNSVRQRKNVLNPKPLIRKLCKEVAHSVRFQ

SEQ ID NO: 24763 - protein, 397 aa, Thraustochytrium aureum
MLTKSEINKEIQAFTLNFGPQHPAAHGVLRLVLELDGEVVRKADPHVGLLHRGTEKLVEQKTYLQALPYFDRLDYVSIIAQEHTYSIGVETLLDLSIPLRSQFIRVIFLEITRILNHLLAVSCHALDVGAITPFFWGFEEREKLIEFYERVSGARMHAAYVRPGGVSFDIPKGLLNDIFYFCESFKVRLDEFEELLTNNRIWKQRLVNIGVVSAADSKNWGFSGVMLRGSGIPWDLRQNFPYEVYNQLSFEIPVGSNGDCYDRYLIRIEEIRQSISIIVQAINLMPEGPVKSFNYKFSNPSKKMMKNSIEALIHHFKYFTEGFPVNRGEVYVATEAPKGEFGVFLVSDGSNKPYRCKIKAPGFSHLQGLDFMSKGHLIADVVTIIGTQDIVFGEVDR

SEQ ID NO: 24764 - protein, 416 aa, Arabidopsis thaliana
  misc_feature (140)..(140): Xaa can be any naturally occurring amino acid
  unsure (1)..(416): unsure at all Xaa locations
TSCTDLVLLFISMDAKKLDTGPRDAINWLPDEILGKILSLLATKQAVSTSVLSKKWRTLFKLVDTLEFYDSVSGMGEQEASYVFPESFKDLVDRTVALQCDYPIRKLSLKCHVGRDDEQRKACVGRWISNVVGRGVSEVXVLRINDRGLHFLSPQLLTCKTLVKLTLGTRLFLGKLPSYVSLPSLKFLFIHSVFFDDFGELSNVLLAGCPVVEALYLNQDGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDEVKRLKSFLGEESMIEVVFPEV

SEQ ID NO: 24765 - protein, 222 aa, Brassica napus
  misc_feature (178)..(178): Xaa can be any naturally occurring amino acid
  unsure (1)..(222): unsure at all Xaa locations
QSTLFVASLGDSRVVLGKKSNCGGLSAIQLSSEHNANNEDIRWELKDLHPDDPQIVVFRHGVWRVKGIIQVSRSIGDMYMKRPEFNREPIAQKFRIAEPMKRPLMSATPTILSHPLHPNDSFLIFASDGLWEHLSNEKAVEIVHSHPRAGSAKRLIKAALQEAARKREMRYSDLRKIXKKVRRHFHDDITVIVVFLNHDLIARGHMNTTQDSALSVRSALEH

SEQ ID NO: 24766 - protein, 486 aa, Photobacterium sp. SKA34
MDMKSLYIDGNYVAASSDIQFTTFNPANGQPIATIGQASQADLELAISAAKKGFAIWSAMTATERSRILLRAVTLLRERNDELAVLEVTDTGKPLQEAIAVDIETGADVIEYFAGLAPGLQGEQQPLSENQFFYTRREPLGICAGIGAWNYPIQIAMWKSAPALAAGNAMIFKPSEETPLTVLKLAEIFTEAGLPDGVFNVVQGDYRVGQMLTAHPEIAKVSFTGETGTGKAVMADSADTLKSVTMELGGKSPMIIFDDANVDHAVSAAMVANFYTQGEVCTHGTRVYVHETIYDTFIEQLKRRTELLIVGDPMNMETQIGALISTSHLSKVLSAIDAAKQSGAILLTGGYQYTDNGLAQGNFVQPTVFIDCDESMSHVKNEIFGPVMSVIKFSDETDVIARANNTHYGLAAGVFTQNLARAHRVIHQLQAGICWVNTWGDSPAQMPVGGYKQSGIGRENGIETLQHYTQTKSILIELGDYQSPYA

SEQ ID NO: 24767 - protein, 435 aa, Dehalococcoides ethenogenes 195
MKADYLIVGCSAGGIGAAEAIREVDRDGSIVIVGEEPYLAYSRPMIAKYLSGQKTVEKILFRRPEFYTNNNITCLTGVKAEAVDTTAHEVSLSNGEKVAYGKLLLAPGGKPIVPPIDGANKAGVFNFINMKDASLIDSYVKAENVKKAVIIGGGLIGMSAADALTKLGIEVDIIELKGHILNTILDEAAGKIAAQTVTSYGVKLNTGRTVSKVLGLHKVSGVELDNGHQIESQMLVIAIGVIPRTELCKAAGLEVNRGVVVNDNMRTSSPDVYACGDACESFDFIYNSRRVTPIWPNAYIGGRIAGYNMAGLETTYHGGTVMNSLNYFGMDIATAGMSVLPPDAGGLEVISTLTANGYKKLVLNEQGKIVGMLTLGETDTAGIIFGLMRDQSDVRPIKDNILNENFGLAYLPADSREEHLHGNTSGRVAPADFKH

SEQ ID NO: 24768 - protein, 216 aa, Bordetella parapertussis 12822
MFPKRLTDGYHAFLQGRFHSERSRYEALAEKGQKPEILLIGCCDSRVSPEVIFDAGPGEIFVVRNVANLVPPCEPDAESSFHGTSAAIEFAVNGLNVKHIVVLGHASCGGIRSFYDDGEPLSKMDFIGKWMSQISPVADRLGPSTGDRATDIKRLELAVVEESLRNLMTFPSISSRVERGELELHGTYFGVATGLLYVLDRATGQFAPWLEEDAAA

SEQ ID NO: 24769 - protein, 528 aa, Prochlorococcus marinus str. AS9601
MSQTSLKKERDPSILILDFGSQYSELIARRIRETNVFSLVVSNFISIEDINRINPKGIILSGGPNSVYEQNAPRCDEKIFNLGIPILGICYGMQLMVKELGGTVISATKKAEYGRAPLNIDQESDLLFDVEDKSIMWMSHGDSINCLPDGFNKIAHTENTLHAAISNDVKKLFGVQFHPEVVHSEFGMRVIKNFVYKISCCTADWTTETYIEETIPRIREQVGNKKVLLALSGGVDSSTLAFLLNKAIGNQLTCMFIDQGFMRKGEPEFLMNFFDKKFHIKVEYINARERFIAKLKGITDPEQKRKIIGEEFIRVFEEESNRLGPFQYLAQGTLYPDVIESAGTNIDPKTGERIAVKIKSHHNVGGLPKDLQFKLVEPLRKLFKDEVRKVGAALGLPDEIIKRHPFPGPGLAIRILGEVNNEKLDCLRDADWIVRDEIKKAGLYNDIWQAFAVLLPVKTVGVMGDKRTYSWPIVLRCVSSEDGMTADWSKIPFQILERIANRIVNEVISVNRVVYDITSKPPGTIEWE

SEQ ID NO: 24770 - protein, 198 aa, marine gamma proteobacterium HTCC2143
MKELDNLISNNRKWAKNIKDDDPDFFYRLSKQQNPEYLWIGCSDSRVAANQIIDLPPGEVFVHRNIANVVSHSDLNCLSVIQYAVEVLKVKHIIVCGHYGCGGIQAAMDKQQYGLIDNWLQHINNVYRLNKEEVDGIDHQQDKLDRMCELNVIEQAGNVSKTTIVKNAWKANQDLTIHGWVYDIKDGILRNLNITVSS

SEQ ID NO: 24771 - protein, 90 aa, Zea mays
CNCQQGGCASGGAKRHRKVLRDNIQGITKPAIRRLARMGGVKRISGLIYEETRGVLKIFLQNVIRDAVTYTQHARPKNRTRMDVVYPLKP

SEQ ID NO: 24772 - protein, 522 aa, Magnaporthe grisea 70-15
MFGGLVEVRPLPLAGFLLGVYVAAWFIQAALMDYRIAKRGGGGVKAPRVASNMITAGIWFFWAGWRQMRNDLLSLYNSVYDKHGTPESPNCVEITLTTPGVRFILTREPEHVKTILTSKFSDFGKGYHFHKIWSPFLGDSIFTTDGQLWHDSRSLIRPMFIKEKVRDLDIFDRWTNEMINLLPPPGQSVDIANLLYRMTLDVTTDFLLGESVNALRDEHNEFAYYFNEIQRIQMMLTILVPAAPFLPRHRYYAGIKYIEKFMAPFIEQALALPPDELEKLSKTDKDFTFLHNIARYSRDRKVIRDQIMAVLLAGRDTTAATLSWTIYELCNKPEVVKRLRQEILRVVGPFGNKPTYENLKELKYLTHIINETLRIYPAVPYNIRAALEDSSLPSPDGKPSIAVLKGDIVVYSALSMQRRKDIYPEVSETFPDPAVYCPERWEHWTPKPWTYVPFNGGPRICVGQNFAMTEMAYVLVLIFQKFDRIEYCGDWDAQYHKAEIVGAPGHGVPVTLYPAVDDQVKE

SEQ ID NO: 24773 - protein, 499 aa, Cytophaga hutchinsonii ATCC 33406
MKILTAAQIHQLDLYTQEAEHITSLALMERAAEAFVGWFTKHTSLQKEIWVFCGRGNNGGDGLAIACLLINRGYKVKPFIVKSGPLTSDCAANLSRLEKMVAVTSIVTEEDLVKIPANILIIDALLGSGLNREVTGVYAAIIDKINATENKVYAVDVPSGLYSDYPAKHAAIITADHTITFQMPKLMLFLSDHEAFTGAWHIVDIGLKMEGAADIVSDYSYTDAAVIHKMIRKRPVFSHKGTFGKVLLIAGSKGMMGAATLAAKSILRTGAGLVCVHIPGSGVDIVQTLIPEAILSIDPNKEVVTVLPDIDGYSAIGIGVGLGEHPYTADVLEELLVSSVDPLVIDASALNILASNPHWITHIPPNSILTPHPRELERLAGMKFQNSWERLHKAIEMAKKMQVIIVLKGAYTAVVMPTGVVHFNSTGNSGLATAGSGDVLTGIITSFLAQGYSPADAARLGVFAHGYAGDAAAEVKSKAGMIASDITEYLPMFFLDFEE

SEQ ID NO: 24774 - protein, 460 aa, Rhodobacter sphaeroides 2.4.1
MNSLSNSLAAADIAHSLHPYTNARAHERNGPLIITRGQGVHVYDSEGREYIEGLAGLWSVAVGFSEPRLAEAAARQMAELPYYHTFAGKAHEPQIRLAEKLVEMTPEALTRVFFTNSGSEANDTVVKLVWFMNNALGRPQKKKFLSRIKGYHGITIASGSLTGLPVNHKGFDLPAIPVVHLGCPHHWRFGAEGESEAEFCARLLREAEETILAEGPETVAAFIGEPVMGAGGVIVPPDGYWSGIEALCRKYDILLVSDEVINGFGRTGARWGCEKFGFTPDILVTSKQLTSSYMPLAAVLMTDKVYQTIADHTETLGTLGHGFTGSGHPVATAVGLENLTVIEERDLMGNAARLERPFQDGLRAFRDNPLVGEVRGTGLIAAIEMVADRATKRSFEPLGKVGARAAAFAAEEGLLCRALGDTLALCPPLIVTEADVGRILERMGRALDRTADWARAEGLI

SEQ ID NO: 24775 - protein, 281 aa, Ralstonia metallidurans CH34
MTQSNQDNRGAKMQLQGKVAVVTGAGSGIGRAVAQALAQRGCHLALADRNQEGLAETAALPELNSVKVSLHTLDVADRDAVAAFPQTVLAHHDRIDLLVNNAGVALAGSFEQVSETDFDWVMAINFHGVVRMTRAFLPLLHRSDDARIVNISSLFGLISPPGQSAYSASKFAVRGFSNALRHELADSRVGVTVVHPGGIATSIARNARVSADIPQAQMQERLANSQKMLRMPPPKAADIIVRGIEKRSARVLVGSDAVVMSWLERLFPVRYWNLLARRAKL

SEQ ID NO: 24776 - protein, 234 aa, Oryza sativa (indica cultivar-group)
MEYLPDAVAVGFFAATGEAAELQQREAVDTQLIAHDKEVYDIAWGGAGVFASVSADGSVRVFDLRDKEHSTIIYESGSGGSSNSAGADGGAASPTPLVRLGWNKQDPRYMATIIMDSPKVVVLDIRYPTLPVVELHRHHSPVNAIAWAPHSSCHICTAGDDSQALIWDLSSMGTGSNNGGNGNGNAAAAAAAEGGLDPILAYTAGAEIEQLQWSATQPDWVAIAFSTKLQILRV

SEQ ID NO: 24777 - protein, 255 aa, Haemophilus somnus 2336
MARRPLVMGNWKLNGSKAFTKELITGLKDELNAVSGCDVAIAPPVMYLAEAEAALVSSDIALGTQNVDLNKQGAFTGDISTEMLKDFGVKYVIIGHSERRQYHHESDEFIAKKFGVLKDAGLVPVLCIGESEAENEAGKTEEVCARQIDAVMNTLGVEAFNGAVIAYEPIWAIGTGKSATPAQAQAVHAFIRGHIAKQSQAVAERVIIQYGGSINDANAAELFTQPDIDGALVGGASLKASAFAVIVKAAAKAKN

SEQ ID NO: 24778 - protein, 374 aa, Mesoplasma florum L1
MAKRDYYEVLGVSKTSTEQEIKSAYRKLAKKYHPDMNKESGAEEKFKEVNEAASVLLDADKKAKYDQFGHAAFDGSSGFGGSGFGGFEDFFSNMGGGMDFGDIFSDLFGGGRSGRSSRRGPSKGQDIGLEATLTFKELVFGVNKKTILNLVKTCTKCDGVGAENPSDVHICTKCNGAGQIIVNKQMGPFQVQNQVTCDKCNGVGKEFKSKCKNCHGKGVESKREEVEIPLPKGLWPGQQFVMRGKGHASLEGGIPGDLYITIGIVKSDVFELIPNSNDLIMNYNISYLDAILGNEVIIKTLDGPVRLKIPKGVYSGQLIKVHDKGLYKNQTSDKRGDLLIKISISIPTSVSKEEKKILKELEQLSNFEPKNIID

SEQ ID NO: 24779 - protein, 443 aa, Dehalococcoides ethenogenes 195
MTRAESVEYVLKTAKDHNVRFIRLWFTDILGTLKSYSIAYNELERALEDGMGLDGSSIEGYARIDESDMLALPDPDTFRIMPWSNGEYQVGRMFCDIKHPSGEQFEGDPRYVLKRNLKKAADMGFTFYVGPELEYFYFKNDRSTEFLDEGGYFDLTPRDLATDLRRETIVALQDMGIIVEYAHHEVAPSQHEIDIRYTDALTMADNVMTYRLLVKEVALRHGLHASFMPKPVGSVNGSGMHTHQSLFKGDKNAFFDAKDSYYLSTMAKQYIAGILKYAPEFTAVTNQWINSYKRLVPGFEAPVYLSWARRNRADLVRVPEYKPGHEKSTRIELRSADPGCNPYLAFSVMLASGLKGIEEKLTPPAPIEENVYEMNEAERAKRGIGTLPGSLLEALKLTEGSDLMREALGDHVHKAFISNKKIEWTEYSAAVTDWELKRYLPLL

SEQ ID NO: 24780 - protein, 421 aa, Neisseria meningitidis MC58
MSEALAKETLNPFEIARKQVKTACDRLKTDPAVYEILKSPTRVLEVNFPVKLDDDTVKTFTGYRSQHNNAVGPYKGGVRFHPSVNLDEVKALSIWMTIKCCVAGIPYGGGKGGITLDPRDYSEAELERIARAYAEAIAPLIGEKIDIPAPDVNTNGKIMSWMVDAYENVVKHSAPGVFTGKPVEFGGSLARTEATGYGVNLAAVQALEKLGKDVKGATYAIQGFGNVGYHTGYYAHQSGAKVVAVSTVDVAIYNENGLDMEALFKEFQEKGFITNEAGYGKEITNAELLALDVDVLAPCALENQLTSENAGKVRAKIVVEGANGPTTPEADVILRQNGVLVVPDILANCGGVVVSYFEWVQNLQGYYWEFDEVQEKETVVLRRAFRDIWNLAQEYDVDLRTASYMMSIRRVEKAMKLRGWY

SEQ ID NO: 24781 - protein, 152 aa, Prochlorococcus marinus str. AS9601
MTKERTFIAIKPDGVQRGYVSEILGRFEKKGFKLVGLKQLIPSKELAQNHYGVHRERPFFGDLVDFISSGPVVAMVWEGEGVILSARKLIGATKPLEAEPGTIRGDLAIDIGRNIIHGSDGEDTAKFEINLWFNEEELCEWETSDSKWRSEN

SEQ ID NO: 24782 - protein, 188 aa, Schizosaccharomyces pombe 972h-
MFNFTRQYSVKDGLITDELASHIVENLPARYASAETWKRIYSLQHDGASLQTMYLACEKEKARSGHPKGACILAVRDTDGDVFGVFIPDYLIPAPHYFGSEETFLWKYFPPKKYVHYPFVGNSNFVAYCTKSFLAFGGGNGRYSLWLDGSLEYAYSSRTPAFENNPLSYRGCPDQRIQIVDIELWVLE

SEQ ID NO: 24783 - protein, 549 aa, Buchnera aphidicola str. APS (Acyrthosiphon pisum)
MKNINFNNTQSYQDLKNHFRKIKNIHLRDLFASDLNRFKKFSIIFENEMLIDFSKNRITDETLIYLLNLAKETDVKSGIKLMFSGAKINKTENRSVLHIALRNRTNRPIILNNCNIMLEVNALLEKMKNFSKMVIHGEWKGYTGKSISNVVNIGIGGSDLGPYMVTEALRPYKNHLNMYYVSNIDGTHLTEVLKKINPENTIFLIASKTFTTDETITNAHSAKKWFLHYSQDQSALDKHFFALSANIKNALNFGININNIFKFWDWVGGRFSLWSSAGLSIMLSIGFDNFEKFLDGAHAMDNHFYHTNYKENIPILLALISIWYTNFFGSETEAIFPYDQYMHRFSAYFQQSNMESNGKSINRNGQRINYQTGPIIWGEPGTNGQHAFYQLIHQGTRLIPCDFIAPVFSHNDLNNHHMKLISNFFAQTQALAFGQSRDSILHRLILSKKNQDDIKRILPFKICKGNQPTNSILIRKITPYNLGALIALYEHKIFVQGYILNIFSFDQWGVELGKELSQNIYNYLNINVKNKSYDASTEGLINFYKSFMI

SEQ ID NO: 24784 - protein, 929 aa, Mycobacterium smegmatis str. MC2 155
MTTEFVRQDLAQNSSTAAEPDRVRVIREGVASYLPDIDTEETAEWLESFDELLERSGPARARYLMLRLLERAGEQRVAIPALTSTDYVNTIPTELEPWFPGDEDVERRYRAWIRWNAAIMVHRAQRPGVGVGGHISTYASSATLYEVGFNHFFRGKSHPGGGDHVFIQGHASPGIYARAFLEGRLTTDQLDGFRQEHSHSGGGLPSYPHPRLMPDFWEFPTVSMGLGPMNAIYQARFNHYLHDRGIKDTSDQHVWAFLGDGEMDEPESRGLIQVAANEALDNLTFVINCNLQRLDGPVRGNGKIIQELESFFRGAGWNVIKVVWGREWDVLLHADRDGALVNLMNSTPDGDYQTYKANDGAYVRDHFFGRDPRTKALVADMSDQEIWNLKRGGHDYRKVYAAYRAAMEHKGQPTVILAKTIKGYTLGQHFEGRNATHQMKKLALEDLKNFRDVTRVPVSDAQLEEDPYLPPYYHPGPEAPEIRYLLERRRALGGFVPSRRTKSKPLALPGSDTYKALKKGSGSQAVATTMATVRTFKELLRDKNIGPRIVPIIPDEARTFGMDSWFPSLKIYNRNGQLYTSVDSELMLAYKESEVGQILHEGINEAGSTSSFTAVGTSYSTHDEPMIPIYIFYSMFGFQRTGDGLWAAADQMARGFVLGATAGRTTLTGEGLQHADGHSLLLASTNPAAVTYDPAFAYEIAHIIESGLQRMYGEDPENVFFYLTIYNEPYQQPAEPENLDVEALLKGLYLYRPAPEKRAKSAQILASGVAMPEALRAADLLASDWDVAADVWSVTSWGELNREGVAIEKHRLRHPDEPAGTPHVTSALADAAGPVIAVSDWMRAVPEQIRPWVPGTYVTLGTDGFGFSDTRPAARRYFNTDAESVVVAVLQGLARDGEIDASVAAQAAEQYRIDDVSAAGVSYADTGSA

SEQ ID NO: 24785 - protein, 447 aa, Streptococcus thermophilus LMG 18311
MFMRTLKKVSLAEVNQSIDTPNHNRFWQNLKAFLGPGALVAVGYMDPGNWITSVVGGATYKYSLLFVILISSLIAMQLQQMAGKLGIVTQMDLAQATAFHSPKWLRYTLWVVLELALMATDLAEVLGSGIALNLLFGIPIMVAILVTILDVFLLLLIMKLGFKKIEAIVSTLILTILVIFVYLVALSEPSITGILEGYLPTPTLFGHYAAGHTNHQLTLALGIVGATVMPHNLYLHSSLSQTRKVDHSNDDDVTKAVRFMSWDSNIQLTLAFVVNSLLLILGASLFFGHASDISAFSQMYNALQDSKIAGAVASSTLSTLFALALLASGQNSTITGTLTGQIVMEGFLHMRLPQWVIRLFTRLFALLPVIIVAILYGDQEKTLDQLLVYSQVFLSLALPFSIFPLIYYTSKKSLMGKHVNAKWNTYLGYAIAIVLTILNLKLIFDTF

SEQ ID NO: 24786 - protein, 331 aa, Rhodobacter sphaeroides 2.4.1
MAIELEDLGLSPDVADVMQRLARVGAGIARIISRNGLERDLGAGVGTNAGGDGQKALDVIADDAFRAALEGSAVAYYASEEQDEVVTLGEGSLALAIDPLDGSSNIDVNVSIGTIFSIFPAAAGPEASFLRPGTEQIAGGYIIYGPQCALVCSFGQGVQHWVLDLDAGIFRRMPDIRPLPAETSEFAINASNYRHWPQPIRAFVDDLVAGAEGPRGKNFNMRWIASLVAETHRILMRGGVFLYPGDERKGYERGRLRHVYECAPIAFLIANVGGGATDGCADILTALPDRLHARTPFVFGCASKVARVAAYHDLACEETSALFGSRGLFRS

SEQ ID NO: 24787 - protein, 444 aa, Clostridium thermocellum ATCC 27405
MKLLAGVMEQVIKRNPNEPEFHQAVREVLESLEIVAEKNPEYLKAGIFERIVEPERQIIFRVPWVDDNGKVQVNRGFRVQFNSAIGPYKGGIRFHPSVNLGIIKFLGFEQIFKNSLTGLPMGGGKGGSDFDPKGKSDGEIMRFCQSFMTELYRHIGPDTDVPAGDIGVGAREIGYMFGMYRKIRNEFTGVLTGKGLTWGGSLVRTEATGYGLCYFMEEAMKTIKGKSFEGATVVISGSGNVAIYATEKAQQLGAKVVALSDSNGYVYDPDGIKLDTVKQIKEVERKRISEYVKYHPNAKYTEGCSGIWSVKCDVALPCATQNELDGNAAKTLVENGCYAVGEGANMPCTPEAIDIFMKNGVLYAPGKASNAGGVATSGLEMCQNSMRYSWSFEEVDAKLKDIMVNIFRNVRAVAKEYGQEDNLVLGANIAGFLKVANAMMAQGV

SEQ ID NO: 24788 - protein, 511 aa, Clostridium thermocellum ATCC 27405
MNNELILVLDFGGQYNQLIARRVREANVYCEVLPYNSSIDKIKSKNPKGIIFTGGPASVLDPKAPICDREVFELGIPILGICYGMQLMSHMLGGTVEKAEQREYGKVNITFDTSSMLFEGIEKESTCWMSHTYYVNNLPEGFVKCADTPNCPVAAIENREKKLYGVQFHPEVVHTPKGRDILNNFLYKICGCSGDWKMASFIEHSINSIREKVGDKKVLCALSGGVDSSVAAVLVHKAVGKQLTCIFVDHGLLRKYEGDQVEEVFKKQFDISLIRVNAEDRFLEKLKGVTDPERKRKIIGEEFIRVFEEEAKKIGTVDFLVQGTIYPDVIESGVGDAAVIKSHHNVGGLPDYIDFKEIIEPLRSLFKDEVRKVGIELGIPEDIVMRQPFPGPGLAVRVIGEVTKEKVDILRDADYIFREEIKNAGLDREINQYFAVLTGMRSVGVMGDERTYDYTLALRAVTTIDFMTADWAKIPYDVLEKVSNRIVNEVKHINRIVYDITTKPPATIEWE

SEQ ID NO: 24789 - protein, 657 aa, Rhodobacter sphaeroides 2.4.1
MKDIGAAQETRMANAIRALAMDAVEKAKSGHPGMPMGMADVATVLFNRFLTVDPSAPKWPDRDRFVLSAGHGSMLLYAIHHLLGYADMDMDQIRSFRQLGARTAGHPEYGHAEGIEVTTGPLGQGIATAVGMALAERMKNARYGDDLVDHFTYVIAGDGCLMEGISHEAIDMAGHLGLGRLIVLWDDNRITIDGDTGISTSTDQKARFAASGWHVLACDGHAPEEIAAAIEAARRDPRPSMIACRTVIGYGAPNKQGGHDVHGAPLGAAEIAAARERLGWDHPPFEIPADLYEAWGRIAARGADARAAWETRLQASPLRAAFETAEAADTSALPPAIAAYKARLSAEAPKVATRKASEMALGVVNEALPFAVGGSADLTGSNLTRSKGMVSVAPGAFAGSYIHYGIREHGMAAAMNGIALHGGLRPYGGTFMAFADYCRPSIRLSALMGVPVTYVMTHDSIGLGEDGPTHQPVEHLASLRAIPNLAVIRPADAVETAEAWEIAMTATSTPTLLVLSRQNLPTVRTEHRDENLTARGAYLLRDPGERQVTLIATGSELELALAAADLLAAEGIAAAVVSAPCFELFAAQPADYRATVLGRAPRVGCEAALRQGWDLFLGPQDGFVGMTGFGASAPAPALYQHFNITAEAIVKSAKERI

SEQ ID NO: 24790 - protein, 333 aa, Rhodobacter sphaeroides 2.4.1
MTIRVAINGFGRIGRNVLRAIVESGRTDIEVVAINDLGQVETNAHLLRFDSVHGRFPAKVTSGDDWIDVGRGPIKVTAIRNPAELPWAGVDMAMECTGIFTTKEKAAAHLQNGAKRVLVSAPCDGADRTIVYGVNHATLTADDLVVSNASCTTNCLSPVAKVLHDAIGIAKGFMTTIHSYTGDQPTLDTMHKDLYRARAAALSMIPTSTGAAKAVGLVLPELKGRLDGVSIRVPTPNVSVVDLVFEAARDTTVEEVNAAIEAAACGPLKGVLGFTTEPNVSSDFNHDPHSSVFHMDQTKVMEGRMVRILSWYDNEWGFSNRMADTAVAMGRLL

SEQ ID NO: 24791 - protein, 516 aa, Rhizobium leguminosarum bv. viciae 3841
MTDKTPFYITTAISYPNGKPHIGHAYELIATDAMARYQRLDGKDVFFLTGTDEHGQKMQQTARAEGITAQALADRNSGEFQAMATLLNASNDDFIRTTQERHHETSRNIWKLMADSGDIYKDSYAGWYSVRDEAYYQENETELRADGVRYGPQGTPVEWVEEASYFFKLSEYQEKLLAHYEANPDFIGPAERRNEVISFVKSGLKDLSVSRTTFDWGIKVPNDPAHVMYVWVDALTNYITATGYIEDKNGPRAKYWPADVHIIGKDIIRFHAVYWPAFLMSAKLPLPKRVFAHGFLLNKGEKMSKSLGNVVDPVNLVNHFGLDQVRYFFLREVSFGQDGSYSEEAIRTRINSDLANGIGNLASRSLSMIVKNCDGKIPECGALNDEDRAMLAEVDALHASTREDMGKQQIHRALASIISVVSETDRYFAGQAPWALKKTDPERMGTVLYVTAEVVRQIAILLQPFMPESSAKLLDLVAAAADKRDFAALGEAGRLVAGTALEAPTPVFPRYVAPEA

SEQ ID NO: 24792 - protein, 87 aa, Brassica napus
MTLYIRRESSKLWRRFCCEISTEIGLLAENWKYLLAGLICQYMHGLAAKGVHYIHRPGPTLQDLGFFLLPELGQERSYISETVFTSV

SEQ ID NO: 24793 - protein, 335 aa, Nicotiana tabacum
MVHEKQVIEEVSGWLRVFEDGSVDRTWTGPPEVKFMAEPVPPHDYFIDGVAVKDVVADEKSGSRLRIYLPERNDNSASKLPVILHFQGGGFCVSHADWFMYYTVYTRLARAAKAIIVSVFLPLAPEHRLPAACDAGFAALLWLRDLSRQQGHEPWLNDYADFNRVFLIGDSSGGNIVHQVAVKAGEENLSPMRLAGAIPIHPGFVRSYRSKSELEQEQTPFLTLDMVDKFLGLALPVGSNKDHQITCPMGEAAPAVEELKLPPYLYCVAEKDLIKDTEMEFYEAMKKGEKDVELFINNGVGHSFYLNKIAVRMDPVTGSETEKLYEAVAEFINKH

SEQ ID NO: 24794 - protein, 428 aa, Dehalococcoides sp. BAV1
MSAVVKSIKAREILDSRGNPTVEADVVLSDGSFGRAAVPSGASTGSHEAVELRDGDKSRYNGLGVHKAVANVNTTIASAISGFKASDQQRLDNLLIELDGTPNKAKLGANAMLATSLAVAHAAAASRHMPLYRYLNNSEEYILPVPMFNILNGGKHASNSTDFQEFMVMPVGAKSFAQALQMGTEVYHSLKKVLKGMNQNTTVGDEGGFAPSLPTNKDAVEVILKAIEKAGYRPGEDIFIALDPASSELYQDGKYTLATENKTLSSAEMVDYWCGWVEKYPIISIEDGLFEDDWDGWKLLTRKIGNKVQLVGDDFYVTNIKRLDRGIKEKASNSILIKLNQIGTLSETIAAIKMANNAGWTAVVSHRSGETEDTTIADLAVAMNAGQIKTGAPCRSERTAKYNRLLRIEEELGGKAKYPGKDAFLNLK

SEQ ID NO: 24795 - protein, 249 aa, Brevundimonas vesicularis
MLKDLFVTTLALSLIIGVRYLLVGVVTHSLLWGGAGRGRQLNHRPPAAKRIRAEVVASLIACPIYALPAAFVIEFWKRGGTAIYDDAHAWPLWWLPVSFIVYMLAHDAFYYWVHRALHHPRIFPWAHAEHHRSRDPSAFASFAFDPAEAIATAWFLPALTLFIPIHWGVALALLTLMTATAVLNHAGREVWPASWLKRAPLRWMITATHHDAHHKRFNGNYGLYFQMWDKWAGSEISQLDRPSPRNPLT

SEQ ID NO: 24796 - protein, 389 aa, Halobacterium salinarum
MSEDFYDVLGVSRDATEDEIMQAYRDQVSEYHPDVSDDPDAEEKFKKIQKAKDVLTDEETRQQYDQLGHERFEEAEKRGATGNGGGGAGGMGGAGGPFGGGMGGGAGGGMGDIFEQFFGGAGGGGGRGRSGPEQGRDLRTDLTVTLSEAYRGVSKQVTVRRPESCADCGGSGYPEDADVRTCPQCGGQGVVTQVRQTPLGRVQQRQECSRCGGEGELHSETCSTCGGQGQTRERATLTVDIPEGIRTGQTCAWTGEGATGEPERGDLLVDVTVEEHPDFERDGTTSITATPFSFPQAVFGAEIEVPTLDGAATFDLDAGTQSGETFRLKGKGMPRLRRRGNGDLYVTVQVVTPESLSDEQRDALEQFAEAGGEEIDVEQGFFEKLKNSF

SEQ ID NO: 24797 - protein, 334 aa, Bordetella parapertussis 12822
MTTAALPYPLDPQIQRFVERMQADSAAHPRRDLVPVEQARAISEAVRRPWAEGGPQMARTREIHAPTPHGPVRLRVYTPRAARPGPAMLYVHGGGWVLFSLDTHDRLMREYAERAGLTVIGVDYTRAPEARYPRAIEEIVGVIDWLDANGAELEVDRARLCIGGDSAGANLSVAACLTLRERGAAPLAGMVLNYGVYDANLFRDSTVKYGGGEYLLSTQQMVWFYWNYLRAGDDPRDPRISPVHADLRGLPPAFMAITELDLLHDANQDMAARLREAGVDVQAKVYPGTVHSFLEAVSLAQVSVAAFDDTAAWLRAVLRPAAAAAAIHTGEHQP

SEQ ID NO: 24798 - protein, 369 aa, Triticum aestivum
MNILGAPTIVPAVILIVLAVLIYRQLSKAKEDDEWEIKCGMPSFTYKELVTATEGFSNKMLLGKGGFGRVYKGVLPTTTQHVAIKRVSPESKQGKKEFMAEIAILGHVRHRNLVQLLGYCRYKQELLLVYDYMPNGSLDRYLYDKTTPTLDWAQRLRIIKGVASGLFYLHEDWEQVIIHRDVKASNVLLDDDMNGRLGDFGLARLHDHGVDAHTTLVAGTWGYIAPELARLGKATKATDVFAFGVFTIEVVCGRKPIGPANTSGGLLALADWVRGTWQGASIVDAGDPELKDYDAAEVEPVLKPGLLCSHSLPRSRPCMRLVMLYLEGGARLPNFHPASLVPEGHEDEETDHKALSTSAATTVTILSGR

SEQ ID NO: 24799 - protein, 1028 aa, Ashbya gossypii ATCC 10895
MPLLFKQIKHVVTPFALSAYFCAKHPIHVLMATLIFASTAYLTVVDEYFKGWQLDAKSIFAQPALADECVHYYRAPASDNWTQVTAGQLQGMSADHYYLMKVEFDATNAGQPLPAMDPLVHREGHSQYVLQDSLALPPVLRTGDAVWKLRAHRHKIYDIRHYLQSAYNDLRGRIFDAEPFDVFIIGSAYLGMLYTIVGLFLDMRKVGSKFWIGLSALFNSVFAFVFALYTCQYVLEKPVSLLSLVEGIPFVVAVVGFRHKIKLAAFVVTHFKNFGISKRETAGDIVYEALRQEGQRMVQDHFLCILAFSGCSLYASSLEVLTNFCVLAALLLLYDLLLTCTFYASVLALKLEINLIHRSTAIKQALEEDGVFTSTAGIVSDAETKSMLSLLTSNTSITLLKLVIVLGFIGVNFYNFGTRWTYNALPPIAPALRAGPVPTFIASQIGPSAIISMPPVQYYEPMKVYFQVEDTILSSLRFISVAIRDRFISKLVLFALAISASINVYLLNIARIHTEFTTNELNNKKKARKTASFSVGSTPIVVPARETIPKSTVSSSETKVVGSVASSIVPSDDETETEDEAEPVRPLATLIDVLRKGAVKTLKNKEVVSLVVNSELPLYALEKQLGDTTRAVIVRRKALAKLADAPVLETERLPYKHYDYDRVFGACCENVIGYMPLPVGVIGPLVIDGVAYHIPMATTEGCLVASAMRGCKAINAGGGVTTVLTKDGMTRGPCVRFPSLARAGACKLWLDSEEGQARVKRAFNSTSRFARLQHVQTALAGDLLFIRFRTTTGDAMGMNMISKGVEFALHQMGAEFGWHDMEIVAVSGNYCTDKKPAAINWIEGRGKSVVAEATVPPDVVRKVLKSDVAALVDVNISKNLVGSAMAGAVGGFNAHASNLVTALYLALGQDPAQNVESSNCITLMRDVGGDLRVSVSMPSIEVGTIGGGTILGPQSAMLDLLGVRGPHPSAPGTNARQLAKIVASAVLAGELSLCSALAAGHLVQSHMIHNRAKTPADPEVPCRRPACI

SEQ ID NO: 24800 - protein, 1123 aa, Ustilago maydis 521
MADAQVLTPDQIQKLLAAQQSQASNSSSTPLAAAAPCSSNRLKTSFKKRRSFEPFYTGGATAVTPDGALLFATLNDQVCVVQVSTGNVVQRLAGDTEEVTALTVSPSGSHLVVASRSLSLSIYTLPECKLVRNLAKSHQSQVNLMSIDPTSTLLATGGSDGVAKVWDIERGFCTHAFKGHAGVVSALAWNMPPCSSTSNTTSKKNKSKSKASSDNTATRIIQLLTGSVDGKVRVWDLNNPAELHKPVATLTGHDSVVRGIAVTEDGATLVTGSRDRTLVVWRLPASAAAKSSAQAAAGWKQAETLSANEGIESVGFLPATSLGEQQVFWTGGSDGILRLWDVASSTIIAKEPKTFNEQLAHYAKQQRAKRASAAGRTVDHAYADDEETRAIMAVHLVSNALGPQLVSVHADQNIVVRSAGGAAGARLNKVRQLIGFNDEIVDLALLSCTAIDHTTVQETHLAVATNSRSLRVYTLGGADGDETTAELLAGHTDIVLCLDKSPDMRLLASGAKDKTTRIWAYVPTWRLSTCLGSEQGADDGGVKISRHTTSISNASAGSHVEQGEWVCVGICEGHAESVGAIAFARRASSPGAPYSPFIVTASQDRTVKIWDLSPVNTLLSSTQPIAHPIQLKSLVTQRVHEKDINCLDISPNNAMLATGSQDRTAKILSLSFSASSSKSSAATARLTTLATLKGHKRGIWACRFSPVDLALATASGDKTVRLWSLKTFTSVKLFEGHTNSVLKLSFLSAGMQLASCAGDGLVKIWNVKDEECTSTIDAHDDKVWSIAVSSDESWMVSAAADGSIRAWEDRTEEEKEEKRQQREDEVRMEQQFGNMLVDKDWRNAIALALQMAQPRRLLGLFTHVSQCRPQVERAKRNALLTSALQVDSDDDQDEHMIAFEQDDEPLRAAGIPTDSRPHRPRNASTNAHSQSDASCAADADANSITGLASIDSILSTLPPNQLIQLLLYIRDWNTSTRTAPIAQTVLHAILSTHTASSLISIFDSASKSHRAALAERLENEELGIVAPLAQKESARQRRLQNETKVDLASLVEALLPYTERHWQRADRVLIEASMLEYSVQAMDTLLGFDQDDDDAAEQNTFADQLRSASVQDEHVDMSDDDSL

SEQ ID NO: 24801 - protein, 477 aa, Neisseria meningitidis MC58
MNEYSQLIKHPDISLPPVSDGIKVDNPATGETLAFVRKTDSDKLKNLIQKAAAAQKLWAAKTALERADVLWRWYFQIKENKEALARLMTMEQGKSLTEARGEIDYAASFVRWFAEEARRIDGDVLTSVKASQKLVVLKQPVGVTAAITPWNFPSAMIARKAAPALAVGCAMIVKPASLTPLSAYALASLAYEAGIPQDLLPVVSGSASEIGHEFATNPIIRKISFTGSTEVGAKIFADSAADIKKLSLELGGNAPFIVFDDADLDKAVEGALASKFRNSGQTCVCTNRVYAQSAIYDEFCRKLSEKAAALKLGNGLEDGVNQGPLIEEKAVEKVEQHIADALAKGASCLTGGKRSALGGTFFEPTVLSGVTAQMAVAREETFGPLCPVFRFETEAEVIEAANNTEYGLAAYLFTADTARQWRVGEALEYGMVGINTGLISNEAAPFGGVKRSGLGREGSKYGADEYLELKYLCMDVG

SEQ ID NO: 24802 - protein, 343 aa, Kluyveromyces lactis NRRL Y-1140
MSNNPLQTIDISEVEGVTATKLLDAAMKQGFLFVDGHGFTQEEVDMLFDLSKRFFTTTAHDEKLKYYFDATNNFGYTDFSSEQLDLTKGRDFKECYNFGAVNFTKGTYNTPNPEAKVKYTEQNETPGCLKDEDGLIVTVLQKYHKVATEILRLVTIALGIEDKNFFTEKMRPDQKNGCVMRFLRYPLVRDDDLTEDPTLDPTIRAGAHTDYGALALLMQKQGQQGLELQIDKNSKEWVKVPFVASKYEGKAPPLVVNFGDMLSYWTNGVLRSTNHRVKFSPGETRTSDRYSIVFFVHPDANTTLDPVPSKIVEDAWDGKKTPTLTAFQYLQKRLRETYDWQNN

SEQ ID NO: 24803 - protein, 194 aa, Thraustochytrium aureum
MVFYSKWLQKMLGKSLISVKIETNSIFLSIKKEKLLEVLVFLAKHTNCNYTILSDITVVDYPKNNNRFEIIYNLLSLTNNHRLFVKIQTNSNWFVPSMVTLFSNANWYEREAFDIFGIFFSGHPDLRRILTDYGFEGHPLRKDFPLNGFNEVRFDFEKKRVICEPLEISQEFRNYKDFSIKQNIFKKNQTFKRV

SEQ ID NO: 24804 - protein, 249 aa, Brassica napus
  misc_feature (57)..(57): Xaa can be any naturally occurring amino acid
  misc_feature (164)..(164): Xaa can be any naturally occurring amino acid
  unsure (1)..(249): unsure at all Xaa locations
MGESKGYGKGGRVIPNAKSANSYNVSLQLSPVVSFWDCIVRTMRYSYIPEWVVIYSXASMDHAVCKQVQPLARKGKSKKHNGKDEFDRVKQAEKKKRRLEKALANSAAIRAELEKKKQRKLEEQQRLDEEGAAIAEAVALHVLLGEDSDDSSRVMLGQENGLFXMDLFTGERTNYVPRQSCASYAVQGIGFVSNGYGLGDSNWSPFTRESWDSNMGVSADLIAAQAVSSLRISENTDRNAFVLKGMFRG

SEQ ID NO: 24805 - protein, 1089 aa, Fusarium oxysporum
MTATTQKRVVVVGLGMVGIAFIEKLLKYDAKSKEYAITVVGEEPYLAYNRVGLTTFFEHRKVEELYMNPAEWYTEAGSSLNCHINTKATHINTEDKIIECANGESYPYDILVLATGSDAILPRMLKGWDANGVFVYRTIEDLNKLIKFSNDKKGTNGAVVGGGLLGLEAAKAMLDLETFNRVDVIEKAQWVLTRQIDETGGKMVADQVSQLGVNLNLGKGVSSMKTDENNNLTGVIFDDGSEISCSTLCFAVGVKPRDDLARSANLEVGQRGGIVVNDDLRTSMPDIYAIGECASWRGMAYGLIAPGVAMAEVVAFNLTQAKLHSPQTFKTPDMSTKLKLLGVNVASFGDCFADRDGPVTLPPKYARTLVNGDAKEPKAVQALTYKDPFSNVYKKYIFTKDGKYLLGGMMIGDVCDYVKLLPMVKAQKELEISPSELILGAKKDGGEDTDDLDDDAQVCSCHNVTKGDIVKVVKDGTCKDVASIKKCTKAGTGCGGCVPLITTIFNKTMASMGQEVTNYVCSHFNHSRADLFNIIMVKRLKNMGEVMREAGNDKEALGCELCKPVVASIMASLWNRHVMDKTTHGLQETNDRFLGNIQRDGTYSVVPRVSGGEITPDKLVVIGEVAQKYNLYTKITGGQRIDLFGAQKQDLLDIWGQLVAGGMESGHAYAKSLRTVKSCVGSTWCRFGLSDSVGMAVRLEERYKSIRAPHKIKGGVSGCVRECAEAQGKDFGLIATEKGWNIFVGGNGGANPRHAELLAKDVPPADVVTILDRYLMFYMRTADKLQRTARWIENLPGGIKYLQEVILEDKLGINASLEAQMEELVDSFFDEWAEAIKSPAIAAKFKQFANTNDTTRNMELEDDRGQKRPAFWPADAAATDNFSGLKDKWSMTSWEPIIESSYFDGADELPNGISATVKRGDTQLAIWRIKGVYYATQQMCPHKRAFILSDGLIGQEPNKAVTNGDKDGASPWVSCPHHKRNFDLGNGACKTDESLSIATFPTEARADGMLYLKLPPVEELDAALGTKKWMVKKGEAGEAPLAKLDSKIKFVGLRGKKPYVKPTGGAKMTTKPLDLMMAANGCGGGAPEW

SEQ ID NO: 24806 - protein, 473 aa, Bacillus cereus ATCC 10987
MRKKVVIIGGGITGLTTMYNLQKDIRDNNLPIDTLLIEASGKLGGKIQTVQKDGFTIERGPDSFLARKESAATLVKELGLGDELVNNQAGQSFILVNNRLHKMPNGSMMGIPTQITPFLFSGLFSPIGKLRAGFDLLMPRSKPVCDQSLGQFFRHRLGNEVVENLIEPLLSGIYAGDIDEMSLMSTFPQMYQIEQKHRSISLGMRTLAPKEEKAEPKKGIFQTVKTGLESIVESLEAKMHEGTIIKGTRIEKVAKQGDAYTITLSNGKEIEADAVVVASSHKVLPSMFAQYKQFRFFRNIPSTSVANVAMAFPKSAIQRDIDGTGFVVSRNSDYTITACTWTHKKWPHTTPEGKMLLRCYVGRPGDEAVVEQTEEELVQLVLEDLRKTMDITEDPEFTVVSRWKEAMPQYTVGHNERMKKLTTFMEKELPGIYLAGSSYAGSGLPDCIDQGEKAAKRVLAHLEKVMDTELIAQ

SEQ ID NO: 24807 - protein, 407 aa, Escherichia coli
MEALTFKPEEWGMKRGTENEDFMFLNLGPNHPSAHGAFRIVLQLDGEEIVDCVPDIGYHHRGAEKMGERQSWHSYIPYTDRIEYLGGCVNEMPYVLAVEKLAGITVPDRVNVIRVMLSELFRINSHLLYISTFIQDVGAMTPVFFAFTDRQKIYDLVEAITGFRMHPAWFRIGGVADDLPRGWDRLLREFLDWMPKRLASYEKAALQNTILKGRSQGVAPMARKEALEWGTTGAGLRATGIDFDVRKARPYSGYENFDFEIPVGGGVSDCYTRVMLKVEELRQSLRILEQCLNNMPEGPFKRDHPLTTPPPKERTLQHIETLITHFLQVSWGPVMPANESFQMIEATKGINSYYLTSDGSTMSYRTRVRTPSFAHLQQIPAAIRGSLVSDLIVYLGSIDFVMSDVDR

SEQ ID NO: 24808 - protein, 362 aa, Oryza sativa (japonica cultivar-group)
MGVYLSTPKTEKYSGEGGNDRLRYGLASMQGWRTTMEDAHTALPRLDECTSFFGVYDGHGGKAVSKFCAKHLHLQVLKNEAYSSGDLATSVLKSFFRMDEMMKGQRGWRELAELGDKGQKFTGMLEGIIWSPKPGESDKPEDTWTEEGPHSHFPGPTSGSTACVAIIRNDELIVANAGDSRCVLSRKGRAYDLSKDHKPDLDAEKERILNAGGFIVAGRVNGSLNLARAIGDMELKQNEFLPAERQIVTAEPELNTVKLSEDDEFIVLACDGIWDCMSSQEVVDFVHKEMNTEDSLSAVCEKLLDHCLAPVSGGDGCDNMTVIIVKFKKPSKSAATSSTNQSVSSEEMRPNELDDGPSDPNK

SEQ ID NO: 24809 - protein, 273 aa, Schizosaccharomyces pombe
DQNPQEIVALFSQQEAYAKLGKYKDEIWDVYQKVFIAALTTGETVLAKKCWNRLNDRFHKSPRVEGLYGMFLEATASEKDAMSYYNSKLSEDPTHTVIYKRKLALLRSMGQTKECIQGLINYLDTFYNDLEAWAELADIYVSVEAFESAIFCYEEMVLLQPFEPRLFARLGDLYFVLAQSNATNYWFSLKHYCRSVEICEEYFHGWFGISKCCQQLLELSRTELKRLLSKVNEKISDTFPDTESVRQLYQLSLKKSDLFAQKQPKLKALLEQC

SEQ ID NO: 24810 - protein, 188 aa, Ashbya gossypii ATCC 10895
MLANSSRSLLPSSRRLFSSSAASLGTKVFFDTSINGAKAGRIEFELYDDVVPKTAENFRALCTGEKGWGYKGVPFHRIIPDFMLQGGDTDLTNGFGGKSIYGARFPDENFTKKHTRAGLLSMANAGRNTNGSQFFITTVPCPWLDGKHVVFGEVTKGMDVVKAIESYGTGNGQPSAKVVIEDAGELKE

SEQ ID NO: 24811 - protein, 263 aa, Haemophilus influenzae Rd KW20
MARRPLVMGNWKLNGSKAFTKELIEGLKAELHDVTGCDVAIAPPVMYLGTAEAALSGCGCSCGGKSVIQLGAQNVDINVKGAFTGDISTEMLKDFGAKYIIIGHSERRTYHKESDEFVAKKFGALKEAGLVPVLCIGESEAENEAGKTEEVCARQIDAVINALGVEAFNGAVIAYEPIWAIGTGKSATPAQAQAVHAFIRGHIAAKSQAVAEQVIIQYGGSVNDANAAELFTQPDIDGALVGGASLKAPAFAVIVKAAAAAKN

SEQ ID NO: 24812 - protein, 199 aa, Brassica napus
  misc_feature (20)..(20): Xaa can be any naturally occurring amino acid
  misc_feature (143)..(143): Xaa can be any naturally occurring amino acid
  unsure (1)..(199): unsure at all Xaa locations
VDHASDSRAIPRAVDWRNLXKIALDIARALAYLHDQCVPRVLHRDVKPSNILLDNDHNAYLSDFGLARLLGTSETHATTGVAGTFGYVAPEYAMTCRVSDKADVYSYGVVLLELLSDKKALDPSFVSYGNGFNIVQWGCMLLXQGRAKEFFTAGLWDAGPHDDLVEVLHLSVICTVDSLSTRPTMKQVVRRLKQLQPPY

SEQ ID NO: 24813 - protein, 369 aa, Pseudomonas syringae pv. syringae B728a
MKSRAAVAFEPGKPLQIVEIDVEPPRKGEVLIKITDTGVCHTDAFTLSGDDPEGLFPVVLGHEGAGIVMEVGEGVTSVKVGDHVIPLYTAECGECLFCKSGKTNLCTAVRATQGKGVMPDGTSRFSYNGQPLYHYMGCSTFSEYTVVAEVSVAKINPDANPEHVCLLGCGVTTGIGAVHNTAKVQPGDTVAVFGLGGIGLAAIQGARQAKAGRIIAIDTNPAKFELARSFGATDCVNPKDHEQPIQQVIIEMTGWGVDHSFECIGNVHVMRAALECAHRGWGQSIVIGVAGAGQEISTRPFQLVTGRTWKGSAFGGVKGRSQLPKMVEDAMKGEIELAPFVTHTMGLDRINEAFDLMHEGKSIRTVIKY

SEQ ID NO: 24814 - protein, 410 aa, Pyrococcus horikoshii OT3
MFRLEDFNFHNKTVFLRVDLNSPMKDGKIISDARFKAVLPTIRYLIESGAKVVIGTHQGKPYSEDYTTTEEHARVLSELLDQHVEYIEDIFGRYAREKIKELKSGEVAILENLRFSAEEVKNKPIEECEKTFLVKKLSKVIDYVVNDAFATAHRSQPSLVGFARIKPMIMGFLMEKEIEALMRAYYSKDSPKIYVLGGAKVEDSLKVVENVLRRERADLVLTGGLVANVFTLAKGFDLGRKNVEFMKKKGLLDYVKHAEEILDEFYPYIRTPVDFAVDYKGERVEIDLLSENRGLLHQYQIMDIGKRTAEKYREILMKARIIVANGPMGVFEREEFAIGTVEVFKAIADSPAFSVLGGGHSIASIQKYGITGITHISTGGGAMLSFFAGEELPVLRALQISYEKFKEVVK

SEQ ID NO: 24815 - protein, 515 aa, Blastopirellula marina DSM 3645
MALAEESESSAAAIAPTANFAPGSEYDDSARMFQGISGLERSPGGRLWATWYGGGVTEDRHNYILLVSSDDEGKTWSENKVVIDPDKEGPVRAFDPCPWVDPSGKLWLFWCQATRGGGGDPHTFAMTTENPDDAQPKWSAPQLVHNGVMMCKPTALANGDWLLPTAIWGRDHSCRVVASTDQGKTWSLRGTANVPAAKDRNCDEPMIVQRKNGELWQLVRTSYGIGESHSTDGGKTWTAVTPWNIRHTASRFFIRRLQSGNLLLVKHGPLHEKTGRSHLTAYLSKDDGQSWEGGLLLDERSGVSYPDGAESQDGVVYLTYDYDRQGQKYIYMTTFTEADVLAKKPVSDHVRQRLVINQATGLNTRKAAKAKPVKIEFASNDDGAPLSTASAAEIQPQIGEIQPLELGVQLFTDRNYKLHDLPKTLSGKRFVQSSIEKSSVKCTAAGVVLVVTPSEGRNQDSLSDDLLKQGFTKVKLSEFLLFSETNAPGNVCTTYQKNLKEGETLELGKWGVILF

SEQ ID NO: 24816 - protein, 480 aa, Haemophilus influenzae Rd KW20
MFGPFKPAPHIAELPAEKIDSTYKRLRWQVFAGIFFGYAAYYFVRANFDLAQPGLIQAGLYSKAELGVIGSAAGLAYGLSKFVMAGMSDRSNPRVFLPFGLLLSGLCMTLMGLFPWATSGIAIMWVMIFLNGWFQGMGWPPCGRTMVHWWSKSERGTIVSIWNTAHNIGGMVPGAMVLLASAIFFSTHGIEAQAKDVWQQSLYFPGIAAMIFAIPVYFVMRDTPQSCGLPSIEKWRNDYPDDYNEKTYENDLTAKEIFVTYVLKNKLLWYIAIANVFVYLIRYGVLKWSPVYLSEVKHFNIKGTAWAYTIYELAAVPGTLLCGWVSDKVFKGKRGLTGFIFMILTTAAVVAYWMNPATPEAELANYSAWYENPYQLTDFVLMTLIGFLIYGPVMLIGLHALELAPKKAAGTAAGFTGLFGYLGGTVSASAVIGWAAQHYGWDGGFYVMIGGGVLAVLLLLIVMVEEGKHKAKLGDTYGTK

SEQ ID NO: 24817 - protein, 351 aa, Mycoplasma pneumoniae M129
MKAYAMLKIGATGWIEKPRPVCGPNDAIIRPLAVAPCTSDVHTVWEGGIGERHNMVLGHEGCGVVDEVGSEVKSFKVGDRVLVAAITPEWNSVNAQAGYPMHSGGMLGGWKFSNVKDGMFAEYFHVNDAEGNLALMPEGMDLADACMLSDMIPTGFHANELADIQYGVALSFFCAGPVGLMAIAGAALKGAGRIIVVDSRPDIVEIAKAYGATDYIDFKKVSVVDEILKWTNNEGVEKVLISGGGSTILETAIKVLRPGGKIGNVNYFGAGEFLTIPRVEWGVGMAHKAIHGGLMLGGRLRLEKLARLIMTKKLDPSKMITHRFKGFEHIEEALFLMKDKPKDLIKSVVIF

SEQ ID NO: 24818 - protein, 259 aa, Streptococcus thermophilus LMG 18311
MEDIMPKNVLIIGATSGIGEATARAFAREGANLILTGRRVERLEALKAEFEATYPNQKVWTFALDVTDMEMVKDVCQAILKSVGQVHVLVNNAGLALGLIAYQDYEEWDLLTMLDTNVKGLMMVTRQILPSMVATNEGHIINMGSKAGIYAYAGAAVYSATKAAVKTFSDGLRIDTIATDIKVTTIQPGIVETDFSQVRFHGDKEDKAANVYQGLEALQAQDIAEAVLYVTKQPRRVQISDMTIMANQQATGFTIHRGE

SEQ ID NO: 24819 - protein, 120 aa, Triticum aestivum
  misc_feature (32)..(32): Xaa can be any naturally occurring amino acid
  unsure (1)..(120): unsure at all Xaa locations
MEIESVKCECCGLREDCTPDYIASVRAGFYGXQWLCGLCCEAVRDEAGRKKQAHPGVEEAVRAHMAFCKKFKSNPAVRVADGMRQMLRRRSGDLSKPPGSSSSNKYGTAQVGDDSPVSLY

SEQ ID NO: 24820 - protein, 217 aa, Arabidopsis thaliana
MFCDSAETQQWFDKNAPDWGFTEMISLTELHAEEGLLRNGELTVVAKVEVLEVVGKLDVSEESSPVIETIDVNGFQVLPSQVEYAKSLFERHLDIASKFRPKNPYLKTAYMNVLLSLTQTICQSPQELSNDDLSDAGAALAYLREAGFELDWLEKKLNEVKEKKKKEEACLAEIQDMDEHVKPLKKKYLDLEAQIDKKKAELLAARAPLSLNDDNVV

SEQ ID NO: 24821 - protein, 833 aa, Chromobacterium violaceum ATCC 12472
MSDALLTPQLIRLGCQPAGKEAAIREAGRMLADAGCIAPDYIDSLLRREAVANTYLGNGIAIPHGMVEDRAMVLRTGVAILQIPAGLEWNPGQRTHLLCAIAARSDDHLVLLRQLTRLLQDEARLLPLFSTRDSADLIAALEQPAETPQADVEAQDLDVRDEWRLDYPNGLHARPAALWVEAARRSPAQLQVRHGGRAADAKNLISLLQLGLRQGDLVAVSARGPQAEEGVRQLLKAMREASLAEQTAAAIAAQRAAGARKTAGWQPAGSLISLPGIAASPGLAIGTVRVLAGERLQVPDRPVSLADGGDRLHEALAATRQQLAELADSTQATLGAGEAGIFRAQAELLNDTDLITLSCQLMVAGHGVEWSWHQAVERLAEKISALGNPLLAARAADLRDVGRRVLFHLDPALQGSAPAEFGPDTLLLAADLSPSDTASLDLSRVKGLATAQGGPTAHTAILARTLGLPALVAAGAALLDVADGSPAILDGDAGRLYLNPGDADLASARAWQQRQLEDQQKQQAERQQPGQTADGKRIEIAANINRPDQAAAALDAGAEGVGLMRTEFLFLEREAAPDEEEQLRTYLAMQQALQGRPLIVRALDIGGDKQVPYLNLPHEDNPFLGMRGARLLLSRRELLEPQLRALYRAAKAGKPLSIMFPMISSLKEITRLKGLCEGVRKELDAPQVPIGIMVEVPAAALLADQFAPYVDFFSIGTNDLTQYALAMDRQHPELAAEADSLHPAVLRLIRQTVQGAAAHRRWVGVCGGIAGDPQGAAVLAGLGVDELSMSPHDIAAVKAMLRRHSHARLRELAEQALACDSAEEVRQLLEALA

SEQ ID NO: 24822 - protein, 468 aa, Saccharomyces cerevisiae
MGQILSNPIIDKEHHSGTDCLTAFGLCAMQGWRMSMEDAHIVEPNLLAESDEEHLAFYGIFDGHGGSSVAEFCGSKMISILKKQESFKSGMLEQCLIDTFLATDVELLKDEKLKDDHSGCTATVILVSQLKKLLICANSGDSRTVLSTGGNSKAMSFDHKPTLLSEKSRIVAADGFVEMDRVNGNLALSRAIGDFEFKSNTKLGPHEQVVTCVPDIICHNLNYDEDEFVILACDGIWDCLTSQECVDLVHYGISQGNMTLSDISSRIVDVCCSPTTEGSGIGCDNMSISIVALLKENESESQWFERMRSKNYNIQTSFVQRRKSIFDFHDFSDDDNEVFAITTKKLQDRLNRSKDNDDMEIDDLDTELGSSATPSKLSGEDRTGPIDLFSLEALLEAGIQIRQRPSSDSDGNTSYFHGASLSDMLASLSNAAAGETEPNDADDNDDNDGEENGKNENAKKGSKIEEIE

SEQ ID NO: 24823 - protein, 192 aa, Triticum aestivum
  misc_feature (19)..(19): Xaa can be any naturally occurring amino acid
  unsure (1)..(192): unsure at all Xaa locations
RDREREREESRCFIGDGAXLVRDAFELAKEKAPCIIFIDEIDAIGTKRFDSEVSGDREVQRTMLELLNQLDGFSSDERIKVIAATNRADILDPALLRSGRLDRKIEFPHPTEEARARILQIHSRKMNVHPDVNFEELARSTDDFNGAQLKAVCVEAGMLALRRDATEVIHEDFNEGIIQVQAKKKSSLNYYA

SEQ ID NO: 24824 - protein, 259 aa, Ralstonia metallidurans CH34
MENASTAHPFSLTGRVALVTGGAQGLGQAIAAGLAAAGAHVLICARNAARVDEAVAQLRANGLGAEALVLDITDEAAVAAAFDDIVACHGRLDILVNNAGARNRNSMAHLDAADLRQMLETNLVAPYALCRHAAQWMQRGGYGRIVNVTSIAGQVARANDVLYPATKGGLDALTRAMAADLGRQGITVNAIAPGYFATEPNQTMVADKTVAEWLRNRTSLGRWGQPEEVAGAVVFLASPAASYVTGQVLAVDGGYLGHF

SEQ ID NO: 24825 - protein, 182 aa, Vitis riparia
GEGGLGNVYKGYIDGGDTIVAIKRLKSKSKQGAHEFLTEIEMLSKLRHRHLVPLIGYCEEEGEMILVYDYMHHGTLRNHLYGADNDPLPWKQRLEICIGAARGLDYLHAGAQHPIIHRDIKSTNILLDNKWVAKVSDFGLSKMRPSDDPVTTVVKGTFGYMDPEYYKWMKLTQKSDVYSFGV

SEQ ID NO: 24826 - protein, 231 aa, Oryza sativa (japonica cultivar-group)
MFGTPASSPLFGTPSTTPAFGAPSSTPAFGTPSTNPAFGTPSSTPAFGAPSSTPSFGTPSTAPAFGTPSSTPAFGAPSSTPAFGAPFSTPAFGVAPSPSPSPFGFQQQMTPSPSPFGFAGGGGGQITTQMAPVAPLPLSPSDRDIQAIVDAYKEDPGNPRYAFRHLLFSVTEPSQRVKPVAASDIMWAEAMGKLEGMDSSDRERLWPQLVQGFKDLSYRLKVRHLDWIPSI

SEQ ID NO: 24827 - protein, 163 aa, Vitis riparia
GEGGFGGVYKGLLSDSKTEVAVKRVSRGSKQGKKEYVSEVKIISRLRHRNLVQLIGWCHEHGELLLVYEFMPNGSLDTHLFGGNSTLKWTVRYKIALGLASSLLYLHEEWEQCVVHRDIKSSNVMLDSNFNAKLGDFGLARFVDHELGSQTTVLAGTMGYIDL

SEQ ID NO: 24828 - protein, 679 aa, Zea mays
MSSRSSLLPLLLLCAAAAAAAASSRNAELDALMELKAALDPAGRALASWARGGDPCGRGDYFEGVACDARGRVATISLQGKGLAGAVPPAVAMLPALTGLYLHYNALRGEIPRELAALPGLAELYLGVNNLSGPVPAELGRLGSLQVLQLGYNQLTGSIPTQLGHLNKLTVLALQSNQLSGAIPASLGDLPALARLDLSSNQLFGSIPSKLAEIPRLATLDLRNNTLSGSVPSGLKKLNEGFLYENNPELCGAQFDSLKACPNDGNDDNDDGRTPRKPESTSVKPQQIQKTADLNRNCGDGGCSKPSTLSTGAVVAGTVVIVAGAAACGLSAFSWHRRQKQKEAYQRSAVSSLINVEYSSGGWDTSSEGSQSQHGVARLSSSTEGGSPSVRSFNLEEVECATQYFSDVNLLGKSSFAATYKGVMRDGTAVAVKSISKNSCKSEEADFLRGLRTLTSLRHENLVGLRGFCRSRASGGCFLVYEFMANGSLSWYLDAKEGDAADAAAVLDWPTRVSIIKGVAKGIEYLHSSKPSLAHQSISADKVLLDHLYAPRLSGAGLHRLLADDVVFAALKDSAAMGYLAPEYATTGRSTDKQGDVYAFGVVVLQVLAGRRAVSPPHLQQGGGGGGRLDDLVDPRLRGRFSRAEAAKLAGVALLCTAEAPAQRPTMTAVLQQLGTSSQ

SEQ ID NO: 24829 - protein, 434 aa, Pyrobaculum aerophilum str. IM2
MTEKWYQLSVEIHRKYGGKISITPKVPIRSMDDFAIYYTPGIAEVSRQIHKNPELAFELTSRWNIIGVITDGTRVLGLGNIGPEAAYPVMEGKALIFKYLGGVDAVPIPIRVKTQEEFVFVAKALEPALGGINLEDIESPKCFYLLERLREELRIPVWHDDQQGTATATLAGLINALKLVGKKISDVTIALIGAGASNIYTARILIKYGAKPGNLILVDSRGILHPERDDIDKLMIENPWKYKYAIETNAERRKGGIPEAMRGADVVIAASSPGPGVIKKEWVASMNKDAIVFALANPVPEIWPWEAKEAGAKIVATGRSDFPNQVNNSLIFPAVFRGALDVRATAITDEMLIAAAEEVAKFAEEKGIHEEYIIPKMTEWEVYVREAAAVAATASAQKVARIPRSYKEELEIAGSIIGKSIKMLEVLMMEKIIE

SEQ ID NO: 24830 - protein, 409 aa, Pyrobaculum aerophilum str. IM2
MSEQTVQVKTTGKILQSPCGPIIHGLEDVLIKSTSISDIDGEKGILWYRGYRIEELARLSTYEEVSYLILYGRLPTKRELEDYINRMKKYRELHPATVEVIRNLAKAHPMFALEAAVAAEGAYDEDNQKLIEALSVGRYKAEEKELAYRIAEKLVAKMPTIVAYHYRFSRGLEVVRPRDDLGHAANFLYMMFGREPDPLASRGIDLYLILHADHEVPASTFAAHVVASTLSDLYSSVAAAIAALKGPLHGGANEMAVRNYLEIGTPAKAKEIVEAATKPGGPKLMGVGHRVYKAYDPRAKIFKEFSRDYVAKFGDPQNLFAIASAIEQEVLSHPYFQQRKLYPNVDFWSGIAFYYMGIPYEYFTPIFAMSRVVGWVAHVLEYWENNRIFRPRACYIGPHDLQYIPLEQR

SEQ ID NO: 24831 - protein, 364 aa, Arabidopsis thaliana
  misc_feature (178)..(178): Xaa can be any naturally occurring amino acid
  unsure (1)..(364): unsure at all Xaa locations
MGKGGMSQGEGSKVEEENMAAWLVGINTLKIQPFLLPSVGPHDVRVRMKAVGICGSDVHYLKTMRCADFVVKEPMVIGHECAGIIEEVGEEVKHLVVGDRVALEPGISCWRCNLCREGRYNLCPEMKFFATPPVHGSLANQVVHPADLCFKLPENVSLEEGAMCEPLSVGVHACRRAXVGPETNVLVMGAGPIGLVTMLAARAFSVPRIVIVDVDENRLAVAKQLGADEIVQVTTNLEDVGSEVEQIQKAMGSNIDVTFDCAGFNKTMSTALAATRCGGKVCLVGMGHGIMTVPLTPAAAREVDVVGVFRYKNTWPLCLEFLTSGKIDVKPLITHRFGFSQREVEDAFETSARGSNAIKVMFNL

SEQ ID NO: 24832 - protein, 970 aa, Ustilago maydis 521
MAARTPAREAAAAKMAMPSSLLKRAALTASDETLLVSALKMLATFDNAKNTVFALVVYRYSTRLLRHVRAYGISESLYQLYCLVSAQVFALILKTPAAKRKVKRELDTAMAEVEAKIVPRPSHLGIHHQLPQLGKETEWIKTELAKLQIMEAGVDAKLVEADWENRDGQMVWKGGKVSGAVYHGGDDLSDLLADTIKQFLVSNPLHPDVFPGVRKMEAEVVSMVLKMYNAPAGAVGATSSGGTESILLSCLAMREWARATKGIKEPELIVSVSAHAAFDKAGQYFGIKVHHIPVDTVTRKVQVARVARAINSNTIGLVGSAPNFPDGIIDDIPNLAKLAKRHKILLHVDCCLGSFLVPFLEKAGFESEPFDFRIDGVTSISCDTHKYGFGPKGLSTILYRSADLRRFQYYVKTDWPGGVYATPTLSGSRPGSLIAGTWAAMMKIGESGYTQSCRDIVGAAKEISTRIEREIPELRVLGRPLVSVVAFASAAPNSVSIYDLITDLKAAVKHARSSFTGQKGSMATLYGLGSGVSATAIVGQLASSRLELQQLRLQDLVGLAQPCTLLCQGVQFLLGVHRLGVLLAEEDADFVAQGCALLHLARQLCAQVLVFELYTLQPILDVVQTCLCGLDEVDHLVPLVQELAHLHPLLLVLEHIRIPLDHFGAIALQLRVHLKQLCARLLELPSERNDACRIFLCLRLELSCLGRPRLALLSLGVLRLVRRAQRAHRVVQILSLRFQRCVGDLFAISKLSSLRSSRFSRCSNDTLVAWLPTLPSTAVRIVVSYDGMADNAVSLDASRAAVVGASAAKWLIASACRDVGDRGDVPLTVWLRDCNDDIEPDRERTRASDTCVAGDTGIEQATCEALELPIAVTIAGVAAAAALAAGSSFESVLLAAMPLAALVGIGVASSNLCAAAAMGWMAEPKSISVHVASLAASPAAPVETSGAPERNDAYVSRISSGFTERGSRCH

SEQ ID NO: 24833 - protein, 183 aa, Brassica napus
MSRNKQEEDPRINGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHVGAVEAGDRALVVDDLIATGGTLCAAINLLERVGAEVVECACVIELPELKGRQRLKGKPLCMLVEYR

SEQ ID NO: 24834 - protein, 223 aa, Neisseria meningitidis MC58
MTTQDELKRIAAEKAVEFVPENEYIGIGTGSTINFFIEALGKSGKKIKGAVSTSKKSGELLAQYDIPVVSLNEVSGLAVYIDGADEVNHALQMIKGGGGAHLNEKIVASASEKFICIADESKYVSRLGKFPLPVEVVESARSLVSRKLLAMGGQPELRIGYTTFYGNQIVDVHGLNIDQPLTMEDEINKITGVLENGIFARDAADVLILGTEEGAKVIYPCQG

SEQ ID NO: 24835 - protein, 525 aa, Erwinia carotovora subsp. atroseptica SCRI1043
MTQNIHQHRILILDFGSQYTQLVARRVRELGVYCELWAWDVTEAQIRGFNPNGIILSGGPESTTEFGSPRAPEYVFNAGVPVLGVCYGMQTMAMQLGGHVEGSNEREFGYAQVEVKTNSALVRDIQDALSATGAPLLDVWMSHGDKVTAIPEGFETVASTDTCPFAIMANEEKRFYGVQFHPEVTHTRQGQRMLERFVLDICQCEALWTPAKIIDDAVNRIREQVGNDSVILGLSGGVDSSVTAMLLHRAIGDRLTCVFVDNGLLRLNEADQVLEMFGDNFGLNIVHVAAEDRFLNELAGEDEPEAKRKIIGRVFVEVFDEEANKQAEVKWLAQGTIYPDVIESAASATGKAHVIKSHHNVGGLPKEMKLGLVEPLKELFKDEVRKIGLELGLPYNMLYRHPFPGPGLGVRVLGEVKKEYCDLLRRADAIFIEELHKADLYNKVSQAFTVFLPVRSVGVMGDGRKYDWVVALRAVETIDFMTAHWAHLPYDFLGRVSNRIINEVDGISRVVYDVSGKPPATIEWE

SEQ ID NO: 24836 - protein, 218 aa, Crocosphaera watsonii WH 8501
MSSLVSDHPSSNAIPLDKIRYNEQGLVPAIAQDYLDGTVLMLAWMNKESLQKTLETGEVWYWSRSRQELWHKGATSGHFQKVKSIRYDCDSDALLITIEQVGDIACHKGERSCFHQLEENEKAAPPADTLSGLYEVICQRRDHPVEGSYTRKLLAGGDNKILKKIGEESAEVVMACKDDEKEAIASEVADLFYHTLVALSYHHVDIKDVFRKLQERKK

SEQ ID NO: 24837 - protein, 391 aa, Solanum lycopersicum
MALSTSRAINHIMKPLSRAVCATRRLSSDSTATITVETSLPFTSHNVDPPSRSVETSPMELMTFFKDMTEMRRMEIAADSLYKAKLIRGFCHLYDGQEAVAVGMEAAITKKDCIITAYRDHCIFLGRGGTLVESFAELMGRRDGCSRGKGGSMHFYKKESGFYGGHGIVGAQVPLGIGLAFAQKYKKEDYVTFAMYGDGAANQGQLFEALNMAALWDLPAILVCENNHYGMGTAEWRAAKSPAYYKRGDYVPGLRVDGMDVFAVKQACAFAKQHALKNGPIILEMDTYRYHGHSMSDPGSTYRTRDEISGVRQERDPVERIRSLILAHNIATEAELKDIEKENRKVVDEAIRKAKESPMPDPSELFTNVYVKGFGVEAYGADRKELRATLP

SEQ ID NO: 24838 - protein, 163 aa, Gemmata sp. Wa1-1
MIVLGSIPELTPLDPKTAKPSLPQRNRAPGRARPAVRSRRHEALGSVPSDSGPLGPARCETVGKKLYVGNLGYGVTDEQLRGMFGPYGSVQTAQVIMDRDTGRSKGFGFVEMNSDQEAQAAIAGMNGQMSEGRALTVNEAKPKESRSREGRGGGSRGGSGGRY

SEQ ID NO: 24839 - protein, 340 aa, Helicobacter pylori
MADLENLDWKNLGFSYIKTDFRFIATYKNGSWSQGELVSENVLQLSEGSPVLHYGQACFEGLKAYRSQKGKALLFRPLENAKRLQTSCERLLMPKVSEELFLKACAEVVKANQKWLAPYKSGASLYLRPFVIGVGDNLGVKPANEYLFIVFCAPVGAYFKGGIEKGGARFITTIFDRAAPKGTGGVKVGGNYAASLLAHKMAIEQGYDDCIYLDPATHTKIEEVGAANFFGITHDDAFITPHSPSILPSITKKSLMVLAKEHLELKVEEREILMDELGAFKEAGACGTAAIITPIKEIAHNNKSYFFEAPGHITKRLYDLLLSIQQGEQEAPKDWIFEVG

SEQ ID NO: 24840 - protein, 454 aa, Arabidopsis thaliana
MSSSSRNLSQENPIPRPNLAKTRTSLRDVGNRRAPLGDITNQKNGSRNPSPSSTLVNCSNKIGQSKKAPKPALSRNWNLGILDSGLPPKPNAKSNIIVPYEDTELLQSDDSLLCSSPALSLDASPTQSDPSISTHDSLTNHVVDYMVESTTDDGNDDDDDEIVNIDSDLMDPQLCASFACDIYEHLRVSEVNKRPALDYMERTQSSINASMRSILIDWLVEVAEEYRLSPETLYLAVNYVDRYLTGNAINKQNLQLLGVTCMMIAAKYEEVCVPQVEDFCYITDNTYLRNELLEMESSVLNYLKFELTTPTAKCFLRRFLRAAQGRKEVPSLLSECLACYLTELSLLDYAMLRYAPSLVAASAVFLAQYTLHPSRKPWNATLEHYTSYRAKHMEACVKNLLQLCNEKLSSDVVAIRKNTSLQQRSFVPRHYRKSFSSDSVSGYVFFTLVYCTYC

SEQ ID NO: 24841 - protein, 190 aa, Medicago truncatula
MVLVLALGDMHIPHRAPDIPAKFKSMLVPGKIQHIICTGNLCIKEVHDYLKTLCPDLHITRGEYDEDSRYPETKTLTIGQFKLGLCHGHQVIPWGDLDSLAMLQRQLDVDILVTGHTHQFTAYKHEGGVVINPGSASGAYSSMTYDVNPSFVLMDIDALRVVVYVYELIDGEVKVDKIDFKKTSTSVPAL

SEQ ID NO: 24842 - protein, 120 aa, Bacillus anthracis str. A2012
MTYDYPNQPLPLPDRFRGIQKFYPEKCIVCNQCSNICPTDCIQLTGKKHPDPTKKGKIIDTYDINFEICILCDLCTEVCPTEAIVMTNNFELAEYSRDDLFKNLQWLDENDENVRKENKA

SEQ ID NO: 24843 - protein, 154 aa, Brassica napus
  misc_feature (134)..(134): Xaa can be any naturally occurring amino acid
  misc_feature (142)..(142): Xaa can be any naturally occurring amino acid
  unsure (1)..(154): unsure at all Xaa locations
MVSFPATTETISVALEANSSEAIQILYQVLEDPSSSPEALRVKEQAITNLCERLTEEKRGEDLRTLLTKLRPFFSLIPKAKTAKIVRGIIDALAKIPGTTHLQITLCKEMVAWTRAEKRTFLRQRVEARLAALXLMENKEYXEAWALLTTLVKE

SEQ ID NO: 24844 - protein, 965 aa, Ashbya gossypii ATCC 10895
MLRTFTEWSILRSNTQLGAFSCPVRRHYHLISGKSIAKTIRDNALREVKEIRQQVPDFNPKLKILQVGSRPDSSAYVRMKLKASTESGVECDVEKLPEDITQLELLRKIEKINSDAEVHGILIQLPLPKHLDEVTVTNAVDHEKDVDGFHRYNVGELAKRGGKPYFLPCTPNACIQLLKECGVEIRGKQAVVIGRSDIVGTPVATMLKNLDATVTVAHRHTTNLPQVLSTADIVVAACGVPNYIKGEWLKDGAVVIDVGINYVQDSTKKSGQRLVGDVDFESAKEKASHITPVPGGVGPMTVAMLVQNVLTAAKRSLQKDAEVPVITPLPVNFEMPVPSDIDISRKQNPKHISQVAAELGIRDHELELFGHYKAKISPKLLQRLHANQNANYVLVAGITPTPLGEGKSTTTMGLVQALSAHLGKRAIANVRQPSMGPTFGVKGGAAGGGYAQVIPMDEFNLHLTGDIHAISAANNLLAAAIDTRMFHEHTQKNDATFYNRLVPKKGGSRKFTKSMLKRLQKLGINKTDPDSLSPKEIKRFARLNIDTDTITIKRVVDVNDRLLRQITIGQAHTEKGFTRTTGFDITVASELMAILALSKDFADMRERVGRMVVAANLDGEPITAEDVGCAGAVAALLKDAIKPTLMQSLEGTPVLVHAGPFANISIGASSVIADRIALKLVGTSPHSPEGTDAGYVVTEAGFDFTMGGERFLNIKCRSSGLKPNTIVIVATVRALKLHGGGPEVKPGQPLTPHYTEENLELVTRGAANLQKQIRNAKLFGVPVVVAVNRFESDTDAEIEIIQKAAKEAGAHDAIAANHWAEGGKGAVTLAEAVINSCKQPSSFKFLYDVDQPVTEKLSTIVRKMYGGSAIDLSPTAQKKIALYTAQGFDKLPICIAKTQYSLSHDATLKNVPSDFVFPIRDIRASIGAGYLYALAAEIQTIPGLSTNAGYMNVEVSDDGEIEGLF

SEQ ID NO: 24845 - protein, 256 aa, Rhizobium leguminosarum bv. viciae 3841
MTPDVRPLVAGNWKMNGMRASLDQIKTIAEGVRPPLADKVEALICPPATLLYVATALCTDSPLAIGAQDCHQNPSGAHTGDISAEMIADCFGTYVIVGHSERRTDHAETDHLVRAKAEAAFAAGLTAIICIGETADERRTGQALDVIKRQLSASVPDCATAESTVIAYEPIWAIGTGVTPTSGDVEKAHAFMRAELAVRFGDEGRKMRLLYGGSVKPANAHELMGIANVDGALIGGASLKAADFLAIYRAYEALLA

SEQ ID NO: 24846 - protein, 220 aa, Triticum aestivum
MDSSSSSTASSSQAQAQPDFDYLFKLLLIGDSGVGKSSLLLRFTSDSFEDLSPTIGVDFKVKMVNIAGKKLKLAVWDTAGQERFRTLTSSYYTRAQGIIMGMYDVTRRETFTNLSDIWAKEIDLYSTNQDCIKMLVGNKVDKESERAVTKKEGIDFAREYGCLFLECSAKTKVNVEQCFEELVLKILDTPSLLADASSGAKKNIFKQKAPEADAAASGCC

SEQ ID NO: 24847 - protein, 182 aa, Vitis riparia
GEGGFGNVYKGYIDGGETIVAIKRLKSKSKQGAHEFLTEIEMLSKLRHRHLVPLIGYCEEEGEMILVYDYMHHGTLRNHLYGADNDPLPWKQRLETCIGAARGLDYLHAGAQHPIIHRDIKSTNILLDYKWVAKVSDFGLSKMRPSDDPVTTVVKGTFGYMDPEYYKWMKLTQKSDVYSFGV

SEQ ID NO: 24848 - protein, 745 aa, Saccharum hybrid cultivar
MSGAALVAIVASIGNLLQGWDNATISAALLYIKKEFKLESEPTVEGLIVAMSLIGATIITTFSGPVSDWIGRLPMLILSSVLYFVSSLIMLWSPNVYVLLLARLINGFGVGLAVTLVPLYISETAPPEIRGLLNTLPQFSGSGGMFLSYCMVFGMSLLPSPDWRIMLGVLALPSLFFFGLTIFYLPESPRWLVSKGRMAEAKKVLQRLRGKDDVTGEMALLVEGLEVGGDTFIEEYIIGPAIEPADDHVADGDRERIILFGPEEGQSWIARPSKGSSMLGSVLSIGSRHGSMVNQNLPLTDPIVTLFGSVHENISLAGGSMRRIVPSKFDSMISITDQHPKTEQWDEENLHRDNEEYATDGAASDYENNVHSPLLSRQNTSAEGKGIAHHGHRGSALGLRRRSLSDEGGEAATSTGIGGGWQLAWKWSEREGEDGKKEGSFKRIYLHQEGVAGSRRGSVVSLPGGGDASEGGKFIHAAALVSQSALYPRDITEQRMAGPATMHPSEAAAKVPSWRDLFEPGVRRALLVGIGIQILQQFAGINGVLYYTPQIMEQAGVAVLISNLGLSSASASILISSVTALLMLPSIGLAMRLMDVSGRRFLLLSTIPVLIASLIVLVVSNVIELGTVVHAVLSTISVITYLCCFKMGFGPIPNILCAEFFPTRVRGICIAICALIFWVGDIIVTYSLPVMLNAIGLEGVFGIYAVACAIAFVFVYLKVPETKGMPLEVITEFFAVGAKQAVAKA

SEQ ID NO: 24849 - protein, 326 aa, Archaeoglobus fulgidus DSM 4304
MKKIVVIPGDGIGKEVMEAAMLILEKLDLPFEYSYYDAGDEALEKYGKALPDETLEACRKSDAVLFGAAGETAADVIVRLRRELGTFANVRPAKAIEGIECLYPGLDIVVVRENTECLYMGFEFGFGDVTEAIRVITREASERIARYAFELAKREGRKKVTALHKANVMKKTCGLFRDVCREVAKDYPEIQYNDYYIDAACMYLVMDPFRFDVIVTTNMFGDIVSDLAAGLVGGLGLAPSANVGERTAIFEPVHGAAFDIAGKGIANPTAMILTACMMLRHFGYVEEAKKVEEAVEKTIKEGKKTPDLGGNLKTMEFANEVASLLD

SEQ ID NO: 24850 - protein, 320 aa, Solanum virginianum
  misc_feature (135)..(135): Xaa can be any naturally occurring amino acid
  unsure (1)..(320): unsure at all Xaa locations
MGSKNSKAKTSVDDTSNSSYQIRVESFRVPFVALQEATNNFDENWVIGMGGFGKVYRGVLCDGTKVALKRCTPGSSQGIKEFLIEIEMLSRHRHPYLVSLIGYCDERNEKILVYEYMENGNLRRHLYGSDLPTLXWEQRLEICIGAARGLQYLHNSAVIHGDVKSTNILLDDHFVAKITDFGLSKTQTELDQTHFTTVVKGTFGYLDPEYIMRGKLAEKSDVYSFGVVLFEVLCARPALDRSLSSEMFSLVRWAMESHKNGQLERIIDPNLVGKIRLDSLRKFGETAVKCLAESGLDRPSMSEVLWNLEYALHLQEPVIQ

SEQ ID NO: 24851 - protein, 305 aa, Brucella suis 1330
MGGFASIGECMIELSGNEGDQWRMGFAGDTLNTAWYMRALTDKSYPVEYVTAFGEDSFSQKQRVFLTSNGIGIAHSPVISGLHPGLYAITLDGAERSFTYWRSNAAARRLACDRDALEKSLAGRDMIYLSGITLAIILPEHRATFFDILHQCRAAGSRIAFDPNFRQQLWPDRKAAREIISNAMGIADIALPTFPDEQALFGDRDAAACAKRIAALGVGEIVVKDGTEPALVAAGGECTLVPSAAAQAIDTTGAGDSFNGAYLAARLNGLAPVEAARKAHLVAARVVEIRGALAPMETARATFAG

SEQ ID NO: 24852 - protein, 422 aa, Zea mays
MAVEYHCCSAAFFEHIVIIIVLVLFAGLMSGLTLGLMSLSLVDLEVLAKSGTEQDRKHAAKILPVVKNQHLLLCTLLICNAAAMEALPIFLDSLVTAWGAILISVTLILLFGEILPQSICSHYGLAIGASVAPLVRVLVWVCFPIAYPISKLLDYVLGHGQTALFRRAELKTLVTLHGNEAGKGGELTHDETTIIAGALELTEKKAKDAMTPLCQTFAIDINAKLDRNLMQEVLEKGHSRVPVYYEKKTNIIGLILVKNLLSVSADDEVPIKSVTIRKIPRVLEEMPLYDILNEFQKGHSHMAVVIRKNNPSYQPAEQAANDGGTFEVSIAIDDKNNEKVVKNLPPPLQRWKSYPNTQNTSNRGNRPKKWSKDQADVLQVHKEPLPTLSEDEEAVGIITMEDVIEELLQEEIYDETDVHEEQ

SEQ ID NO: 24853 - protein, 318 aa, Zea mays
MDEKATMESKLSSAAAFVEGGVQDACDDACSICLDAFCDSNPSTMTKCKHDYHLQCILEWCQRSSQCPMCWQHISMKDPMSQELLEAVEQERNIRANPSRNTAVFHHQMLGDFEIPVGADDAELEERIIQHLAAAAAVRRSHRHHNRRDGHQSRSEASSHPQFLVLSADERTISGQEGDYEQASAVASGRPLRTLVEQERTRGLADASSPSLRCSTPADSTGRSNNRISGIESTPVDQDGTGPSALQSMVQGFHNQSASGWRERWFSRSNSLLDLGSEVRREVNAGIAAVSRMMEWHDARDGTGAGPSPTSASRSGSQ

SEQ ID NO: 24854 - protein, 438 aa, Coccidioides posadasii
MAITKIHARSVYDSRGNPTVEVDVVTETGLHRAIVPSGASTGQHEACELRDGDKTHWLGKGVLKAVKNVNEVIGPAVIKENIDVKDQSKVDEFLNKLDGTANKSNLGANAILGVSLAIAKAGAAEKGVPLYAHVSDLAGTKKPYVLPVPFQNVLNGGSHAGGRLAFQEFMIVPSAAPSFSEALRQGSEVYHKLKALAKSKYGQSAGNVGDEGGVAPDIQTPEEALDLIAEAIEQAGYTGKVKIALDVASSEFYKPEEKKYDLDFKNPNSDKSKWVTYEELSDLYKKLASKYDIVSIEDPFAEDDWEAWSYFFKTSNMQIVADDLTVTNPIRIKKAIDLKACNALLLKVNQIGTLTESIQAAKDSYADGWGVMVSHRSGETEDVTIADIVVGLRSGQIKTGAPARSERLAKLNQILRIEEELGSSAVYAGENFRTAVNL

SEQ ID NO: 24855 - protein, 142 aa, Erwinia carotovora subsp. atroseptica SCRI1043
MTIERTFSIVKPNAVAKNAIGAIYARFESAGFTIVASKMLRLSREQAEGFYAEHKGKPFFDGLVEFMMSGPIMVQALEGENAVQRNRDIMGATNPANALAGTLRADYADSFTANAVHGSDSIESAQREIAYFFSDDEICPRA

SEQ ID NO: 24856 - protein, 179 aa, Zea mays
KTAFPGLGSPIPHVDVTYDGKWILGTTDTYLILICTIFIDKDGKEKTGFSGRMGNRIAAPRLLKLNPLDSHLAGANSRFREGRFSWVTENGKQERHLVATVGKYSVVWNFLQVKNSHPECYQYQEGLKTCYCYKVIPKDESIVASRFMHDRYSVSDSPEAPLVVATPMMVTSFSISSGH

SEQ ID NO: 24857 - protein, 414 aa, Burkholderia sp. 383
MTRPTHDLVVFGATSFVGQILARYLSEYLSGSGETLRWAIAGRSEAKLRQVRDTLGAAGQSVPIIVADAADEAQLRALCAQTRVVVSTVGPYALYGEPLVRICAETGTDYCDLTGETQWIKRMIDKYEPAARQSGARIVHCCGFDSVPSDMGVFFLQQQARQQWGVPATQVKMRVKTLKGGASGGTVASVINVVREAAADPALRRELLDPYSLCPKGHGFTMRQHAVRSAAFDRDFDAWIAPFVMAAVNERVVHRSNALAGNAYGSRFTYDEAVMTGTGFKGRLTAVTMVAGLGAFMVGVVIKPVRSLMERFLLPKPGEGPSPAAQLAGRYDLRFFGRTDDGKTLRVKVTGDRDPGYGSTGKMLGQAAISLALDCVGDGVKTGRGGGFWTPATMFDARYIERLVRHAGLRFEVI

SEQ ID NO: 24858 - protein, 792 aa, Zea mays
MATPSHLLLVVFTALLALLPGTTQLQPSQVWTLIKIQQLLNAPPMLSHWRRSTDFCGGGGGAMGPAGSAAVLCYGDTVTQLHIAGAGAPPLPRNFSIGAVVTTLSRLPDLKVLTLSGLGLWGPLPGKLGRLASLEIVNMSGNYLFGEVPRGVSRLAGLQTLVLDDNMLGGEVPAWIGALPSLAVLSLRNNTFQGAVPESLGSAPSLRSLVLASNNLSGNLPDMSRQANLQVLDVGGNSLGPAFPKLGRKVVTVVLGRNRFGGGLPAELSSFYLLERLDVSWNRFVGPFAPALLSLPSIRYLNIAGNRFTGTLSDKAPCGDNLRFVDLSLNLLMGSVPTCLRSPGRKPDTVVLVSTNCLDDSDGSQHPSPFCQNQALAVGIVPGKERKSVAGQAGFVAGVVVAILVAISAVGLIAFFAVRKAAMKRWEARAPTVSEEESSSTGYPSKMLADARYISQTLKLGALGIPSYRAFSLVELEAATNNFENSHLLGQDSHGEMYRGRLGNGTPVTIRTLKMKRSQTAQSFNRHIETISRLRHQNLVSALGHCFEYNLDESTVTQLYIVFEYVQNGNLRSRISQGTEGCRLTWSQRISAAIGVAKGIQFLHGGIIPGLVGNDLRITNVLVDQNHVAKIGSYNIPILAEAMRSEQGGGGNKLQADSRVKSDKTDIFDFGVILLEVVSGKTITSMYEVEILKELLAWAIADEDRVRRRSFADPAVSKGCSDESLRTVMEICQRCLAKEASQRPSVEDVLWNLQFAAQVQDDWETDAWSSGGGSPVSSSSRPTRPSRLHLSR

SEQ ID NO: 24859 - protein, 412 aa, Oryza sativa (indica cultivar-group)
MEAKLSAASRRVAPSPIQQLSHLAQRAGAVNLAEGFPDFPAPAHVKAAAAAAIAADLNQYRHVQGICDALAETMKRDHGLRVDPLTDFAVCCGQSEAFAAAIFAIIDQGDEVLLFDPAFETYQTCIELARGVPVYVPLDPPSWTLNEDKILKSFTNRTKAVVLNSPHNPTGKVFSREELLIIAQACQKMDCFAITDEVYEYITYDENKHISLASLPGMQERTIITSSLSKTYSVTGWRIGWACAPANIASAIRNIHVKLTDSAPAPFQEAALVALTSPPDFYSSLKQDYTARRDFILQVLTDFGFRISFKPQGSIFVFVELPRSWQLSDMDFVTNLIKNAGVAAVPGRGFFHSSTDDPSYHHRYVRFAFCKSNDTLNAAAEKMRKLAVSHDARLLRPTDDGEAGQTASATSP

SEQ ID NO: 24860 - protein, 55 aa, Brassica napus
  misc_feature (20)..(22): Xaa can be any naturally occurring amino acid
  unsure (1)..(55): unsure at all Xaa locations
MDLDDFRTVMDNAGVYVWTXXXTAILVASLDYGHELKQRRDNIVERLYATFIANK

SEQ ID NO: 24861 - protein, 504 aa, Ashbya gossypii ATCC 10895
MGTSSAVLAPQAQRPRKNTLSSKLGKLFGGPRGARDVGSSPVTLCGTPSPAASGASMGAPTRPLSPPSSAGARDDGQSVRSAGSRGSEGTRESGGSGRTSPAASRASPTAAAQASGRFVVHEDGTHEHSLKNAKRQEKLSSMIRNMLGAQKLRGEAKSAVPEILLGAKKPGAAEGDLPTLFSGLFSQTAQDSDGLRTPHRPTPDPDAPAAGKDYLSFAEKYGRCQEVIGKGAFGVVRICHKKDANGTEALYAVKEFKKRPSEDQEKYSRRLTSEFCLSSSLKHTNIINTLDLFQDAKGDYCEVMEYCSGGDLFSLIVTAGKLEYMEADCFFKQMIRGVVYMHDMGVCHRDLKPENLILTANGVLKITDFGNGECFRMAWEKDIHLSGGVCGSSPYIAPEEYSMEEFDPRPVDIWACGTIYMAMRTGRQLWRTAQKEDEFYARYLRGRKDEAGYEPIEQLKRARCRNVIYSILDPVPSRRINGKQILNSEWGREIKCCVDSHPLH

SEQ ID NO: 24862 - protein, 276 aa, Pyrus pyrifolia
WRTDEEFARELLAGVNPVTIRRLQEFPPSSELDREAYGDQTSQITKEHIEHNLNGLTIDEAIMSNKLFILDHHDAWMPYLRRINTTSTKAYASRTLLFLNNDGTLKPIDIELSLPHPDGDQFGCISKVYTPSSQGVESSIWQLAKGYALVNDSGCHQLFSHWLRAHAVTEPFVIAANRQLSVLHPIHKLLHPHFRGTMNANASARQVLTNAGGVIEEIIFASKFSMEWSSAMYKDWTFPDQALPADLIKRGVAVEDSSVSHGARLLIEDYPYAVDG

SEQ ID NO: 24863 - protein, 453 aa, Mesoplasma florum L1
MSRIEKIIAREVLDSRGTPTVEVELWTEFGGYGIAKAPSGASTGENEALELRDGDKARYNGKGVLKAVANVNDKIAPALIGHDVQDQLGLDRVMIKLDGTEFKKKLGANGMLAVSLAAAHAAASELEVPLYRYIGGVQAKRLPVPMLNVINGGEHADSAIDFQEFMIMPVGAPTFKEALRWSSETFQALKSLLHDKGDITAVGDEGGFAPHFSWAYAKQDLASFKAKTPAEIALDLLVEAITKAGYKVGKDGIMIAMDCASSELYFEDKKYHFKKIEKVTGQEWAFTTEEMIAYLEKLVNNYPIISIEDGLSEKDWDGFVQLTEKIGDRVQIVGDDLFTTNPRFIKEGISKDAANSTLIKLNQIGTLSETVEAITMTQKAGWTAVVSHRSGETEDATIADLAVAFNAGQIKTGSMSRSDRIAKYNRLLQIEDQLGEDAIYDGYATFYNLKINK

SEQ ID NO: 24864 - protein, 224 aa, Arabidopsis thaliana
MAGGGGYGGASGKVDYVFKVVLIGDSAVGKSQLLARFARDEFSMDSKATIGVEFQTRTLSIEQKSIKAQIWDTAGQERYRAVTSAYYRGAVGAMLVYDMTKRETFEHIPRWLEELRAHADKNIVIILIGNKSDLEDQRAVPTEDAKEFAEKEGLFFLETSALNATNVENSFNTLMTQIYNTVNKKNLASECDSNNPGSLAGKKILIPGSGQEIPAKTSTCCTSS

SEQ ID NO: 24865 - protein, 276 aa, Pyrus pyrifolia
WRTDEEFAREMLAGVNPVNIARLQVFPPASKLDPKVYGDQNSTITEEHIKNNLDGLTVDEALKKNKLFILDHHDSLMPYLRRINSTSNRIYGSRTLLFLQNDGTLKPLVIELSLPHPDGDQFGCISNVYTPAEQGVEGSIWQLAKAYVAVNDSGVHQLISHWLNTHAVSEPVVIATNRQLSVVHPIYKLLHPHFRDTMNINAFARQILINAGGILETTVFPARYAMELSSVVYKDWNFTEQALPADLIKRGVAVKDKNSPHGLHLLIEDYPYAVDG

SEQ ID NO: 24866 - protein, 276 aa, Pyrus pyrifolia
WRTDEEFAREMLAGINPVTIRRLKEFPPASKLDRKAFGDQTSLITKENIAHNLKGLRIDQAIDENRLFILDHHDSIMPYLRRINTTSTKAYASRTLLFLQDDGTLKPLAIELSLPHPNGDQFGCTGKVYTPSSQGIKSSIWQLAKAYVAVNDTGYHQLISHWLRTHAVMEPFIIATNRQLSVLHPIYKLLHPHFRDNMNVNALARQVLINAFGILETTVFPAKFSMEWSSAMYKNWVFPDQALPADLIKRGMAVEDSSSSHGVRLLIEDYPYAVDG

SEQ ID NO: 24867 - protein, 474 aa, Coccidioides posadasii
MASTLRLGSAALRSTSIAQKPVVQSAAFNCLRYYSSAKTKSLKDTFADKLPGEVEKVKKLRKEFGSKVIGEVTLDQVYGGARGVKSLVWEGSVLDSEEGIRFRGYTIPECQKLLPKAPGGEEPLPEGLFWLLLTGEIPSEQQVRALSAEWAARSDVPKFVEELLDRCPSTLHPMAQFSLAVTALEHESSFAKAYAKGINKKDYWQYTFEDSMDLIAKLPTIASKIYRNVFKDGKVAPIQKDKDYGFNLANQLGYGENKDFVELMRLYLTIHSDHEGGNVSAHTTHLVGSALSSPMLSLAAGLNGLAGPLHGLANQEVLVWLQKMKKAIGNDLSDQAIKDYLWSTLNAGQVVPGYGHAVLRKTDPRYVSQREFALRKLPDDPMFKLVSQVYKIAPGVLTEHGKTKNPYPNVDAHSGVLLQYYGLTEASYYTVLFGVSRALGVLPQLIIDRALGAPIERPKSFSTEAYAKLVGAKL

SEQ ID NO: 24868 - protein, 130 aa, Haemophilus influenzae Rd KW20
MMTQIIHTEKAPAAIGPYVQAVDLGNLVLTSGQIPVNPATGEVPADIVAQARQSLENVKAIIEKAGLTAADIVKTTVFVKDLNDFAAVNAEYERFFKENNHPNFPARSCVEVARLPKDVGLEIEAIAVRK

SEQ ID NO: 24869 - protein, 211 aa, Dechloromonas aromatica RCB
MQKVIEGFLKFQKDVFPERTQLFKQLAQQQNPKVLFVTCSDSRVVPELFTQQEPGDLFVIRNAGNIVPSYGPEPGGVSATVEYAVSVLQVSDIVICGHSNCGAMAAISSCQCLDHLPAVAHWLRHADSAKAIVASETYATQQEKADALVRQNVIAQLANIRTHPSVALALAQRRLNLHGWVYDIENGVIDALDGASASFVPLSANHQVVAT

SEQ ID NO: 24870 - protein, 149 aa, Acidovorax sp. JS42
MGNKLYVGNLPYSVRDQDLEQAFSQFGAVTSAKVMMERDTGRSKGFGFVEMGSDAEAQEAINGMNGQSLGGRSIVVNEARPMEARPPRSGGGGFGGGGGYGGGRSGGGGGYGGGGGGRSEGGFRSPYGSGPRGGGGGRGGYGGGGNNGY

SEQ ID NO: 24871 - protein, 433 aa, Synechococcus elongatus PCC 6301
MVTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVIDAVPSIEMVRFVNSGTEACMAVLRLMRAYTGRDKIIKFEGCYHGHADMFLVKAGSGVATLGLPDSPGVPKSTTANTLTAPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPATYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 24872 - protein, 468 aa, Novosphingobium aromaticivorans DSM 12444
MSQQPQPGGNLGFIGLIVAVATIGGFMFGYDSGAINGTQDGLKHAFGLGEAELGLTVSALLPGCALGAFLAGRFADIWGRRAVMMMAAALFILSALGSGAAPSAIVLAVARFFAGAAVGAASVLSPAYISEVTPAHVRGRLSSAQQVMIISGLTGAFLANYWLAGAAGSSLGAFWCGYPAWRWMFWVQAAPAILFLVTLLLIPESPRFLVAKGRTEEARSVLARLFGDATADAKLGEIRASLAADHQPSLADIRKPGGGWRPIVWVGIGLAVFQQLVGINVVFYYGAVLWQAVGFSEADALKINILSGVVSIAACLVSIGLVDKLGRKPLLLIGSAGMTATLGALAWCFAQASTGPDGALVLPEGVGTIALYAANIYVVFFNMSWGPVMWVMLGEMFPNQMRGSALAVAGAAQWLANFAVSSSFPWLAGNIGLPVTYAAYTLFAAISLVFVWTSVKETKGKELEAMEG

SEQ ID NO: 24873 - protein, 215 aa, Triticum aestivum
  misc_feature (161)..(161): Xaa can be any naturally occurring amino acid
  unsure (1)..(215): unsure at all Xaa locations
NKFVQKSRLVPVRNSRDIVDPRVRVERIGYTRERIAESIDRWLWCGSQVSRLFRIDELRLTDAEKSRIYHFYIPVFLWCEDQVADHRSKYNDGDEIPPLVIGVSAPQGSGKTTLVFALDYLFRVSGRNSATLSIDDFYLTAAEQGKLRETHAGNALLEFRXNAGSHDLQFSIDTLESLIQLTKEGTGCEQVSASCPNPLCFYFMICAVYFLYSLD

SEQ ID NO: 24874 - protein, 396 aa, Rhodopirellula baltica SH 1
MCHPREAFVYRDAFGGLRESFFLSTFDTICCGMIGETAGADRVNSLCRELIPGFMMTTEAATIPVRPSQANLEADVLSPIQPDTPTSSYPDAGASSYSDPTKRSIRWDYTIFFVSLHLLTLLVLLPYFFSWAGVAAFVVGVIVFGQMAIPIGYHRMLSHRSFRSPKWFERTLVTLAMCTAQETPAHWVAWHRMHHSHSDHAEDPHSPRISFMWAHVRWLVHESRTRMATFSMYEKYARDILSDPYYRWIEKLPSPAGMFYLAHAFVYALLAVGISGLVYGNNADAYQMAASVFVWGVIARTVWVWHITWSVNSITHVFGYRNYQTTDDSRNNWFVSLLTAGEGWHNNHHADPASASVQHRWWEIDPNYYVIRLFGVLGLATHIIRPRHVRKSGAES

SEQ ID NO: 24875 - protein, 470 aa, Medicago truncatula
MHYFFTLFTFFIFLTFIALTNAGNIGINYGRIANNLPSATKVVQLLKSQGITHVKIYDTDPSVLRALSGSKIKLTVDLPNQQLFAAAKSQSFALSWVERNIVAYQPNTIIEAIAVGNEVFVDPNNSTKYLVPAMKNIYRSLQKHNLHNDIKVSSPIALSALGNSYPSSSGSFRPELIQPVFKPMLDFLRETGSYLMVNVYPFFAYESNADVISLDYALFRENPGQVDAGNGLRYLNLFDAQIDAVFAALSRLKYDDINVVVSETGWPSKGDGNEVGASVENAAAYNANLVRKILTSKGTPLRPKADLTVFLFALFNENQKPGPTSERNFGLFYPDEKKVYNVPLTVEALKNYHDDPSPASPVSGGGGSGGGGVSKSTTGNTWCVANPYADKNKLQDALDFACGEGGADCRPIQNNATCFDPNTLVAHASFAFNSYYQKQARAGGSCYFGGTSYVVTQEPKYGKCEFPTGY

SEQ ID NO: 24876 - protein, 150 aa, Rhizobium leguminosarum bv. viciae 3841
MSQLIFNQPSEDKSALEDAGDFTPRFDDRGLITAIVTDAGDGELLMVAHMNAQALALTIQTGTAHYFSRSRGKLWKKGETSGNLQTVKEIRTDCDQDAIWLKVEVAGHDATCHTGRRSCFYRTITLQDGKPMLDIVDDELHFDPQDVYGK

SEQ ID NO: 24877 - protein, 273 aa, Oryza sativa
  misc_feature (104)..(104): Xaa can be any naturally occurring amino acid
  misc_feature (121)..(121): Xaa can be any naturally occurring amino acid
  unsure (1)..(273): unsure at all Xaa locations
MRKSSINGVHVIGVPVTAKAFGIEEEVSLARGQSFRKADGDHLAVSLSHPSPYTSFGYKHSSKGQVIHWVSKLSRRAQGFREHGELAFMHACLIRHKKKLVDHXDLSDERRVLIYIHHRVXRAVTLGPKLSETVKGKLSLGAKILQAGGIERVFRKAFSAEKGERLVKALQCYLYTTGGPIAGMLFVSTKKVAFRSDRPVTVTSAKGDVARVPYKVVVPLRRIAQVRPSENADKPEEKYIHVVTVDGFEFWFMGFVSYQRSCKYMQQAISELQ

SEQ ID NO: 24878 - protein, 272 aa, Oryza sativa (japonica cultivar-group)
MATARAVRLIASRPPSTNLRSLVVVPGRRRLLSTSTEAGGAGDPSVHSGDPPSDDYPDRPPKFSGAEEATGGGDHGKNPSTAAATPSESTKERVPPFAMSDKLGSQELADPAGGSSFTQKRRRSSSSRPADSREEATPGGEEAAGRKVREEDREYYQTHKPSPLAELEFADTRKPITRATDGGSAADRLSDVPGKVAEDTADDSLARAEAMFREVTPSGRTRARSRRCWRGAAAKETLRGAGAVRLGEASQASADPRECRRAVVAWGVCKKK

SEQ ID NO: 24879 - protein, 513 aa, Coccidioides posadasii
MFRPIVPRLAGRSLPKATPQTAFQHSFPVSTVYILGRSKRGYATQSDEHDLVIIGGGVAGYVAAIKAGQEGLKTACIEKRGALGGTCLNVGCIPSKSLLNNSHLYHQVLHDTKKRGIEVGDVKLNLKQMMKAKDTSVESLTKGIEFLFKKNKVEYVKGTGSFIDQHSVKVDLLEGGERTLRAKNIIIATGSEATPFPGLTIDEKRIITSTGALSLEEVPKKMVVIGGGIIGLEMASVWSRLGSEVTVVEFLGQIGGPGMDAEIAKQIQKILSRQGLKFMVGTKVTKGDASGESIKLEVEAAKGGKEQTLDADVVLVAIGRRPYTQGLGLEKVGLDVDEKGRVIIDQQYRTKEQHIRVIGDCTFGPMLAHKAEEEAVAAIEYIKKGHGHVNYSAIPSVMYTHPEVAWVGQNEADLKAAGIKYRVGTFPFSANSRAKTNLDSEGQVKFLADEQTDRVLGVHIVGPNAGEMIAEATLAVEYGASCEDIARTCHAHPTLAEAFKEAAMATYAKAIHF

SEQ ID NO: 24880 - protein, 415 aa, Haemophilus influenzae Rd KW20
MNFFQYKHNKLYAEDMPVQQLAEQFGTPLYVYSRATLERHWHAFDSAFGNRPHLICFAVKSCSNIGVLNIMAKLGSGFDIVSQGELERVLAAGGDASKVVFSGVAKSREEIMRALEVRIRCFNVESVSELKHINQIAGEMGKIAPISLRVNPDVDAHTHPYISTGLKENKFGVSVNEAREVYKLASTLPNIKITGMDCHIGSQLTELQPFLDATDRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIVEIDRTLEREKAIYDVVGPVCETSDFLGKQRELSIAEGDYIAQCSAGAYGASMSSNYNSRARTAEVLVDGDQSYLIRRRETLQELWALESTI

SEQ ID NO: 24881 - protein, 456 aa, Mycoplasma pneumoniae M129 [sequence omitted]

SEQ ID NO: 24882 - protein, 333 aa, Acidovorax sp. JS42
MPVAPAASSSFNAEQALRLGRETVRTEAEALHAMGERLGGGFVQVVQRVLATTGRVVVMGMGKSGHVGRKIAATLASTGTPAFFVHPAEASHGDLGMVTNGDLVLALSNSGESSEITVLLPVLKRLGVPLIAMTGGLQSTLARHADLVLDCSVQREACPLNLAPTTSTTAQLAMGDALAVALLDARGFRPEDFARSHPGGALGRKLLTHVRDVMRAGADVPHVPPHANFSTLMREMSAKGVGATAVVDDAGRPVGIFTDGDLRRRIEAGLDLRETRAQDVMHASPRTIAADALAADAAQAMEHHSITSVLVTDDDGVLVGVVHIGDLMRAKVI

SEQ ID NO: 24883 - protein, 895 aa, Xanthomonas campestris pv. vesicatoria str. 85-10
MNWLNEVLHNDPNPLETQEWLESIKAVIDVEGPERAHQLLEGMVEQTRRAGAYLPFSPTTEYVNTISPANEAKHPGDSALEWKIRSIIRWNAMATVVRANRKPGDLGGHIASFASSATLYDVGFNHFWRAPSDNHPGDLLFIQGHSAPGIYARAFLEGRISQSQLDNFRMEVDGQGISSYPHPWLMPEFWQTPTVSMGLGPLAAIYQAQFMRYLENRGLIEKSDRKVWCFIGDGESDEPETLGAIALAGREGLDNLIFVVNCNLQRLDGPVRGNGKIIQELEGVFRGGGWKVIKLLWGGYWDALLAKDSDGVLRKLMMETVDGEYQNCKAFGGAYTRANFFGKYPETAAMVAGLSDDDIWRLNRGGHDPHKVYAAYHQAVNTTGMPTVILAKTVKGYGMGSAGEALNPTHQTKKLDDAAVKHFRDRFNIPVSDKQLEDGQVPFFHPGEDSPEVQYLKERRSALGGYLPQRRTKASKSFVAPTLDKFDRLLKESGERTYSTTMSFVQSLNIALRDKELGPRIVPIVADEARTFGMEGMFRQIGIYAPFGQKYKPVDADQLMYYREDQTGQVLQQGISEPGAIASWMAAGTSYSVSNVPMLPFYIYYSMFGFQRVGDIAWQAADMRTRGFLLGGTAGRTTLNGEGLQHEDGFSQLVAGGIPNVRSYDPTFGYEVTVIMQHGMKAMMEDQIDEYYYITLMNENYVHPGMPDGAAEGIIKGMYLLTDAGKPKKGELRVQLLGSGTILREAIAAAELLDKDFGVTADIWSCPSFNELRRDGFDAERWNRLHPEGQQRKPYVTQLLEGRQGPAIAATDYVRLFADQIRSFVPMTYSVLGTDGFGRSDTRANLRRFFEVDRYYIAHAAIAALAKDGKMTGKDVARAIKQYKIDPEKANPVGV

SEQ ID NO: 24884 - protein, 184 aa, Acidovorax sp. JS42
MTALSVNDYLRQHIRTVPDWPAPGVQFRDITPLLQNPKVFRVLIDAFVHRYMDRALRPDVVAGLDARGFILGAVVAYELNVGFVPIRKKGKLPFTTVEETYELEYGSATVELHADAVQPGDRVLLIDDLIATGGTMMAGKKLLEKLGATVMEGAAIVDLPELGGSERLRASGLPLYTLVDFSGH

SEQ ID NO: 24885 - protein, 144 aa, Rhizobium leguminosarum bv. viciae 3841
MTSSVKAILDLKGRDVVTAGPNTTVAEAAAILSKKKIGAIVVVGMENRISGMFTERDLVHAIAKHGKEGLDHSLAQVMTAKVYRCHEETTVNELMELMTSRRFRHVPVESNGKLAGIISIGDVVKSRIAEVEREAEEIKAYIAG

SEQ ID NO: 24886 - protein, 115 aa, Bacillus cereus
  misc_feature (1)..(1): Xaa can be any naturally occurring amino acid
  misc_feature (63)..(63): Xaa can be any naturally occurring amino acid
  misc_feature (85)..(85): Xaa can be any naturally occurring amino acid
  unsure (1)..(115): unsure at all Xaa locations
XENAFKLLYKTIEERKGSPLPESYTNYLFSKGEDKILKKIGEECAEVIIACKNNDKEEVVKEXVDVFYHCFVLLAEKNIALEDVXREVKERNGKLSRVGDRREIDTLLEHHHHHH

SEQ ID NO: 24887 - protein, 391 aa, Myxococcus xanthus DK 1622
MADDYYQTLGVDRSASAEDVKKAYRKLARKYHPDVNPGNKAAEEKFKQVSAAFEVLSDTRKRKLYDEFGPDAEKIGFDEKKAEAYRAYKASAGSAGAGGIPYGAEGFDLGDLFGDLFGGRGGGAAGGAPGGFDIGEMFGRRGRNAGPERGEDLTVRVQLTLAEAVSGTERPLAFNRPGRCSTCSGRGTSGPVSTCNVCNGTGRARRSGSLFGGAGACPNCHGTGKAAPPCPQCGGAGVKEELARLTVKIPAGVHTGSKVRLSGQGAAGTRGGPPGDLYIETEVAEHPLVRREGDDLHLDLPVTVSEALLGADVRVPTFQGEVTVKVLPHSQSGRRMRLKGRGVPSLKGGAQGDLYLHLQVKVPEETTAEARAAAEALARAYQGDVRRELTL

SEQ ID NO: 24888 - protein, 462 aa, Mesorhizobium loti MAFF303099
MVVSVAGPRRAGSGDQDHRDGGEFVAGLAARKAAARLLAAVIDARTPLDGLTDHENGHPQYKALDLRDRGLVRAILVTALRFRMTITGLLARRLEKPLPPNATALSHILHVAAAQILFLDIPDSAAVDLAVTHAKSDPRTQRFSGLVNGVLRTLARAKETELPAALAATDEAPKWFSDRLKAAYGEDKAKQILAAHRYEAPVDFSVRADPELWAEKLGGIVLPTGTVRVENLAGAVTDLPGFAEGAWWVQDAAASLPARLFGDVGGLRVADLCAAPGGKTAQLILAGAKVTAVDTSKNRLARLAQNLDRLGLSAEIVQADLLKYEPAELFDAVLLDAPCSSTGTVRRHPDVPWTKTAADVEKLADLQRRLLARAVTLVRPGGRIVFSNCSLDPLEGEELHLAFLKETPVVVDDPLRQGEIAGIDPFLTAQGTLRTTPADLDLGAPERSGLDGFFAARMRRAL

SEQ ID NO: 24889 - protein, 192 aa, Oryza sativa
  misc_feature (19)..(19): Xaa can be any naturally occurring amino acid
  unsure (1)..(192): unsure at all Xaa locations
MESNGKAVTRSGDYVKYTXGAVFWGEPGTNSQHSFFQLLHQGTKLIPADFIRAVETHNPVQGGLHQRMLASNFLAQTEALMVGKTPEQVKAEGAPEELIPHKTFLGNRPTTSILADKISPATLGALIAYYEHMVFTEGAIWNINSFDQWGVELGKALAKKVQKDLETEGAGSGHDSSTSGLIAAFKAKSGLK

SEQ ID NO: 24890 - protein, 556 aa, Andrographis paniculata
MDVVRRRPTKPAPSDKVVVDRRPSSPKASDALPLPLYLTNGIFFTLFFSVAYFLLHRWRDKIRNSTPLHVLTLSELAAIVCLIASFIYLLGFFGIDFVQSFISKPDADDDPQRFILHEDRNVLCSIPPPSPPKPKIPLNLSDDDDELVDRVVSGEIPSYSLESKLGDCLRAARIRRAAVQHLTGRSLEGLPLEAFDYDSILGQCCEMPVGYVQIPVGIAGPLLLNGCEYSVPMATTEGCLVASTNRGCKAIHASGGATCVLLRDGMTRAPVVRFPSAKRASELKFFIEDPINFETLSVVFNRSSRFARLQSIKSAIAGKNLYLRFTCSTGDAMGMNMVSKGVQNVLEFLQNDFPDMDVIGISGNYCSDKKPAAVNWIEGRGKSVVCEATISGDVVSKVLKTTVSGLVELNMLKNLTRSAMAGALGGFNAHAANIVSAIFIATGQDPAQNIESSHCITMMEAVNDGKDIHISVTMPSIEVGTVGGGTQLASQSACLNLLGVKGANKESPGANAQLLGLVVAGAVLAGELSLMSAISAGQLVKSHMKYNRSQKNFAKN

SEQ ID NO: 24891 - protein, 232 aa, Bacillus cereus G9241
MLILDGMVMTTEKDEFVYHEMVAHVPLFTHPNPENVLVVGGGDGGVIREVLKHPSVKKATLVEIDGKVIEYSKQYLPSIAGALDNERVEVKVGDGFLHIAESENEYDVIMVDSTEPVGPAVNLFTKGFYAGISKALKEDGIFVAQTDNPWFTPELITTVFKDVKEIFPITRLYTANIPTYPSGLWTFTIGSKKHDPLEVSEERFHEIETKYYTKELHNAAFALPKFVGDLIK

SEQ ID NO: 24892 - protein, 372 aa, Bacillus cereus E33L
MKAEEKFSPGLDGIVAAETKISFLDTVKGEIVIQGYDLIELSKTKEYLDIVHLLLEEHLPNEDEKATLEKKLKEEYAVPEGVFNVLKALPKETHPMDGLRTGVSALAGYDNDIENRSLEVNKSRGYKLLSKVPNIVANSYHILNNEDPIEPLEELSYSANFFYMLTGKKPTELEEKIFDRSLVLYSEHEMPNSTFTARVIASTQSDLYGALTGAVASLKGSLHGGANEAVMYMLLEAGNVEKFEELLQKKLYNKEKIMGFGHRVYMKKMDPRALMMKEALKQLCDVKGDYTLYEMCEAGEKIMEKEKGIYPNLDYYAAPVYWMLGIPIQLYTPIFFSSRTVGLCAHVIEQHTNNRLFRPRVNYIGERHVLSK

SEQ ID NO: 24893 - protein, 455 aa, Xanthobacter autotrophicus Py2
MSRREVDLFVIGAGSGGVRAARIAAQHGARVMMAEEYRVGGTCVIRGCVPKKLFVYAGRFAHDIEDMAGFGWRVTEPEFDWLTLVANKDKEIARLEAIYRRNAENAGVEVVASRAVVVGPNSVRLLATGEEIGARYILLATGARPALGPAIPGCELAITSNEAFNLTHFPNRILVQGAGYIAVEFAGLFRALGADVTLVYRADKVLRGFDGEIRDHLEAEMTRAGIHLKPGRTLTSIEVINGGKRVTLSDGSVVEVDDVMLALGRIPNTAHLGLDTVGVKLDEVGAVVVDETGATNVPSIYAVGDVTNRINLTPVAIREGHAFADTVFGNKPWTVDHSLVATAVFSEPEIGTVGLSEEAARALGRPIDIYSTSFRPLKATLSGRETRTFMKLVVDKESDVVLGCHIMGDAASEMIQLAGVALGLKAKKADFDRTVAVHPTSAEELVTLRTPTRSV

SEQ ID NO: 24894 - protein, 308 aa, Zea mays
  misc_feature (249)..(249): Xaa can be any naturally occurring amino acid
  unsure (1)..(308): unsure at all Xaa locations
MAPSRPLMRGIRPPRVFPTRGGRASPYTVALTALLLVSAALLALIAFGVFSLPVSAPNAAATTGTAAGGETESADVRPRARRDLGEGLGERGAQWTEVISWEPRAFVYHNFLSKDECEYLIGLAKPHMVKSTVVDSTTGKSKDSRVRTSSGMFLQRGRDKVIRAIEKRIADYTFIPVDHGEGLQVLHYEVGQKYEPHFDYFLDEFNTKNGGQRIATLLMYLSDVEEGGETIFPDANVNASSLPWYNELXSDCAKRGLSVKPKMGDALLFWSMKPDATLDPLSLHGGCPVIKGNKWSSTKWMHIHEYKA

SEQ ID NO: 24895 - protein, 520 aa, Bifidobacterium longum DJO10A
MANGPVLVVDFGAQYAQLIARRVREAGVYSELVPHSMPVDEILAKDPKAIILSGGPASVFEPGAPTIDTKVFESGVPVLGICYGFQVMAYELGGKVDKAALGEYGKTSATIDDAAGILADSPAEQTTWMSHGVAVEQAPAGFEVLAHTEGAPVAAMADESRKLYGVQWHPEVKHSPLGQKLIENFLHRCAALPNDWDASSIIEDQVKKIREQVGDAEVICGLSGGVDSAVAAALVHKAIGDQLTCVFVDHGLLRKGEVEQVKHDFVAATGIRLITVDAADDFLDALAGVSEPERKRKIIGEKFIRTFEKAQRQVLEEAGARGKEVKFLVQGTLYPDVVESGGGDGAANIKSHHNVGGLPEDIKFQLIEPLRTLFKDEVRAIGTELGLPDEIVWRQPFPGPGLGIRIIGEITKERLDLLREADAIAREELSKAGLDRDIWQCPVVLLADVHSVGVQGDERTYGSPIVLRPVSSEDAMTADWSRVPYDVLATISTRITNECRQINRVVLDCTSKPPATIEWE

SEQ ID NO: 24896 - protein, 466 aa, Streptomyces viridochromogenes
MFVNGALQPARRHTTVHDRWTGEPVGTVPRDGAEEAAAAVAALAAGRRATTPQQRSAVLTRAADMLTARAEEFSTLITAESGVCRKETLREVSRAAGNLRVAAAEAERIRGESIPLPDGTRLAVTLPEPVGVVLGITPFNRPLNQVVVKAAPALAAGCPLLLKPSEKTPLTALAFAELLVEAGCAKDMLAVVTGEPGEVGPPLAAHPDVAMVTFTGSVATGHAVAAQAAGKRQLLELGGNDPLFVLPDADLRRAAKLAADGSCATAGQSCRGIKRVFVWEEVADEFTALLEPAVAAKRAGDPRREDTDLGPLVSEEAALVVERRIARAVRDGARLVTGGERDGALVRPAVLDHVPPDTELVTEETFGPVAPVIRVRDADEAVRLSNGTAYGLQAGVLTRDSAAFWDIAARLRVGAVNLGEGPHFDSPHIPFGGVKSSGVGREGIRYAIAEMTVTKTVTLPGPYGTG

SEQ ID NO: 24897 - protein, 153 aa, Brassica rapa
MALRATQSTARMAANLRRVARPFSTDAVVESDYKRGEIGKVSGIPEEHLARKVIIYSPARTATQQGSGKLGKWKINFVSTLKWENPLMGWTSTGDPYANVGDSALGFDSELAAKSFAERHGWDYVVKEPKTPLLKAKSYSDNFKWKGKPQLEN

SEQ ID NO: 24898 - protein, 158 aa, Zea mays
  misc_feature (8)..(8): Xaa can be any naturally occurring amino acid
  misc_feature (19)..(19): Xaa can be any naturally occurring amino acid
  unsure (1)..(158): unsure at all Xaa locations
AVSRAFGXSRFRPRKNDMXKKGVDEGRWSEKLVSRIEFKGDMVVATPDILQVPLASDVEFIILASDGLWAYMKNSDVVSYFRDQLREHGNVQLACESLAQVALDRRSQDNVSIIIVDLVRTEWKNFLSQRQNVVVELVQAATTIGLVSVGRKKSSHLS

SEQ ID NO: 24899 - protein, 149 aa, Arabidopsis thaliana
  misc_feature (59)..(59): Xaa can be any naturally occurring amino acid
  misc_feature (63)..(63): Xaa can be any naturally occurring amino acid
  misc_feature (80)..(80): Xaa can be any naturally occurring amino acid
  misc_feature (82)..(82): Xaa can be any naturally occurring amino acid
  misc_feature (102)..(102): Xaa can be any naturally occurring amino acid
  misc_feature (138)..(138): Xaa can be any naturally occurring amino acid
  unsure (1)..(149): unsure at all Xaa locations
MASSMLSSAAVATYPAQANMGAPFTAMKPCASLPDTRKANNDITYITCNGGRASRMKGXPPIXKKTLETLSYLPDLTDYXIXKEVDYLLHNKWITRGEFQMXHGLEYREHGNTPGYYDGRDWTIAKLPLFGCTDSAQXLNEGEECKNEY

SEQ ID NO: 24900 - protein, 298 aa, Gemmata sp. Wa1-1
MWLLWPRGQERASLSAGGSVRVVAVSPDGVLIAAAGEDKVIRVWDAGATTTKFALEGHAGKVFGLAFSPDSKTLCSCGDDRTVRLWDAATGTPGAVITASDATVECVAFAPDGKTLASAGSDHIVRLWTVPDGKPIRTLKGHTRRIHALVFADSKTLASAGEDGGVRLWNWPTGALIGQLPVEKHRVHALTVSADGKVLAAAATGGPRWWTLADKSERPKVTSAGGTRAVAFDRDGKFLATGHEDGAVKLWSALDGAEVKTLTGHRGAVFGVGFTPDGKTLVSAGSDGTVKLWDVPVK

SEQ ID NO: 24901 - protein, 208 aa, Brassica napus
MEFTLATSSFMGTKVIPATLFCRRARAASLIVTASSTKIYTRLDSCLVIPPPPIFKKPRAIIKFLGGAFVGAVPELTYSYLKELLAKEGYLIVSVPYNVTFDHEQAAKQVYQRFNSCLDAIVLSGVPNANLNPQDLANLPVFSVGHSNGALLQVLTGSYFSDKIPKVNAIISFNNKSATEAVPYFEQLGPLIQQMMPVVEASPLYEIA

SEQ ID NO: 24902 - protein, 331 aa, Triticum aestivum
  misc_feature (124)..(124): Xaa can be any naturally occurring amino acid
  misc_feature (134)..(134): Xaa can be any naturally occurring amino acid
  misc_feature (261)..(261): Xaa can be any naturally occurring amino acid
  unsure (1)..(331): unsure at all Xaa locations
HYNTGCTKKQVATGPEFPGYRRPTRPAAGNRCYATVAPRARSSTIVASLGTPAPSNSSSFRPKLIRNTPVQAAPVAPALMDAAVERLKTGFEKFKTEVYDKKPDFFEPLKAGQAPKYMVFACAXDSRVCPSVTXWGLEPGEAFTIRNIANMVPSYCKNKYAGVGSAIEYAVCALKVEVIVVIGHSRCGGIKALLSLKDGADDSFHFVEDWVRIGCPANKKVHTDCASMPFNDQSTVLEKEAGNVILRNLLTYPFVREGGVXNGNPSSSLAGNYDFISGKMETWEQLIFPTGKVLYLHANTTAYIFSGYGRTVRTDGVESNGHEMGYSFISQ

SEQ ID NO: 24903 - protein, 439 aa, Pyrococcus horikoshii OT3
MIREKALEFHKNNFPGNGKIEVIPKVSLESREELTLAYTPGVAEPCKEIARDPGKVYEYTSKGNLVAVVSDGSRILGLGNIGPLAGLPVMEGKALLFKRFGGVDAFPIMIKEQEPNKFIDIVKAIAPTFGGINLEDIASPKCFYILERLREELDIPVFHDDQQGTAAVVLAGLLNALKVVGKKISEITLALFGAGAAGFATLRILTEAGVKPENVRVVELVNGKPRILTSDLDLEKLFPYRGWLLKKTNGENIEGGPQEALKDADVLISFTRPGPGVIKPQWIEKMNEDAIVFPLANPVPEILPEEAKKAGARIVATGRSDYPNQINNLLGFPGIFRGALDVRARTITDSMIIAAAKAIASIVEEPSEENIIPSPLNPIVYAREARAVAEEAMKEGVARTKVKGEWVEEHTIRLIEFYENVIAPINKKRREYSKAITRA

SEQ ID NO: 24904 - protein, 609 aa, Mesorhizobium loti MAFF303099
MKLRNIAIIAHVDHGKTTLVDQLLKQSGSFRDNQRVAERAMDSNDLEKERGITILAKATSVDWKDTRINIVDTPGHADFGGEVERILSMVDSAIVLVDAAEGPMPQTKFVVGKALKVGLKPIVVINKIDRPDARHVEVVNEVFDLFAALDATDEQLDFPILYGSGRDGWVSENPEGPKDQQLAPLFDLIIKHVPAPTVHPGPFRMIGTILEANPFLGRIITGRIESGTLKANQAVKVLHHDGTQIETGRISKILAFRGLERQPIEEAQAGDIVAIAGLSKGTVADTFCDLAVTEALHAQPIDPPTVTMSFLVNDSPLAGTEGDKVTSRVIRDRLLREAEGNVALKIEESPDKDSFFVSGRGELQLAVLIETMRREGFEIAVSRPRVVMQKGENGELLEPVEEVVIDVDEEHAGVVVQKMSERKAEMVELRPSGGNRQRIVFHAPTRGLIGYQSELLTDTRGTAVMNRLFHAYEPYKGELPGRTNGVLISNEQGESVAYAMWNLEDRGPMVIDPGVKVYQGMIIGIHSRDNDLEVNVLKGKKLTNIRAAGKDEAVKLTPPIRMTLERALAWIQDDELVEVTPKTIRLRKLYLDPNERKRFEKSSKVVGAA

SEQ ID NO: 24905 - protein, 253 aa, Xanthobacter autotrophicus Py2
MPHAAPVGRARGTGTETPMVHAEDPKRRAAAHALTYVTDGMRLGLGTGSTARHFVELLAEKVHAGLNILGVPTSEQTLSQAVSLGVPIATLDEAGPLDLCIDGADEVGPGLALIKGGGGALLREKIVASAAREMVVIADSSKKVAMLGRFPLPIEVVDFGVASIERHVADAVRKAGCEGPVKLRRDGDGHPFVTDQGHLILDVHLGRIPDPAALARAVEEVAGVVEHGLFLGLARRVVLAGADGITVLEPGSF

SEQ ID NO: 24906 - protein, 437 aa, Mycobacterium tuberculosis H37Rv
MAAATGGLTPEQIIAVDGAHLWHPYSSIGREAVSPVVAVAAHGAWLTLIRDGQPIEVLDAMSSWWTAIHGHGHPALDQALTTQLRVMNHVMFGGLTHEPAARLAKLLVDITPAGLDTVFFSDSGSVSVEVAAKMALQYWRGRGLPGKRRLMTWRGGYHGDTFLAMSICDPHGGMHSLWTDVLAAQVFAPQVPRDYDPAYSAAFEAQLAQHAGELAAVVVEPVVQGAGGMRFHDPRYLHDLRDICRRYEVLLIFDEIATGFGRTGALFAADHAGVSPDIMCVGKALTGGYLSLAATLCTADVAHTISAGAAGALMHGPTFMANPLACAVSVASVELLLGQDWRTRITELAAGLTAGLDTARALPAVTDVRVCGAIGVIECDRPVDLAVATPAALDRGVWLRPFRNLVYAMPPYICTPAEITQITSAMVEVARLVGSLP

SEQ ID NO: 24907 - protein, 572 aa, Streptomyces viridochromogenes
MGNFRFTTKFGRNLSRYVRHGIGVHHAGMLPKYRRLVEKLAQAGLLKVICGTDTLGVGVNVPIRTVLFTALTKYDGTRVRTLRAREFHQIAGRAGRAGYDTEGFVVAQAPEHVVENEKALAKAGDDPKKRRKVVRKKAPEGFVAWSEQTFEKLIGSEPEPLASRFRVTHTMLLSVIARPGNAFEAMRRMLEDNHEPRKQQLRHIRRAIAIYRSLLDGGIVEKLDEPDPTGRIVRLTVDLQQDFALNQPLSTFALAAFELLDPESPSYALDMVSVVESTLDDPRQILAAQQNKARGEAVAQMKADGVEYEERMERLQDITYPKPLEELLFHAYDTYRKSHPWVGDHPLSPKSVIRDMYERALSFTELVSHYELARTEGIVLRYLASAYKALDHTVPDDLKSEDLEDLIAWLGEMVRQVDSSLLDEWEQLANPAEMTAEEAQEKADEVKPVTANARAFRVLVRNAMFRRVELAALDQVEELGEMDAESGWDADAWGEAMDKYWDEYEDLGTGPDARGPKLLIIEEEPQSALWRVRQIFHDPSGDHDWGISAEVDLTASDAEGRAVVRVTDVGQL

SEQ ID NO: 24908 - protein, 82 aa, Zea mays
TFHEIQKLLSKTNGKVIADVMTPAPLVVRETTNLEDAARLLLVTKYRRLPVVDSSGKLVGIITRGNVVQAALEIKKKVEGTL

SEQ ID NO: 24909 - protein, 443 aa, Dechloromonas aromatica RCB
MANAQSATLPANMSANHAELDGAYRKVTLHLIPFIFICYLFNYLDRVNVGFAKLQMIDALKWSETIYGLGAGIFFIGYVLSGVPSNLLLHRLGARKVIGTLMIAWGIASASLMFVKTPEAFYTLRFITGVFEAGFFPGIVLYFTNWFPASRRGRIMGLFMSAIPISGLLGSPLSGWMMQSFAGQGGLAGWQWMFLLQGIPTVLLGLLVYVMLNDGIAQAKWLSTDEKQMLIAELEKDEKNRRESSLAADTFASVLRNPHVWLLGLVYFCIQMGVYAINFWLPSIIKSLGFQSPLTVGWISAIPYLCASIFMIWIGRSGDARKERRWHLSGPLLMGLCGLMIATMAGGNAVIAVFGLSLATMGALSGLPMFWPLPTAFLGSAAAAGGLALINSLGQIAGFISPFLVGWIKDATGGTTVALYILSGVLFFGAMLVLRVPAKIVNR

SEQ ID NO: 24910 - protein, 444 aa, Haemophilus influenzae Rd KW20
MKNVVIVGGGAGGIELATFLGNKLGRQKQAKVTLVDRNATHLWKPLLHEIATGVMDDGVDSLSYRAHGKNHFFSFEQGSIIRINREQKYVELAPVYGQEGDMLVIARRIPYDYLVIAIGSKSNDFNTKGVADNCIFLDSSKQALRFQHKLLELFLKFSENRALDDIGEEEFKQKLVDENKVNIAIVGGGATGVELTAELYHAAEDLSSYGYGKIDSSCLQVTLVEAGTRLLPALPENLSAAVLDELKEMGTNVQLNTMITEAQPNTLITKDGGEIKADLIVWAAGVRASTVTQQFDGLEINRINQLVVKDTLQTTVDDSIFAIGDCAALIQSNGKLVPPRAQAAHQMAKACAKNIFALFENKPLKSFKYNDKGTLVSLSNFTALGSLTNKFGKNPLTVQGKFAQFAYVSLYRMHQHALHGCIKIGLIILVDKLNRYLKPRLKLH

SEQ ID NO: 24911 - protein, 318 aa, Ralstonia eutropha JMP134
MPLDPQARAMLDAMAAMPSPDFTTLRAADYRAAVAAMPAFAPGDSVAAQQDLTIDGAAGPLPARLYRPDDSAGPPLIVYFHGGGFVLCGLDSHDNICRSLARRSGALVLSVDYRLAPEARFPAAADDAVAAVRWAAGHAAELGVDPARLAVAGDSAGGNLAAVVCQQLRGSGIALKHQLLLYPYLDCTDAAADSASYRACAEGYFLSARELDWCRAQYLANPDAAADVRASPLHQRDLQGLPAATIITAEFDPLRDQGEAYGEALRGAGGAATVRRWPGQFHGFMSMQGVLDAASHALDAAAASLRQAFAASGTQEAA

SEQ ID NO: 24912 - protein, 421 aa, Shigella flexneri 2a str. 301
MSNNEFHQRRLSATPRGVGVMCNFFAQSAENATLKDVEGNEYIDFAAGIAVLNTGHRHPDLVAAVEQQLQQFTHTAYQIVPYESYVTLAEKINTLAPVSGQAKTAFFTTGAEAVENAVKIARAHTGRPSVIAFSGGFHGRTYMTMALTGKVAPYKIGFGPFPGSVYHVPYPSDLHGISTQDSLDAIERLFKSDIEAKQVAAIIFEPVQGECGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAAEFNDPQTGEPSAAIAQKIQQRALAQGLLLLTCGAYGNVIRFLYPLTIPDAQFDAAMKILQDALSD

SEQ ID NO: 24913 - protein, 203 aa, Glycine max
MKQIEMESNASALAKKVWSMVRVVLFMLRKGITKGKLMMDLNMMLKRRGKLAGKAIANLMSSHHHHNRGGSHNSHHLKFSAPREYEFSCSNTPHNFFFPTGGKHHRHHFFACVHAPPTQDDDVVTVNAMKAVMEMLNNNNNDAVKVEASPALPGFGRSPMVRQLRVTDSPFPLRDADQDNDHLVDKAAEDFIKRFYKELRKQD

SEQ ID NO: 24914 - protein, 771 aa, Oryza sativa (japonica cultivar-group)
MPPPMAPPPPPPPPPPILLLLLLLLAAVAADVSTALCFDYATLTLGSLKLLGDAHLKNGTIRLSRDLPVPNSGAGRALYATPVALRGGFSTQFAFTVATLNADSVGGGLAFVLASDGVTLGDAGPYIGVSAASDVAAVEFDTLMDVQFGDVNGNHVGLDLGSMVSAAVADLDGVGVELTSGRTVNAWIEYSPKSGMEVFVSYSPKRPAEPVLSAPLDLGEYVKGDAFVGFSASTQGSTEMHAVEWWTFSTPTSSSSSPSKPSPRMATPSSPPPEAPVSSAAPPPASLNPMLPSPPQLPGVSTTTPSPPASTVSMPPTNSVAVASAPANSTAGISNAGSPHPPAHAAVAGAATAGAFVAVSFAGFALWALARRARARRRGTTALAAVADKRDSLASAAALARSPREFTYKELSAATRGFDASRVIGNGAFGTVYKGIIPDTGAMVAVKRCTNASADGAQARSEFLSELSIIAGLRHRNLLRLQGWCHEKGEILLVYDYMRNGSLDKALFDASSPVLPWSHRREILAGVASALAYLHHECERRVIHRDVKSSNVMLDDAYRARLGDFGLARQAEHGESPDATAAAGTMGYLAPEYLLTGRATEATDVFSFGALVLEVACGRRPIGATEGRCNNLVEWVWSLHGAGQVLDAVDARLRGEYDEAEMRRAMLVGLACSSPEPALRPGMRAVVQMLGGEADPPFVPAARPSMSFSANHQLLLSLQDSVSDYNALGLNDLSDDSSSDSLSSSSLTSTLRKGGHDIAAFSSAAAGDAAR

SEQ ID NO: 24915 - protein, 572 aa, Mycoplasma pneumoniae M129
MKKLSGIGVSDGMALAKAFLVKTPEFAVNKYLKHQLTKAQAKRLLDSAFKKAVKDLEEIKEITVNNINTEAGMIFDAHIQMLNDPTITEQLEQQLAQNVHPVIAVDTVFSQTATMFSQMQDKYFQERAADILDLRQRLLAYLTGQKPHDLVKIKSDVIIVAHDLTPSQTATLNKKYVKGFLTEIGGRTSHAAIMARSLEIPAVVGIKGITTKVKDGQIVGVDGRKGIAGLDLNSKDTTEWKKQKALEEKYQQELKQYTNKETVTLDGHAVVVAANIGNVKDMELACQYNTNGVGLFRTEFLYMNSQEWPDEETQYQAYKAVLEQAHGDLVIIRTLDIGGDKKLNYYEFPHEDNPFLGYRALRLTLDKQDIFKTQLRALLRAADHGQLGIMFPMVATLDELLQAKQLLNQVHQELGGNKQFKLGIMIEIPAAVLAANTLSHHVDFFSIGTNDLIQYSFAADRMNKNVSYLYQPLNPALLKLIYLTIEGGKVNDIWTGMCGEMAGEPLAIPLLLGLGLKEFSMSASSMFKARMIIAKLNYTECQTLAQKALTLANAKEVEKLVEKFFKKKDIFI

SEQ ID NO: 24916 - protein, 129 aa, Triticum aestivum
  misc_feature (51)..(51): Xaa can be any naturally occurring amino acid
  unsure (1)..(129): unsure at all Xaa locations
MHLYKNAGWQEQNSRDIVDPRVRGKGSDPEWNETFVFTVSENATELVIKLXDSDGGTDDDSVGEATIPLDGVYTEGSIPPTVYNVVKDEEYRGEIKIGLTFTPEVAVLHSCSGTKPISLYRVLCFSVAN

SEQ ID NO: 24917 - protein, 508 aa, Mycoplasma pneumoniae M129
MHKKVLLAILDGYGISNKQHGNAVYHAKTPALDSLIKDYPCVMLEASGEAVGLPQGQIGNSEVGHLNIGAGRIVYTGLSLINQNIKTGAFHHNQVLLEAIARAKANNAKLHLIGLFSHGGVHSHMDHLYALIKLAAPQVKMVLHLFGDGRDVAPCTMKSDLEAFMVFLKDYHNVIIGTLGGRYYGMDRDQRWDREEIAYNAILGNSKASFTDPVAYVQSAYDQKVTDEFLYPAVNGNVDKEQFALKDHDSVIFFNFRPDRARQMSHMLFQTDYYDYTPKAGRKYNLFFVTMMNYEGIKPSAVVFPPETIPNTFGEVIAHNKLKQLRIAETEKYAHVTFFFDGGVEVDLPNETKCMVPSLKVATYDLAPEMACKGITDQLLNQINQFDLTVLNFANPDMVGHTGNYAACVQGLEALDVQIQRIIDFCKANHITLFLTADHGNAEEMIDSNNNPVTKHTVNKVPFVCTDTNIDLQQDSASLANIAPTILAYLGLKQPAEMTANSLLISKK

SEQ ID NO: 24918 - protein, 244 aa, Mycoplasma pneumoniae M129
MRTKYLIGNWKTNKDLHQALAFVEQFKQHPAKTKAVLGIAPVHVHLTEVNKVLPNNLLLLAQDANFIASGSYTGTVSYTQLQDIKVNSVIIGHSERRKYFNETAQVINQKLKACLQAGMLVVLCIGETEGQPISFLKEDLTQVLQGIDLSLLKQLVIAYEPIWAIGTGKTATPEIANNTIAQIRVYLSELYNKEIAQQTSILYGGSVAKDNIKELAQTEQIDGFLVGKASLDVNDFLVMAQVYA

SEQ ID NO: 24919 - protein, 213 aa, Nostoc punctiforme PCC 73102
MQTTNRQVNSNYDQSTKNPRIATVHRTTGETDVQVTINLDGRGTCTAATGIPFLDHMLHQIASHGLIDIDVQAKGDLEIDDHHTNEDVGITLGQAFNQALGDRKGIVRFGNFLAPLDEALVQVALDFSGRPHLSYGLQIPTQRVGTYDTQLVREFFVALVNHSQMTLHIRQLDGINSHHIIEATFKAFARATRLAVEIDPRRAGLIPSSKGVL

SEQ ID NO: 24920 - protein, 341 aa, Anaplasma marginale str. St. Maries
MRPEIHLWERMALITVREALRQAMEEEMERDPNVLLIGEEVGEYQGAYKVSQGLLERFGPSRVVDTPISEHAFTGIAVGAAFCGLKPIVEFMSFNFSMQAMDQIVNSAAKTNYMSGGQLGCPIVFRGPNGAAAGVAAQHSQCYASWYAHIPGIKVVAPYFAADCKGMLKAAIRDPNPVIFLENEIAYGHQHDISEEEQSADYLVEIGKAAVVREGSDLTVLAFSLQLQYALEAADALMNDGISAEVIDLRTIRPLDRETILQSVRKTNRLVTVEEGWPFSGVGAEIAAFVTEFAFDDLDAPVLRVAGKEVPLPYAANLEASALPQVGDIVSAAHEVCYRKV

SEQ ID NO: 24921 - protein, 297 aa, Burkholderia xenovorans LB400
MKSTEFRGIISYPVTPFDLHDGSVDVPTLNRLIDRLVDSGSHGIAPLGSTGESAYLSDDEWDTVAEASVRRVAKRLPVIVGISDLTTRNAVRRAKFAESVGADAVMVLPVSYWKLNEAEIFRHYATIAEAISVPIMVYNNPATSGIDMQPELIVKLAREIDNVTMIKESTGDIQRMHRIAQLSDGRVPFFNGSNPLALGAFAAGAAGWCTAAPNLVPQWPVKLYEACEKGDMELARAVFYRLLPFLQCIMKGGLPTTVKAGLALRGFSVGAPRRPLQPLAEPAVRELAAVLGGLEGG

SEQ ID NO: 24922 - protein, 205 aa, Oryza sativa (japonica cultivar-group)
MADVEEYRCFIGNLSWSTTDESLKDAFGKFGNLTEAKVVFDKYSGRSRGFGFVTFDEKKAMEDAIEGMNGLDLDGRAITVDKAQPQGPGRDRNGDRDYDRDRGSRYDRGRDFGGGGRAPRGSGGGGDCYKCGKPGHFARECPSGDGGGRGDRYGGRDDRYGGGGGGGGRYGSDRGGDRYSGRSRDGGGYGGGGGDRYSRDRSGPY

SEQ ID NO: 24923 - protein, 301 aa, Zea mays
MLPYATAAEAEAALGRPMTPAEALWFRYTAGVSDYHLYCCNILFLFVVFTVAPLPIALLELRAPAAVSPYKLQPRVRLSRAEFVRCYKDVLRIFFLVIGPLQLVSYPAVKFVGIHTKLPLPSLAELAAQLLVYFLVEDYLNYWIHRFLHGEWGYQNIHRVHHEFTAPIGFAAPYAHWAEVLILGIPSFVGPAIVPGHMITFWLWIILRQVEAIETHSGFDFPFTPTKYIPFYGGAEYHDYHHYVGGQSQSNFASVFTYCDYLYGTDKGYRFHKTYLAKLKDLGHNDGQKGDGSGPSYVKLD

SEQ ID NO: 24924 - protein, 144 aa, Prosthecobacter dejongeii
MEYTGEKITKAESERRGNALAARAAKTGGAAVYIFTLNKTHDLDGSTSGNTARLINHSCEPNCEAFISRGRIWIHAKYDIPEGEELSFNYGFALDTWEDHPCRCGKPSCVGYIVDEQYWPKLRRILKARAQRAEKIAALEARAA

SEQ ID NO: 24925 - protein, 153 aa, Candida glabrata CBS 138
MKAQLQAISLRIQAVRSSDQMTRSMREATGLLAGMNRSMNLPQLQKISMEFEKQSDLMDQRQEFMDEAIDNVMGDELEENEDADEIVNKVLDEIGIDLNSQLQNTPQHELKLPGEAESQNGVAETVGASGSGGDTKMSPDDDLQARLDSLKRQ

SEQ ID NO: 24926 - protein, 794 aa, Arabidopsis thaliana
MLHRLRWFIGLSKRSREAKTLDAKPYISKVKPVLMVDTVQEIAIYIHRFHNLDLFQQGWYQIKITMRWEDGDNVTRGIPSRVVQYEAPDSGANDSYGVWKIVDKDNSFLTQPFRIKYARQDIRLCMMISFTLPLERYEGSATSAAILKFELMYAPSVDNASAKQLDTSPVAVHEFRIPPKALTGLHSYCPVHFDTLHAVLIDVSVHISVLKSAAYKRPASLSSGVSNSKNVSGSSAQSFKKALGLLASADKKLVSFVKALLGARGILLEEMQRLSKAVGQTIDLSDFVSNMNNVQLSNSTSTGSGQGKEQNSLENLNITFDLTSDDWLHELSKDHLSRIFHLLGTQLHYLWNTLLGFHRDNHTKILEYLRDIWTKDRRAEWSIWMVYSKVEMPHHFINSGMTDILNQSAHKRASGVLNEPAQIAATRAELHRRSIAQMRINNRSIQDMHILGDPMRVPIVIIERVLNAPRRTLSDNSYLRHMDLLDSSLLNGHKDEAEKTKVTNSQQSARELKIVVFVHGFQGHHLDLRLVRNQWLLIDPKIEFLMSEANEEKTHGDFREMGQRLAQEVVSFLKRKKDRYARQGHLKSIKLSFVGHSIGNVIIRTAIADSLMEPYRKYLHTYLSLSGPHLGYLYSTNSLFNSGLWLLKKLKSTQVIHQLTLTDDPDLRHTFFYKLCKQKTLENFKNIILLSSPQDGYVPYHSARIESCQPASFDSSKRGVAFLEMLNNCLDQIRGPVPEAPHQQRVFMRCDVNFDMTVYGRNLNSFIGRAAHIEFLESDIFARFIMWSFQDLFR

SEQ ID NO: 24927 - protein, 721 aa, Pyrobaculum aerophilum str. IM2
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLSVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEAVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 24928 - protein, 95 aa, Medicago truncatula
MKVNILRILFIFAFYLFVLLLQIVLTWDAQDETCGICRMAFDGCCPDCKLPGDDCPLIWGACNHAFHLHCILKWVNSQTSQAHCPMCRREWQFKG

SEQ ID NO: 24929 - protein, 135 aa, Triticum aestivum
  misc_feature (79)..(79): Xaa can be any naturally occurring amino acid
  misc_feature (100)..(100): Xaa can be any naturally occurring amino acid
  misc_feature (102)..(102): Xaa can be any naturally occurring amino acid
  misc_feature (111)..(111): Xaa can be any naturally occurring amino acid
  misc_feature (119)..(119): Xaa can be any naturally occurring amino acid
  misc_feature (122)..(122): Xaa can be any naturally occurring amino acid
  unsure (1)..(135): unsure at all Xaa locations
MAPTVMASSATSVAPFQGLKSTAGLPVSRRSNGASLGSVSNGGRIRCMQVWPIEGIKKFETLSYLPPLSTEALLKQVDXLIRSKWVPCLEFNKVGFIFRXAXASPGYYDGXYWTMWNCXMFXCTTHVTSGGKKDT

SEQ ID NO: 24930 - protein, 117 aa, Medicago truncatula
MTTFFNKTVFHHLALYVFHPSNKPWRLITNFYQTSLANPNERIVLLTTVENHLPKVLGMTNSVSCSGKNNTIMKAVLVASLYPQYGENLKTTHLNESTVTGKVVEVYQPSHEKVQKI

SEQ ID NO: 24931 - protein, 499 aa, Oryza sativa (japonica cultivar-group)
MAAVAGTGVFAEILEGEVYRYYADGEWRVSASGKSVAIVNPTTRLTQYRVQACTQEEVNKVMETAKVAQKAWARTPLWKRAELLHKAAAILKEHKTPIAECLVKEIAKPAKDAISEVVRSGDLVSYTAEEGVRILGEGKLLVSDSFPGNERNKYCLSSKVPLGVVLAIPPFNYPVNLAVSKIGPALIAGNALVLKPPTQGAVAALHMVHCFHLAGFPKGLINCVTGKGSEIGDFLTMHPGVNCISFTGGDTGIAISKKAGMVPLQMELGGKDACVVLEDADLDLVAANIVKGGFSYSGQRCTAVKVVLIMESVADIVVEKVKAKLAKLTVGPPEADSDITPVVTESSANFIEGLVMDAKEKGATFCQEYRREGNLIWPLLLDHVRPDMRIAWEEPFGPVLPVIRINSVEEGIHHCNASNFGLQGCVFTKDINKAIMISDAMETGTVQINSAPARGPDHFPFQGLKDSGIGSQGITNSINMMTKVKSTVINLPSPSYTMG

SEQ ID NO: 24932 - protein, 559 aa, Xanthobacter autotrophicus Py2
MIAFGHPRPRGMSNVPANRAAPLRAPVSFAYESQSLTSFSNLGLAEPIVRALTEAQHVTPTPIQAEAIPQILAGRDLIGIAQTGTGKTAAFALPILDRLVRHPHRPEPKSVRALVLSPTRELSGQIVENFEKFGRHANISVSLAIGGVPMGRQIRALSRGVDVLVATPGRLIDLVENHAVKLDQVEVLVLDEADQMLDMGFVHAIRAIVRRLPHKRHSLFFSATMPHAIAELAGSMLRDPVRVAVTPVAKTADRVEQRVILVDKANKGQLLAEVLSTEDIDRALVFSRTKHGADKVVRVLAKAGIAAEAIHGNKSQNQRDRVLAAFREGKIRTLIATDIAARGIDVTGVSHVINFDLPNVPESYVHRIGRTARAGREGIAISFCDHEERAFLRSIEKLIKMQLPSSDRRGAGTRFAVPELEPIILDERDETSERSDYIGRSGRQNPRGQRPRHGDERSGEGRSRAPRSEEGRPQAARAHQPRGEGRPAGGRPEGRPDAGGAQGAGHRAGQPARAEGRGQRTERGQRPAGDIGGLGFMQSVPNRGQRSDSRPGGAKRPVR

SEQ ID NO: 24933 - protein, 516 aa, Bifidobacterium longum DJO10A
MTTTASPVSKQTASAAQETGATGAAATAIETIETGVAGVADAATNAAANAIEDLEAAESRGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 24934 - protein, 387 aa, Brucella suis 1330
MTTLSNRSAVEPFHAMDVLAEANRRRAAGHPIISMAVGQPADSAPVVVRQAAERALKDGRIGYTDALGLIELREAIAAHYADHYGVSVSPERIAVTTGSSAAFNLAFIVYFDPGDRVAITRPGYPAYRNILTALGLEVVEIPTGHGTFSSLTAQALAAAHAEKPLKGVLFASPANPTGAVIDKPELTAIIETARNLGIRVISDEIYHRLSYEADDVTALEVADDVTIINSFSKYYCMTGWRIGWMVLPDNDIRAIERLSQSLYISAPELSQRGAIEAFRATAELERIKDRYRRNRLILLNHLPRMGLDLAAPMDGAFYAYCDVSRFTNDSMEFVRGMISEINIAATPGRDFDPLDGHRTVRFSYAGKVEEMEEAVRRLDDWLPQQKA

SEQ ID NO: 24935 - protein, 227 aa, Haemophilus influenzae Rd KW20
MELVFIRHGFSEWNAKNLFTGWRDVNLTERGVEEAKTAGKKLLDKGYEFDIAFTSVLTRAIKTCNIVLEESHQLWIPQVKNWRLNERHYGALQGLDKKATAEQYGDEQVHIWRRSYDISPPDLDPQDPNSAHNDRRYANIPSDVVPNAENLKLTLERALPFWEDQIAPAMLSGKRVLVVAHGNSLRALAKHIIGISDAEIMDFEIPTGQPLVLKLDDKLNYVEHYYL

SEQ ID NO: 24936 - protein, 435 aa, Oryza sativa (indica cultivar-group)
MAAAKHFTYVILGGGVAAGYAAREFAKQGVKPGELAIISKESVAPYERPALSKGYLFPQNAARLPGFHTCVGSGGERLLPEWYSEKGIELILSTEIVKADLASKTLTSSADATFTYDTLLIATGSSVIKLTDFGVQGAEANDILYLRDIEDADKLVAAMQAKKDGKAVIVGGGYIGLELSAALKTNNFDVTMVYPEPWCMPRLFTSGLAAFYEGYYANKGIHIIKGTVAVGFDADANGDVTAVKLKNGNVLEADIVIVGVGGRPLTHLFKGQVAEEKGGIKTDAFFETSVPGVYAIADVAAFPMKIYNEIRRVEHVDHARKSAEQAVKAIKAKEAGESVPEYDYLPYFYSRSFDLSWQFYGDNVGEDVLFGDNDPTAAKPKFGSYWIKDGKVVGVFLEGGSAEENQVIAKVARAQPPVADVEALKKEGLDFAAKV

SEQ ID NO: 24937 - protein, 564 aa, Alteromonadales bacterium TW-7
MTTNTDPNYLYIHHSGPGLIETPLLNKGSAFSKKERENFNLAGLLPPRFETIEEQVERCYQQYSSFTDNLNKHIYLRAIQDNNETLYYRLVRDHLEEMMPIIYTPTVGDACEKFSDIYRSARGLFISYEDRYQIDDILRNATKGKVKVIVVTDGERILGLGDQGIGGMGIPIGKLSLYTACGGISPAYTLPVMLDVGTNNEKLLNDPMYMGARHKRIAQDEYDEFLDLFIKAVKRRWPNVLLQFEDFAQPNAMPLLKRYREEICSFNDDIQGTASVTVGSLLAACRVKGSTLSQQKVVFVGAGSAGCGIAEQIISQMVFEGITEEQARSQVFMVDRFGLLTNGMEGLRDFQQALAQPTDALNDWTYSGEYASLLDVMHCAKPDILIGVSGQPGLFTEQVIRAMHSTCEQPIIFPLSNPSKQVEAHPEDVIKWTDGKALVATGSPFDPVEYNGETFPIPQCNNSYIFPGIGLGVIAAKATRITDAMLSVSSEMLAESSPRANSGKGSLLPALTEIETLSKRIAFAIAKKAIEEGVALEISDDALWAAIDKNYWLPKYRNYKRCSV

SEQ ID NO: 24938 - protein, 435 aa, Burkholderia xenovorans LB400
MADSYFPRWRAQPAAAEGRIVGTDERLAWPQMFAMGVQHVVAMFGSTVLAPLLMGFDPNLCIFMSGIGTLLFFVLVGGRVPSYLGSSFAFIGLVIAVTGYGGHGPNLNIPVALGGIIACGVVYAVIGLIVSAVGTRWIETLMPPVVTGAIVCVIGLNLAPIAVHGVSGSNFDSWMALVTVLCVGAVAVFARGMLQRLLILVGLLMAYVIYAIVTNGLGMGKPIDFTIVANAAWFGMPHFTAPVFNMQAMTLLAPIAVILVAENLGHIKAVSAMTGQNLDRYVGRAFLGDGLATIVSGFAGGTGVTTYAENIGVMAVTKIYSTLVFVIAAVIALVLGFSPKFGAVIQTIPGPVLGGVSIVVFGLIAVTGARIWVVNKVDFSDNRNLIVAAVTLVLGAGDFSLKLGGFGLGGIGTATFGAIILYALLRRKPVQGPVA

SEQ ID NO: 24939 - protein, 555 aa, Bacteroides fragilis YCH46
MGLFIKKPFEALLAEANASGSKSLKRVLGPWSLVALGVGVIIGAGLFSITGTVAAGYTGPAITLSFAIAALGCCFAGLCYAEFASMIPVAGSAYTYSYATMGELIAWIIGWDLVLEYTVAATTVSISWSRYLVVFLEGLDIHLPQALTACPWDGGIVNIPAFLIVVLMSIFLIRGTEGSSIFNGIVVFLKVSVIAIFVVLGWKYINADNYTPYIPANTGTLGEYGLSGVLRGAAIVFFAFLGFDAVSTAAQETKNPKRNMPIGILVSLLVCTVLYMLFAHVMTGVAHYTEFSGQQGIAPVAIAIEHMGHADATGIIHPDYPWLNRAIVLAILFGYCSVIMVTLLGQSRVFLSMSHDGLLPPFFSHINEKFRTPARSNLLFMLIVGLLAAFVPARLAGEMTSIGTLMAFTLVCAAVLVVRKTMPNVPRSFKTPFVPLVPILGILTCLCMMLFLPADTWIRLVLWMLIGLDIYVGYGMKHSKLEHGVKNRRGQSALNMIGIALSLLCVITGLWHQQTVGWNESKVLLIISFVFAFTHCAYYMMRIWKGTTKQTNDNG

SEQ ID NO: 24940 - protein, 111 aa, Prosthecobacter dejongeii
NVMNTKMYVGNLPFTAMESELRALFNDYGTVTDMHLPMDHATGRPRGFAFVTMDSAMAMNEAITALNGKDFGGRSLTINEARPKEDRPAYSGGGSRGGKGGYGGGGGGGRY

SEQ ID NO: 24941 - protein, 214 aa, Ustilago maydis 521
MAPAAIRRKLVIVGDGACGKTSLLCVFAIGEFPQEYEPTIFENYVAEIRLDGKPVQLALWDTAGQEEYERLRPLSYSQAHVILIAFAIDTPDSLENVQVKWMEEVRQICGPSVPVLLVGCKKDLREDAIAKGKPVQGHYVERQQAKLVAAQIGARSYHECSSLNNQGVDAVFEAATRAAMLVRNSGASSGGAISQSKTKEALHNDAGSCKCIVL

SEQ ID NO: 24942 - protein, 753 aa, Arabidopsis thaliana
MQISLQIHLSSFTFLLLIFLLPVLSESQVASSESQTLLEIQKQLQYPQVLQSWTDTTNFCHIRPSPSLRIICLHGHVTELTVTGNRTSKLSGSFHKLFTLLTQLSSLKTLSLTSLGISGSLSPKIITKLSPSLESLNLSSNFISGKIPEEIVSLKNLKSLVLRDNMFWGFVSDDLRGLSNLQELDLGGNKLGPEVPSLPSKLTTVSLKNNSFRSKIPEQIKKLNNLQSLDLSSNEFTGSIPEFLFSIPSLQILSLDQNLLSGSLPNSSCTSSKIITLDVSHNLLTGKLPSCYSSKSFSNQTVLFSFNCLSLIGTPNAKYQRPLSFCQNQASKAIAVEPIPKAKDKDSARIKLGLVILIIIGVIILAAILVLLVLIALKRRRSRSEDDPFEVNNSNNERHASDKVSVCSTTTASSKSLPDSTKTINRIFLSVGRVPQTMRSAVIGLPPYRVFSLEELEEATNDFDAASLFCEQLYRGCLREGIPVTVRVIKLKQKSLPQSLAQQMEVLSKLRHMHLVSVLGHSIASNQDHNQHAGHTIFIVQEYISSGSLRDFLTNCRKKEVLKWPQRMAIAIGVARGIQFLHMGVAPGIFGNNLKIENIMLDETLTVKISGYTIPLPSKVGEERPQAKKPRSNEDREKEDVYQFGVILLQIITGKVVAAGSSEMGSLKLQLENGLRDEPSVLSSLADPSVKGSYAYESLRTTVEFAINCLCEDQSKRPSIEDVVWNLQYTIQVQQGWRPSSGNHESSMKAIYE

SEQ ID NO: 24943 - protein, 450 aa, Zea mays
MAATTAAPPARSPRRRRREADPAAALAAARHEFGEHGGVNMSIEASATFTVMEPDTMRRLFAGELGPDRGDMYIYSRHFNPTVLALGRQMAALEGTEAGYCTASGMSAISSVLMQLVGAGGHVVASRCLYGGTHALLARFLPRASGVRATFVDADDEAAVRAAVVPGETRVVYVETMSNPTLAVADIPMLARVAHEAGAKLVVDNTFTPVVVSPARLGADVVVHSVSKFISGGADIIAGAICGPASLVNAMMDLQEGALMLLGPTMNAKVAFELSERLPHLPLRMQEHSRRALAFAERMQGLGLRVLYPGLPGHPHHARLAAMGNPGYGCGGMLCLDMGTEERANRLMHHLQNTTQFGLMAVSLGYYETLMSCSGSSTSSEMPPEDRARAGISPGLVRMSVGYNGTLEQRWAQFERALALMQTPTPTHHLKAAAADRDGPEAANNHHRKH

SEQ ID NO: 24944 - protein, 665 aa, Listeria monocytogenes str. 4b F2365
MLPEEKNTFYITTPIYYPSGKAHIGHAYTTVAGDAMARYKRLKGYDVFYLTGTDEHGQKIQAKAKERGISEQEYVDEIAEGFQELWKKLEISNTDFIRTTQDRHKTSVEKIFEQLLEQGDIYLGEYEGWYSVSDEEYFTETQLEEVYKDENGKVIGGKAPSGNEVELVKEESYFFRMSKYADRLVEYYNSHPEFILPESRKNEMINNFIKPGLEDLAVSRTTFDWGIKVPGNPKHVVYVWIDALSNYITALGYNTDNDTKFQKYWPADVQIVGKEIVRFHTIYWPIMLMALDLPLPKMVFGHGWILMKDGKMSKSKGNVVDPYMLIDRYGLDALRYYLLREVPFGSDGLFTPEDFVDRVNFDLANDLGNLLNRTVAMINKYFDGEIPAYQGNVTEFDQTLVDFKNNVVKEYEGSMDHMQFSVALNQLWSLISRTNKYIDETAPWTLAKDEDKRTELASVMTHLAENLRIIAVLLQPFLTRTPGEIFLQLGLQEENLKKWDSIYGYGEIPAGTTVVKKGTPIFPRLEAEVEVTYIQDEMKGSAPAPAKEAAEVEALETPQIGIEDFDKIDLRVAEVKQVDKVKKADKLLCFQLDLGEGKLRQVLSGIAEFYQPEELIGKKVIVVSNLKPVKLRGLMSEGMILSGEKDGKLSVIEASSALPNGAKVK

SEQ ID NO: 24945 - protein, 324 aa, Thermoanaerobacter tengcongensis
  misc_feature (1)..(1): Xaa can be any naturally occurring amino acid
  misc_feature (21)..(21): Xaa can be any naturally occurring amino acid
  misc_feature (53)..(53): Xaa can be any naturally occurring amino acid
  misc_feature (75)..(75): Xaa can be any naturally occurring amino acid
  misc_feature (98)..(98): Xaa can be any naturally occurring amino acid
  misc_feature (102)..(102): Xaa can be any naturally occurring amino acid
  misc_feature (140)..(140): Xaa can be any naturally occurring amino acid
  misc_feature (143)..(143): Xaa can be any naturally occurring amino acid
  misc_feature (180)..(180): Xaa can be any naturally occurring amino acid
  misc_feature (217)..(217): Xaa can be any naturally occurring amino acid
  misc_feature (238)..(238): Xaa can be any naturally occurring amino acid
  misc_feature (252)..(252): Xaa can be any naturally occurring amino acid
  misc_feature (256)..(256): Xaa can be any naturally occurring amino acid
  misc_feature (276)..(276): Xaa can be any naturally occurring amino acid
  misc_feature (306)..(306): Xaa can be any naturally occurring amino acid
  misc_feature (315)..(316): Xaa can be any naturally occurring amino acid
  unsure (1)..(324): unsure at all Xaa locations
XEGLKQLKDLPAETPDGKKVXLAANIGTPKDVASALANGAEGVGLFRTEFLYXDRNSLPSEEEQFEAYKEVVEKXGGRPVTIRTLDIGGDKELPYLDXPKEXNPFLGYRAIRLCLDRPDIFKTQLRAILRASAYGNVQIXYPXISSVEEVRKANSILEEVKAELDREGVKYDKEIKVGIXVEIPSAAVTADILAKEVDFFSIGTNDLTQYTLAVDRXNEHVKEYYQPFHPAILRLVKXVIDAAHKEGKFAAXCGEXAGDPLAAVILLGLGLDEFSXSATSIPEIKNIIRNVEYEKAKEIAEKALNXSEAREIEKXXKDVIKDIG

SEQ ID NO: 24946 - protein, 289 aa, Medicago truncatula
MSVSTACLVGEKKVGREKETLVLIYEEIRGVLKIFLQNEICDAVTYTEHARRKTLTAMDVVYQGRTLYSFGVPLEIDESTKIRTFGHYARILIDLDLSQPILNNLLVGREESAFFVKIEYEKQPLFCNNCKHIRHSIQNCKKIAQNSIDLFKENKENTVTKSHHYGKSNVRFKHIDRPSETDNLAGSLKTKLNMIHDTHLDNRIDVIKGRAKLAEQSGAMIGSAKQSKESDVGRTENLTCNNHEVHNVVQELDTVNSDAGASVEVKHMSKSKKQKTKQKKHKAKNIEWW

SEQ ID NO: 24947 - protein, 224 aa, Pseudomonas putida GB-1
MTQDQLKQAVAQAAVDFILPKLDEKSVVGVGTGSTANFFIDALAQHKTAFDGAVASSEATAQRLKGHGIPVYELNSVSELEFYVDGADESDAHLNLIKGGGAALTREKIVAAVAKTFICIADGSKLVPVLGAFPLPVEVIPMARSHVARQLVKLGGDPVYREGVVTDNGNVILDVHNLQITNPVELEAQINAIVGVVTNGLFAARPADLLLLGTSEGVKSLKAE

SEQ ID NO: 24948 - protein, 250 aa, Arabidopsis thaliana
SKITTEALRWWEDGETVGGRDLVGGGTWLGCTRHGRLAFLTNFKEASSFPAAKSRGDLPLRYLQSEKSPAEFAEEIQDEISLYNGFNLVVAHVLSKSMIYITNRPPHGDKLVTQVSPGIHVLSNANLDSPWPKCLRLREGFQQLLAENGSGEFPVKTMVEEVMTNTVKDEETELPHVFTPETEYHLSSIFVDMQRPTGRYGTRSISAIIVKSHGDGGGDGEICFYERHLEEGDSWKEHTQQFVIIQNQSI

SEQ ID NO: 24949 - protein, 280 aa, Triticum aestivum
MDQYEKVEKIGEGTYGVVYKAKDRYTNETIALKKIRLEQEDEGVPSTAIREISLLKEMQHRNIVRLQDVVHNEKCIYLVFEYLDLDLKKHMDSSADFKNHHIVKSFLYQILHGIAYCHSHRVLHRDLKPQNLLIDRRTNSLKLADFGLARAFGIPVRTFTHEVVTLWYRAPEILLGARQYSTPVDVWSVGCIFAEMVNQKPLFPGDSEIDELFKIFRIMGTPNEETWPGVSSLPDYKSAFPKWPSVDLATVVPTLEPLGLDLLSKMLCLDPTRRINARTA

SEQ ID NO: 24950 - protein, 759 aa, Pseudomonas putida GB-1
MLNTLRKIVQEVNSAKDLKSALGIIVLRVKEAMGSQVCSVYLLDPETNRFVLMATEGLNKRSIGKVSMAPNEGLVGLVGTREEPLNLENAADHPRYRYFAETGEEKFASFLGAPIIHHRRVVGVLVIQQKERRQFDEGEEAFLVTMSAQLAGVIAHAEATGSIRGLGRQGKGIQEARFVGVPGSPGAAVGRAVVMLPPADLEVVPDKTVDDIDAELKLFQNALEGVRDDMRKLSAKLATQLRPEERALFDVYLMMLEDAALGGEVTEVIKTGQWAQGALRQVVGEHVNRFELMDDDYLRERASDVKDLGRRLLAYLQEARSQSLVYADNTILVSEELTPAMLGEVPEGKLVGLVSVLGSGNSHVAILARAMGIPTVMGLVDLPYSKVDGIELIVDGYKGEVFTNPSEVLRKQYSEVVEEERQLAQGLDALRELPCVTPDGHRMPLWVNTGLLADVARAQQRGAEGVGLYRTEVPFMINQRFPSEKEQLAIYREQLAAFHPLPVTMRTLDIGGDKALSYFPIKEENPFLGWRGIRVTLDHPEIFLVQTRAMLKASEGLNNLRILLPMISGIHELEEALHLIHRAWGEVRDEGTDVPMPPVGVMVEIPAAVYQTKELARQVDFLSVGSNDLTQYLLAVDRNNPRVADLYDYLHPAVLQALNTVVRDAHGEGKPVSICGEMAGDPAAAILLMAMGFDSLSMNATNLPKVKWMLRQVNMSKATELLAEALSHDNPQVIHSSLQLALKNLGLARMIGPGANKTL

SEQ ID NO: 24951 - protein, 248 aa, Pseudomonas putida GB-1
MCLIVFAWRPGHALPLIVAANRDEFYARPTQPLAAWDDAPGVHAGRDLEAGGTWLGVGPQGRFAALTNIRDPGHALGPRSRGELVAAYLQGEMGVEAYLGQVASRSGQYSGFNLLVGDGQQLGYLNAREATPRLLHAGVYGLSNAGLDTPWPKLVKARSGLEGLLEAPEPHRLLALLADNEPAAEGDLPETGVGVATEKLLSSVFIASQNYGTRASTVLIVDDQGKRRLVERSFGPFGGHLGEVELTV

SEQ ID NO: 24952 - protein, 1271 aa, Mycobacterium sp. JLS
MAVTRTACSYCGVGCGIEVHTGSEGGRPVIARVSGDRLHPTNSGRLCTKGATHAEMMNATDGRLTSALLRPTRHEEPVPAPVDDAVAEAGRRLRAIIDEHGADAVALYVSGQMSLESQYLATKLAKGFLRTKYLESNSRLCMASAATGYKQSLGADGPPGSYTDFDVTNLFFVIGSNMADCHPILHQRMVDRLKTGAKLIVVDPRRTATADRADLYLPIRPGTDVALLNGLLHLLVERGDIDEEFIAEHTEGWAHMPEFLADYAPARVAAITGLAEADLHRAAAMIAEAGDWVTCWAVGMNQSTHGTANTNAICNLHLATGAICRPGAGPMSLTGQPNAMGGREMGYMGPGLPGQRSILSAEDRAFVEQRWGLPPGTIRTDAGPGAVDMFERLAAGEIKACWIICTNPVATMPNRRTTIAGLEAAELVITQDVYRDTATNRYADIVLPATLWAESDQVMVNSDRTLTLLQQAVPPPGQTRPDWQLICRIAAELGFGADFTYTDSAQIFDEIREFSNRRTGFDLRGATYDRLRETPLQWPVPPDDGADRHPIRYLNDGVSQDLHVDASGHRPRLAFPTPSRRAVFYARPHVDAAELPDGDFPFVLNTGRLPHQWHTMTKTGRVRALVKLDGRPFVEVHPHDAAALDIVDGQSVELTSRRGRAVLPAVVSDRVMPGNCFAPFHFNDEHGEYLTVNALTNDAVDPDSLQPEFKVCAVALRPVQTVAAPTEERRTPAPEPVASDGPLVLWASQTGTAEDFATDVAARLPGAQLVTMDELPLLRLAEARDVVVITSTFGDGGPPDNGADFFDRLQGPDAPKLDHIRFAVLGIGDRSYSDFCGHARSLDGRLASLGATRMLDRVDCEAYDQDRMEHWAQQMTHLLNPDGVDSDGGGVTTRRRTTTVAEPFTRARPLLAPLARNTLLTPAESRKEVRHFGFDISEYDVTYAAGDSLGVYATNSAVAVDAWLAATGLDGSEKVDVDGAEHSLRDALTVSYDFCRVTPDLMRFVAEQCRDRSAAKRLRAARADLDAWLVDRNGLDVVREFEVRADPRQWQEVLVRLTPRQFSISSSPLVSPHEVQLTVSVVRYRGSDGGERGGVASTFLADRATAPLPVFLQRSPHFRPPRDGVTPMIMVGPGTGIAPFRAFLQERRALGHTGPNWLFFGDRHRDENFYYRDDLEDMVTDGFLRLDLAFSRDQPKPVYVQHRMLEHGAEVWRWLERGAHLYVCGDAARMAKDVDAALTTIIRKHGGLSESAAREYKKSLVAGKRYLRDVY

SEQ ID NO: 24953 - protein, 383 aa, Triticum aestivum
  misc_feature (214)..(214): Xaa can be any naturally occurring amino acid
  misc_feature (287)..(287): Xaa can be any naturally occurring amino acid
  misc_feature (324)..(324): Xaa can be any naturally occurring amino acid
  misc_feature (354)..(354): Xaa can be any naturally occurring amino acid
  unsure (1)..(383): unsure at all Xaa locations
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGXARMAGASRIIGVDLNPAKYEQAKKFGCTDFVNPKDHSKPVQEVLVEMTNGGVDRAVECTGHIDAMIAAFECVXHDGWGVAVLVGVPHKEAVFKTYPMNFLNERTLKGTFXFGNYKPRTDLPEVVEMYMRKELELEKFITXHSVPFSQINTAFDLMLKGEGLRCIMRMDQ

SEQ ID NO: 24954 - protein, 108 aa, Glycine max
  misc_feature (28)..(28): Xaa can be any naturally occurring amino acid
  misc_feature (87)..(87): Xaa can be any naturally occurring amino acid
  unsure (1)..(108): unsure at all Xaa locations
GDHTCHNYAFELSDSLYYDKREDEEREXLLKEMSKDSIIHLARHIYRLDIGQRVRGIKWDLKYFIGPKGPINYSFEKVPWRERCTGXTHSLRRYATGEERRIAHKLSK

SEQ ID NO: 24955 - protein, 185 aa, Brassica napus
  misc_feature (10)..(10): Xaa can be any naturally occurring amino acid
  misc_feature (50)..(50): Xaa can be any naturally occurring amino acid
  unsure (1)..(185): unsure at all Xaa locations
DKADYYAHPXEHYNPVFHDKIAPYTSVLVNCMYWEKKFPRLLSTKQVQDXAEKGCPLVGICDITCDIGGSVEFVNRATSIDSPFFRFNPIKKSYYNDMDGDGVLRMAIDILPTEFAKEASQHFGDILSEFVGSLASMTEVADLPGHLKRACISHRGELTPLYEHIPRIMKSDPEDVQDNIANSVS

SEQ ID NO: 24956 - protein, 636 aa, Ustilago maydis 521
MVTHVASGAAATAMTVPKHVRREARQPKTLTRAQLAERIANGETLVLHRRKIYKLDRWLSSHPGGELAILHFVGRDATDEIEAYHSDDTLSRLMSRFVVGYLDQADWHDYRPLVPPVQLGYRKGKLDHPHAQVAMWRHRNTPSASVVSSNRESQEPEPGSDSSEEALVDSLVSTSSAHSPLQRPVLSTKSSPPCAVTTTVSSTLIVERPDAFPLPVDLLEPPPDPESIDPAREHKISQAYQRLHQQVKEAGLYTLHPIGYAREMTRYVLLASIAYAFWSRGQAQLRLEHSSADPTSFWNSSTSSFLLSSLFLGLFWHQLTFSAHDSGHSGITHSWQWDRLIGTAIADFIGGLSIGWWCDNHDVHHLVTNHPEHDPDIQHMPFFAISPQFVLAGQTTVINGNSGIGAPSSEPSKPLGLWSSYYRRVLEFDLPSRFLLKHQHKLYYIVMAFGRFNLYANSYGFLATKARRDRWWALELVGLLTFWSWYGFGLLGSLPTWPVRIGYLMISHIVTSPLHVQIVLSHFAQSCDDLGLSESFASRQIRTTMDVDCPPWLDFIHGGLHMQVSHHLFPRIPRHNLREVRDRFVVPFAKEWGLEYHEYGFTKGNGRVLTTLKKVADQVHILAKVAEAQAKGEIQH

SEQ ID NO: 24957 - protein, 435 aa, Burkholderia vietnamiensis G4
MSDSYFPRWRVQPAGAASRMVGPDERLAWPQMVAMGVQHVVAMFGSTVLAPLLMGFDPNLCIFMSGIGTLLFFVLVGGRVPSYLGSSFAFIGLVIAVTGYGGSGPNPNIPVALGGIVACGVVYVALGALVQAIGTRWIETLMPPVVTGAVVAVIGLNLAPIAVRGVSASTFDSVMALVTVLCVGGVAVFARGMVQRLLILVGLVIAYAIYAVATNGMGLGKPIDFSIVAHAAWFGVPRFRAPVFDPHAMLMLAPIAVILVAENLGHIKAVSAMTGTNLDRYVGRAFIGDGLATIVSGSVGGTGVTTYAENIGVMAVTRIYSTLVFALAALIAIGLGFSPKFGAVIQTIPGPVLGGVSIVVFGLIAVTGARIWVVNKVDFSDNRNLIVAAVTLVLGAGDFSLKFGGFALGGIGTATFGAIILYAILRKEKEPGPVV

SEQ ID NO: 24958 - protein, 333 aa, Methanocaldococcus jannaschii DSM 2661
MHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 24959 - protein, 972 aa, Ustilago maydis 521
MDWDHNVTFSAVRSLQATTAVAQATDNVVDLDRNRVDSRPGVLPTKNESSPHSSASLPPPSPHPPPPPAFTPSPSPSPSPSPQTATARSSVTDAAPAPKRSPRSPLHSNGSFPPVSDPISSIDSRDALDIDHESTAMLASSSSARKSKPKLQPQLINHLPLAQQAAMATFHEITFNDYHDKKLGRPPGKFDDYMICDCTPNSGNLDMACTDYSGCINRMTQIECSASKCRWGKQCRNQRFHRRQYVDVDIVQTEKKGFGLRACQDIPKETFIYEYVGEVMNQTTFLQRMQQYRIEGIRHFYFMMLQPNEYLDATKKGGKGRFINHSCNPNCAVSKWQVGKHLRMGIFAKRNIQKGEELTFNYNVDRYGNDAQECFCGEPNCVGTLGGKTQTDLSGMDDLFLDALGISDEVEQTEAKGSRRKRGKRLDLDFIPQMRAIQEHEATRVMTAARQAGPKREILEKLLRRMEMTTDVNVQKSLVKLHGFILMQFLLEQWWNDRDIVILIINVLARWPLIARNKVIDCGVEDQVRILAQTYRPRSPEDQKPSLDALRQVKQDDSAADRNDYTQVQPTLAPVRIGAPPAPDAEVSARAEHLLEAWKKLDMTYRIARKDALKPDADDHKDATAVTTWIDRRRMQDLDDPLDLEHAQAPNAVSSELGNALSGDQELREIKPSWQPPPAPPSMPNAPAKRMGGAVHHRSPPGSFTPTRLQSSGQSPLTPDQVTSVLSSSLVKSLSGLVSSLKQQGIQLQQQQQQQPPAQQQPSAQPAAPSAKSIEDIIREANEQEERARKEAEAAAKAARELEVNGGQTSGSSRKRPSSASRHSDKRAKHSSLSSSSQAASKLISSNGSAADSTSKAGSVESVAANERRLRKLVGELVVRQMSKYKDDLERESFKRHAKELTNAIVGKEMRNPKSWPPARGALTELSLDKRAKIKAFAKEYIDKLLARKGKGKGSSTPSNNEGAGSSNNGIV

SEQ ID NO: 24960 - protein, 340 aa, Oryza sativa (japonica cultivar-group)
MGQQQQQENLTLLPMSSSSAAAAADAAAASSPAASAGRLFTAGLVASWYASNIGVLLLNKFLLSTYGFRYPVFLTACHMSACALLSYAAAAASAAAPRGCAAAPLQGAARQGGAARGGVLRLRGRRDVSLRYLPVSFNQAVGATTPFFTAVLAYAVAARREACATYAALIPVVAGVVIATGGEPSFHLFGFIMCIGATAARALKTVLQGILLSSEEEKLNPMELLGYMAPVAVVLLIPATFIMERNVLTMVTALAREDPSFIWILLCNSSLAYFVNLTNFLVTKHTSPLTLQVLGNAKGAVAVVVSILIFRNPVTFMGMLGYGITVAGVVLYGEAKKRSK

SEQ ID NO: 24961 - protein, 172 aa, Coffea canephora
MAQYGAEYGNQKSQYDEYGNPVRQTDEYGNPARHGGTMGDYGTTGTTGAYGGTTGAHGTYATGTTGTTGTGAYATQPGTDVGKEHHGLGGMLHRSGSGSSSSSEDDGQGGRRKKGMKEKIKEKLPGGHKEAQPGQEYSSATAAPGYGGEGVQHEKKGIMDKIKEKLPGGHHN

SEQ ID NO: 24962 - protein, 448 aa, Pyrobaculum aerophilum str. IM2
MPKWHWPISPDDVPKIVVEPPGPKALEIVKRDEELIMQSFARWYPLVIARGYGPVVEDVDGNLYVDFNSGIAVTNVGHAHPKVVEAIKRQAELFLHYSLTDFYYEIAVKLAERLVSIAPISGRKKVFFTNSGTESVEGVLKIARGYFKGQRPYVIAFLGAFHGRTYGSMSLTASKPVHRRHFSPLVPNVIHAPYPHPVRCPFKASDPEECGEYALAFIEDWIFKRLVDPSEVSLVIIEPIQGEGGYVVPPKNFIQGLRKLTQKHGILFAVDEVQTGFGRTGKWFAVEHFGVEPDLIATAKAIAAGLPLGAIIGRAEVMSLPRGAHANTFGGNPVAAAAALASIEVIEEEGLLHHAQTLGEELKKFFKDEVGEKHDVRGLGLMIGIELLDERKKPAGYLDEVLLKAFKRGVAVIGAGISTVRVAPPLVIPRDMALRAAALITEILRRYR

SEQ ID NO: 24963 - protein, 175 aa, Coffea canephora
MAQYGAEYGNQKSQYDEYGNPVRQTDEYGNPARHGGTMGDYGTTGTTGAYGGTTGTAGAHGTYATGTTGTTGTGAYATQPGTDVGKERHGLGGMLHRSGSGSSSSSEDDGQGGRRKKGMKEKIKEKLPGGHKEAQPGQEYSSATAAPGYGGEGEQHEKKGIMDKIKEKLPGGHRN

SEQ ID NO: 24964 - protein, 359 aa, Oryza sativa (japonica cultivar-group)
MPLLLRCSPAASPPLLPRRRSGSLLSAAPPGRRPLLPAAAGRVVLGCGLVTLDYLATVDAYPRPDDKIRSGELQVSGGGNAGNALTGAARLGLNTRLISKVANDEIGGTVLSELKEAGIDISHVIISDGGNTTFVYVIIDKQTKTRTCIITSGYPPMIPSDLRMSSLSAALQDVSLLYLDGYSDEMALAVAKQADQMKIPILVDAEPERTREELGGLLSLASYIVCNGKFPEKWTSVPSIPSALLEILLQYPRACFAVVTLGENGCMMLERGKDGENYETEPVDIENVAESLRLKVDKDDILPTCVSSKFMRLTARGSGNIFARLLIGTAESIPASELVDTTGCGDAFIGAVLHGRHQM

SEQ ID NO: 24965 - protein, 512 aa, Triticum aestivum
MVSFWSFLLSYPEVFLAIACFFCLSLFRLVRHCHKSDLPVNWPVIGMLPFLVRNLYQIHDSVTDMLREAGCTFRIIGPWFLNMSFLATCDPATVNHCFNTNFNNYPKGSEFAEMFDILGDGLLVADSESWEYQRRVAMQVFASRAFRSFSMSTITRKAGTVLLPFLDHMAKHGSQVELEGIFMRFSLDVSYSTVFATDLDCLSVSHPIPAFGQATKEVEEGMLFRHVVPPSLWKLLRMLKVGSEKKMADARVVIDKFIYEEIAKWKAQANKECQGDVLSMYMNWPMDPSMSEQQKTLFLRDTVVGFIFAGKDLIAVTLTWFFYMMCKHPHVEAKILEEIKALQSTTWPGNLSVFECDKLRPAIYLQAALLETLRLFPATPFEEKEALNDDVLPDGTMVSKGTRIVFSLYAMGRIKGIWGKDCMEFRPERWISKSGRLRHEPSYKFLSFNSGPRSCLGKDLGLSNMKMAAASIIYNFKVELVEGHAVMPESAVILHTRNGMMVRLKRRELVAA

SEQ ID NO: 24966 - protein, 210 aa, Mycobacterium tuberculosis H37Rv
MTTTQTAKASRRARIERRTRESDIVIELDLDGTGQVAVDTGVPFYDHMLTALGSHASFDLTVRATGDVEIEAHHTIEDTAIALGTALGQALGDKRGIRRFGDAFIPMDETLAHAAVDLSGRPYCVHTGEPDHLQHTTIAGSSVPYHTVINRHVFESLAANARIALHVRVLYGRDPHHITEAQYKAVARALRQAVEPDPRVSGVPSTKGAL

SEQ ID NO: 24967 - protein, 474 aa, Bacillus cereus E33L
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERMNEFLSKLRKAMETVVVGDPLIEETDVSALISKKDVERIDNWVQEAVKEGANVLYGGNKRDERVFEPTVLTNVPEHVSVQCQEVFGPLMTVNTFKEFNEAIEQVNNSRYGLQAGVFTNNLFKAMRAIDELEVGGVMINDIPTFRVDHMPYGGVKESGTGREGIKYAIEEMTEMKLVCIKK

SEQ ID NO: 24968 - protein, 819 aa, Mycobacterium sp. JLS
MTRRRLVVIGNGMAGVRAIEEILARGGADMFEITVFGDEPYGNYNRILLSNVLSGSDDTSEIYLNPLDWYTGNGIDLRAGVRVVRIDRYARLVHADDGTALHYDELIVATGSRSFFPPITGLWADDKTLADGVFGFRTLDDCLGMIHEAEHRTKAVVIGGGLLGLEAARGLQNRGLTVDVVHAGATLMNAQLDDTAGAILRRSVERLGITVHMDKRTTEALLGEDGKLRGIGFSDGSTVDCDMLVVAAGIRPNVGLAQRAGLTVERAIVVDDHMRSIDDDHIHVVGECAQHRGQVYGLVAPLWEQAGVLAAHLTGTDPTAAYHGSRTATKLKVAGVDVAAMGLKAPELPDDEFVQYSEPRHGVYKTIVIRDGKLVGATLLGDVSKVSFLTQAFDTGLPLPEERVSLMFDIGTPDVEVGVAELADDAQVCNCNGVSKGTLVGCVRDGESSVAGVMAKTKAGKGCGSCKELVGQIVEWAAGGAVTEDPSASWYVPGVPYDKPTLMRHIRELRLHSVSSVFAALAPDGREDAGSKMALASLLEMMWADEFVDERDARFINDRVHANIQRDGTFSVVPQMKGGVANPWQLRRIADVADKYSIPMIKLTGGQRIDLLGVRKEDLPAVWADLDMPSGYAYGKSFRTVKTCVGSDFCRFGVGDSTALGIAIEDRYKGLASPAKMKLAVTGCPRNCAESLCKDLGVVAIDGGRWEIYVGGAAGAHIRKGDLLATVDSPDEVMTLTGRFLQYYRENANWLERTYAFVPRVGIEKIRDAIAEDAEGLDQRMQKSVDAYRDPWHDGRAPATEGQFRSSLPLLPLPQVPVR

SEQ ID NO: 24969 - protein, 355 aa, Medicago truncatula
MASFLSLSLPKLNLIKASSAATTTTPLSTPEALNDKFGRKGIKFLESNSIPIVELTVRNGSSLSLRLPDAHVTSYKPKVFWKDDGLEELLYTIPANETGLYKAKGGIGLVLNEVLQPGAKELLPSTLEWTVKDVDYDAIDALQVELISTNRFFDMTYIVSLYPVSMATAVIVKNKSPKPVTLTNAILSHFRFKRRGGAAIKGLQTCSYCSHPPLDSPFQILTPSEAMKSESQRLISFGAEPEMKPGSWTQQGVPITLLENKMSRVFAAPPKERTKAFYNTPPSKYEIIDQGREIFYRVIRMGFEDIYVSSPGSMSDKYGRDYFVCTGPASILEPVTVNPGEEFRGAQVIEHDNLS

SEQ ID NO: 24970 - protein, 520 aa, Hordeum vulgare subsp. vulgare
MIQTTLDKIIDSLTSVANAHRGDPNAAEISLKIGRVSECGIDDSVGKVRPKGLILGAGRVCRPAAEFLTSYQNIDQVHVVVASLYQKDAEETVDGIKNATAAQLDVSDTESLSNLVSQVDVVVSLLPASFHAAIARVCIELKKHSVTASYVDDSMSKLEQAAQGAGVTILCEMGLDPGIDHMLSMKMIDEAHAQNGKIKAFTSFCGGLPSPAAANNPLAYKFSWSPAGAIRAGRNPAVYKFLGEIINVDGSKLYESAKRLKLPELPAFALEHLPNRNSLMYGDLYGISKEASTVYRSTLRYEGFSEIMAILAKVGFFDAEDHPLLQETNRPTYRIFLNELLNVNNVSTSNTKVNGEETGGHDDELISRLMMLGHCKEKELAVKILKTIKFLGLHEETEIPKDCSSAFSVICQRMEQRMAYGHNEQDMVLLHHEVEVEYPDGRPTEKHQATLLEFGKTENGRSTTAMALTVGVPAAIGALLLLQNKVQRKGVIRPLQPEIYIPALEILEASGIKLIERVET

SEQ ID NO: 24971 - protein, 455 aa, Kluyveromyces lactis
MMMKWTHHRPNTGVSMSQPKIFRKKRQESRYHGGSQSRYQPNRPNNHHNTAGNVNVNRSLGKRNPRGKFNRPSNGPETSGSRFEGHGSIPRGPRAMGSSAESAGDSHSRNIFGKKPLALISFQDVKSSFQPLAQVGEGTYGKVYKAENVHTGKLIALKRLRLEQERDGFPITSIREIKLLQQLNHPNISLIHEIIVSDKNTISMGFQYMENDLSGMLMDKSIQFSDSNIKHLMKQLFVGLQYLHQQQIVHRDIKGSNLLIDNRGNLKITDFGLAKKLTDVSSPASNTNRVITHWYRPPELLLGATDYKYEVDCWGCGCLLVELFAGAAIFPGSNEVDQFQRILSIMGSPTLEQWPKMLDMPWWFMLVPQISKTYKNVFFDEFSKVPQDALDLASKLLRYDQDTRFTTTEALQHHYFTNEPKPQPLLLGPEFKGSHEYEVKKIRRKERERQKETTV

SEQ ID NO: 24972 - protein, 508 aa, Azoarcus sp. EbN1
MTSEANFAGLGLAEPLLRAISESGYTTPTPIQAQAIPLVLAGGDLLAAAQTGTGKTAGFTLPVLHRLSAAPAANPKAGRPRCLILTPTRELAAQVEESVRTYGKHLPTTSMVMFGGVGINPQIQALKKRVDILVATPGRLLDHVGQKTLDLSGVEILILDEADRMLDMGFIRDIRKILALLPKQRQNLLFSATFSDEIRSLANGLLHNPGCVEVARRNTASELVQQSVYSVAQKQKRDLLVHLVKQNDWHQVLVFTRTKHGANKLAEYLAKHGIPSAAIHGNKSQSARTRALAEFKDGSLPVLVATDIAARGLDIDQLPHVVNFELPNVPEDYVHRIGRTGRAGSSGAAVSFVDSEERQHLTAIERLIKRTIDREALPAFAIAPVDPNESDARPPRQPRQPSRHNNANAPRQARTDRPAGRQATPPSPSRAPVRSRDADNFGNRAPRSEVEAKRGHPDADGNRALRNAGPNGAPRSSDSARAAPRPDGNRRPQSRPALFNAKTDDRNR

SEQ ID NO: 24973 - protein, 425 aa, Triticum aestivum
MSAMQSSYLPATTESIAMAQEAKDASESILILYRVLEDPSSSSDAVRTKEVAITNLTNYLTKENRAEELRNLLTQLRPFFALIPKAKTAKIVRGIIDAVSKIPGTSDLQISLCKEMVEWTRAEKRTFLRQRVEARLAALLLESQEYTEALTLLPGLIKEVRRLDDRLLLVDIDLLESKLHFSLRNLPKAKASLTAARTAANAIYVPPAQQGTIDLQSGILHAEEKDYKTAYSYFFEAFEGFNALDDPKAIFCLKYMLLCKIMVNQADDVAGVISSKAGLKYVGPDVDAMKAVADAYSKRSLKYFETALGDYKAQLEEDPIVHRHLSSLYDTLLEQNLCRLIEAYSRVEIAHVAEMIELPIEHVEKKLSQMILDKKFAGTLDQGAGCLIIFEDAKTEAIFPATLETISNVGKVVESLYMRSAKIMA

SEQ ID NO: 24974 - protein, 924 aa, Oryza sativa (japonica cultivar-group)
MPSASAALVLLFVAFSLSNAQPGFISLDCGGDDDYTDGIGIQWTSDAKFVSAGQKANLLLQNQQLQQYTTVRSFPADNRKYCYTMNVRNRTRYLVRATFLYGNFDNSNVYPKFDLSLGPTPWTTVVIDDATTPVVQEAIILAAAPTLSVCLSNASTGQPFISTLELRQFNGSLYYTTDEKQFFLRLSARINFGAESNASVRYPDDPFDRIWESDLVRRANYLVDVAPGTERISTTKPIFVSTNEEPPQRVMQTAVVGKNGSLTYRIDLEDFPGNAWGVSYFAEIEDLTPNQTRKFKLVIPGKPEFSKPTVDVEENAQGKYRLYEPGYTNIPLPFVFSFGFKKTNDSSEGPILNAMEIYKYIEISVGSQDANIMASLVSRYPEAGWAQEGGDPCLPASWSWVQCSSEAAPRIFSISLSGKNITGSIPVELTKLSGLVELKLDGNSFTGQIPDFTGCHDLQYIHLEDNQLTGALPPSLGELPNLKEFFSGNSDLRMGHSNTGRTIVIIVCAVVGAILILVAAIVCYLFTCKRKKKSSDETVVIAAPAKKLGSFFSEVATESAHRFALSEIEDATDKFDRRIGSGGFGIVYYGKLTDGREIAVKLLTNDSYQGIREFLNEVTLLSRIHHRNLVSFLGYSQQDGKNILVYEFMHNGTLKEHLRGGPDDVKINSWVKRLEIAEDAAKGIEYLHTGCSPTIIHRDLKSSNILLDKNMRAKVADFGLSKPVVDGSHVSSIVRGTVGYLDPEYYISQQLTEKSDMYSFGVILLELISGHEPISNDNFGLHCRNIVEWARSHMESGDIHGIIDQSLDAGYDLQSVWKIAEVATMCVKPKGVLRPSISEVLKEIQDAIAIELQRELPSSIHHLMSKTSPSEAVNTTGSLQDLEQNASFDELLMRPGLRLNGTGRAAQAASEILNETAILVTSRC

SEQ ID NO: 24975 - protein, 356 aa, Zea mays
MAHAKAGASLPVPNVQALAQTWHGSGEPVPFRYVRTEEIVAGEVVAGCAIPVVDLSRLLDPRSSEEELANLGSACQHWGFFQLINHGVPDEVIQDTKKDMVEFFKLPVEAKKVHAQVPGGIEGYGQAFVFSETQKLDWADMIYLMISPKESRDLRFWPTRPPSFRDSIERYSAETAKVTACLLRFMAKDLGVEPERLLEEFRGLPQSMRTTYYPPCRLAADVLGLSPHTDATGLTLLLHVNDVQGLQIRRDGKWLAVDPLDGALVVSIGDILEILSNGRYRSIEHRAIVHPDKERISAAMFHQTCPNTTVGPLQELVERDSGGARYRSMDYMDFMKGFFAAKLDGRRSHMDALRIY

SEQ ID NO: 24976 - protein, 190 aa, Treponema pallidum subsp. pallidum str. Nichols
MRGIGRYHAPVDGHAALDRAIRKRIDFPKKGILYYDITGVLMNAAVFRYCLDQMVEFYRDEHVTAVAAIESRGFIFAAPFADRMGIPLILVRKAGKLPGDTYSCSYSLEYGKATVEVHKSDVVAGARVLLTDDLIATGGTLNAARTMLRAGGAEVVGFFAVVGLPFLRYHELIGDLPVRTLIEYNQETSN

SEQ ID NO: 24977 - protein, 565 aa, Candida glabrata CBS 138
MISTLPWTYWFLLFLAVLTVVRSPFVEANKKHVNDRMRVVCSGMYSKEARGGKVDPFIGFDLEKLYPTQHDYEPGVIAVIYDFRDYQHIGIELPNGEVQYVCDEYSIGKGLCKESQLNHFIIQDVIYDPFSDSTKGLSNEVLTFSHNYLGKHQSVYPVMKTGYYCVRTATISSSIRFDVAINFRNAFGKIDAAEIDNIRLYGWLSLGYLVSMSMYFFQLWKNKDDLLPLHRYIMIFFSFLTIETVSIWIYYLLKNEKGNITPTKVYMVFISLMSAGKASFTYFLLLIIALGYGIVYARLNKTLVNRCRAFAILNFFLYSAYLIQSYAQNPESTSITILITAVPTVLLMFVFFFLILRAITKTTSYLKGQRQTYKLSVYNRLLIVIYATLVCIFIGLILCAFAYLGMNAIEIIEKHWMIRFYLTDFWPSLVYFFAFISFAYIWRPTGTTFMLTTSQQQPEELENVMGLEMDDLDEFSDEFDMDDYAESETSEHRVHGINEAERQNIDDIFANNEPNMDDVFSDQNELQDTDVISNFSGHNSDEDLVPNASNTKQSINDIANPKTRK

SEQ ID NO: 24978 - protein, 339 aa, Zea mays
RARARIPLLSQQSDFVSLVYTRELERSSCLTYDYVGDDPEDSLVETDLNAVSALATLAASRPPAAAGVSHRDALQSCAHHARLWLSRADEPIHPDSTITYAGVRAKLDRIMASGYYTAQLEMRTPMDLAAAVANFGAGGVQVQESMVVSPQALEAVEESQDVEEHKDEKEDSQATEIYSDHQAPVVDAEHVDDEGLVNPADEVPSAEAEQETLDDYVDDQEQKDQQFTQRRSYQNQRSGGGGSRRGYPNGRGVRGGRGGGYQNSRGGGYQNGRGGSGYQNGRGGGGGYYESGYYQPRNYNNRGRGGRSGGGNSYYHSHGGGAQAGGHGHPGRVELGANA

SEQ ID NO: 24979 - protein, 457 aa, Saccharomyces cerevisiae
MTSEPEFQQAYDEIVSSVEDSKIFEKFPQYKKVLPIVSVPERIIQFRVTWENDNGEQEVAQGYRVQFNSAKGPYKGGLRFHPSVNLSILKFLGFEQIFKNALTGLDMGGGKGGLCVDLKGKSDNEIRRICYAFMRELSRHIGKDTDVPAGDIGVGGREIGYLFGAYRSYKNSWEGVLTGKGLNWGGSLIRPEATGFGLVYYTQAMIDYATNGKESFEGKRVTISGSGNVAQYAALKVIELGGIVVSLSDSKGCIISETGITSEQIHDIASAKIRFKSLEEIVDEYSTFSESKMKYVAGARPWTHVSNVDIALPCATQNEVSGDEAKALVASGVKFVAEGANMGSTPEAISVFETARSTATNAKDAVWFGPPKAANLGGVAVSGLEMAQNSQKVTWTAERVDQELKKIMINCFNDCIQAAQEYSTEKNTNTLPSLVKGANIASFVMVADAMLDQGDVF

SEQ ID NO: 24980 - protein, 416 aa, Treponema pallidum subsp. pallidum str. Nichols
MFGCSLRRRCFRRPAFVPVSRAHPVFLCVRANVDKDSLDGVIVAKKDYYEVLGISKTASGEEIKKAYRRLAIQFHPDRNQGNKEAEERFKEATEAYEVLIDAQKRAAYDRYGFDGLKDMHGAHGFNSSAFQGFEDIFGGGFSDIFENIFGTSSRRGGSGNDGSGGSGRGANLRYDLQISFEEAVYGKKSELHYVRDETCITCKGAGSASGGRKMCPDCKGTGQIRRSTGFFSIAQSCARCGGEGTIIESPCARCAGSGIERKKQKIIVSIPAGVEEGRRITIPRQGNAGRAGGAYGDLYVFVFVRAHEYFEREGADLYCATSISVTQAILGAQVTVRALDGSAQQVRVPAGTQGGALLRVKGMGVPLARGAGDLYVKVLVRIPTTLSARSRALLAEISQEEGENAHPPLLELSSLK

SEQ ID NO: 24981 - protein, 203 aa, Orpinomyces sp. PC-2
MNLSIKSVIFLAIVALATLVSASTNPKVTNKVYFDIRQGDKDLGRIVLGLYGEVVPKTVENFRALATGEKGYGYKNSKFHRVIKDFMIQGGDFTRGDGTGGKSIYGERFADENFKLRHTGPGILSMANAGRDTNGSQFFITTVTTSWLDGRHVVFGKVIEGMDVVTAIETTKTLPGDRPATPVIIADCGELPVSNNNDAKAEL

SEQ ID NO: 24982 - protein, 500 aa, Oryza sativa (japonica cultivar-group)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLLSENSSWLFISSAAFIYHCVGANITKARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 24983 - protein, 703 aa, Solanum lycopersicum
  misc_feature (621)..(621): Xaa can be any naturally occurring amino acid
  unsure (1)..(703): unsure at all Xaa locations
MGFHHIIIIRFVFSILLGWLSSSVEATNSTKCNQYCGAAGSYSPRVSYPFGFSEGCGIRLDCTESTGEIRIGEYIIQNVTSETLMVNFSMNCSRPIEDLQQFDRTNFGMTWRNGLLLHNCKVPKSECTIPSEILSTRLNIQSCDSKKENVSCYSEARADYLDYQKLKNTGCGTVISSILIGMDNDTMKSSAMFIEFQTMELAWGLEGDCACHNDANCTNVSLPGNRKGFRCRCKDGFVGDGFSDGDGCRKVSRCNPSRYLSGRCGGTTRIGVLVGGIIAGAGLMAALAVLCYCIRRRSASLKKRMSARRLLSEAAGSNSVHVFQYKEIERATNSFSEKQRLGIGAYGTVYAGKLHSDEWVAIKKLRHRDPDGVEQVMNEVKLLSSVSHPNLVRLLGCCIENGEQILVYEFMPNGTLAQHLQRERSSGLPWTIRLTIATETAHAIAHLHSAMNPPIYHRDIKSSNILLDYNFNSKVADFGLSRFGMTDDSHISTAPQGTPGYVDPQYHQNYHLSDKSDVYSFGVVLVEIITAMKVVDFSRSHSEINLAALAIDRIGKGRVDEIIDPFLEPHRDAWTLSSVHRVAELAFRCLAFHRDMRPSMTEVADELEQIRLSSWASLEDXVCMTSSVNSSCSSPRRRSETSFLCSTTKKGVGSRRLIVPLPLENSLALVEEIKNSSPVSVQDPGLSEESPPSPNRLLGNSGR

SEQ ID NO: 24984 - protein, 556 aa, Pseudomonas fluorescens PfO-1
MTEPEDPSRERLKHHFAQRVIHQARQILEIWQRLQRSEWSTADLAELSEANLRLLRFAERFEQPEHTQLARHISQSLEAVDANRGRLSSGLITDLNRLMQRLSRTGLRHGDQLDQTFLPPLRKPIYVMLQDHDRAERLAKQLEFFGLSAQALDSVSAFRSSMVERLPAAIVMDVDFSGAGVGLKLAAEAQQGLEEPLPLLFFSLHETDTPTRLAAVRAGGQEFLTGTLEASSLLEKIEVLTCVAQYEPYKVLIIDDSRAQALHTERLLNSAGIVTRTLIEPIQAMAELADFQPDLIILDMYMPACTGTELAKVIRHNDRYVSVPIIYLSAEDDLDKQLDAMSEGGDDFLTKPIKPRHLITTVRNRAARARNLKARMVRDSLTGLYNHTHILQLLEDCSFRARRENKPLSFAMLDIDHFKRVNDSHGHPMGDRVIKSLALFLKQRLRKTDFIGRYGGEEFAIVMPDTDIEAAHKVLDEIRQRFAEIHYPAQPQDLWCTFSAGVVEMHDDSDSLMMASQADEALYRAKGEGRNRVQTARDSKQSATFSSDSTQSVITV

SEQ ID NO: 24985 - protein, 263 aa, Medicago truncatula
MAIARTGVYVDDYLEYANTLPAELQRLLNTVRELDERSQSMINQTRQQTKYCMGFSSHGSKKGNHNYNNNYMNEDDDASIEKMRKEIEANQDSALSLCTEKVLLARQAYELIDSHVKRLDEDLTYFAEDLKQEGKISQDEPAILPPLPIVPKPEKRRHAYGTPQSKRLDYRERDWDRDFELMPPPGSHKKDYMIPMDIDQPIDPNEPTYCVCHQVSFGDMIACDNENCRGGEWFHYSCVGLTQETRFKGKWYCPTCRLLPQCQ

SEQ ID NO: 24986 - protein, 383 aa, Oryza sativa (indica cultivar-group)
MAIVDLVNAGEQQQMGSKRAAAEDGDGGVDDSREYYCRRGVRHLCDSGITRLPGNYVLPASDRPGQAAGAAAAAGGSVKLPVVDLSRLRVPSERGVVLRTLDAACREYGFFQVVNHGVGGEVVGGMLDVARRFFELPQPERERYMSADVRAPVRYGTSFNQVRDAVLCWRDFLKLACMPLAAVVESWPTSPADLREVASRYAEANQRVFMEVMEAALEALGVGGGGVMEDLAAGTQMMTVNCYPECPQPELTLGMPPHSDYGFLTLVLQDEVAGLQVMHAGEWLTVDPLPGSFVVNVGDHLEILSNGRYRSVLHRVKVNSRRLRVSVASFHSVAPERVVSPAPELIDDSHPRRYMDTDLATFLAYLASAAGNHKSFLHSRRLY

SEQ ID NO: 24987 - protein, 292 aa, Brassica napus
  misc_feature (98)..(98): Xaa can be any naturally occurring amino acid
  unsure (1)..(292): unsure at all Xaa locations
MSSMSSREKRRKRKREPSPESNPTPVSKPTPASTPQWSSPIPSLPYDLVLLCVARVSRLYYPTLSLVSKSFRSLVSSPELYKTRSLFGFTESCLYVCXQSLGGSADWYTLCRKPDKTLKSGSSGYALARVPVPNSPLWHCRNMVAVGSNIYNIAFPRSLNVLPRVSILDCKSHSWIEAPSLPVELHSFSASVVDHKIYVAGFDHRLMKNSFEVFDTQTRVWDSLSTSNTSAEREEMFIKKAISIDGKFHVVTDKEVLAYDPKLAKWDMVGRGMRELMYSKAYCVIRDVLYYA

SEQ ID NO: 24988 - protein, 198 aa, Triticum aestivum
MHPTRWELSHMVDLQAAALVISVVAAEVVEKVPSLKGGGALWFTDLTTPDALCIFPMITSLFIMLRFEVNYGVAAKRTERSRKMEDNIRQVVRATSLVPLLWTATLPQAISCSLVAWSGLTLAGKIVLKHPDVQKVLYGGPFLLKQECSSSDGQKGPTAEDSPPPVKEEEEPVSPETKKSSDASVHRDESDKTSTKDG

SEQ ID NO: 24989 - protein, 516 aa, Tortula ruralis
MRVGAMAVKFEREDYQFLTELGLAPENLGCYGGGVWRANGPTVTTINPSDNEPIATVREASLEDYEDSMKACADARRMWMLTPAPKRGEIVRQIGDGLRAKLPLLGKLVSLEMGKILPEGIGEVQEFIDMCDYAVGLSRQLSGSIIPSERPNHAMMEVWNPLGIVGVITAFNFPCAVLGWNACIALVCGNCVVWKGAPTTPLLTLATTRIIAEVFERNKLPGGIFTCACGGAEIGSAIAHDARIPLVSFTGSTKVGMLVQSIVHARHGKVLLELSGNNAIIVMDDAVLPLAIRAVLFAAVGTAGQRCTTCRRLIVHEKVYDDMLEGLLKAYKQVKVGNSVEGDTLCGPLHSKLSMSGFTEGIKKIKAQGGNILTGGSTINRAGNFVEPTLVEISHDAEVVREELFGPVLYVFKIKSLEEAIEMNNSVPQGLSSSIFTRNPETIFTWIGPTGSDCGIVNVNIPTNGAEIGGAFGGEKATGGGREAGSDSWKQYMHRATCTINYGKDLPLAQGINFGG

SEQ ID NO: 24990 - protein, 504 aa, Oryza sativa (japonica cultivar-group)
MSKPQQQSPPSTTTTSPPPPPPSTPPPASSSRSLLSALRRSPVTTLVAAFFLLALFMYGEDVRTLAELSIDDYLYPDADFYNVSALPPLLLPPPTCDLSRGRWVFDNTSLPAYREKECTFLTKQVSCLANGRPDDLWQYWRWQPNNCSLPTFDARRFMEKMRGKRMMFVGDSLNRNQWESLVCLVQPILSKGRKKIVKRGSFNIFYAKEYRATLEFYWAPFLVESNSDNPNFHHIDQRIISPERIESHANNWKDVDYLIFNTYIWWMNNEDIKVRRPNSTSWSDHDEVPRIETYGRVFKTWSTWLEQNVDPARTSVFFMTISPLHNSSKIGIGGRWFNTDAVITFCQFNIDEPCISATGSLELWNILKYRHRVRWFPAQWGNPNGIKCVKETLPVLNYTKPLDLNHDMRMYDLVAKVAKNMKNVPVSLIDITRMSDYRKDAHTSLYSIRQGKLLTPEQKADPQKYADCIHWCLPGVPDVWNQILYTRILSKSSPPSPHPPLPPQ

SEQ ID NO: 24991 - protein, 326 aa, Listeria monocytogenes str. 4b H7858
MQLHAMWDEYPALSKDLQEVLQTIEKNIQIRDKHVEQNVKDLIHAGGKLLRPAFALLSAQAGPDYDKERAVSIAAALEVLHMATLIHDDVVDDSPLRRGIPTIHSKYGRNYAVYTGDYLFCICFKILSAHASSVENIEFNSKNIEKILMGELDQMRTSYKMNVTVREYLTRISGKTAQLFALSCYSGATGSKATRMTVAKCYNIGHYLGMAFQIIDDVLDYTSTDEGLGKPVLNDMKQGIYSLPLIYAMKGHLAEFEPLLSQKLDMTDEASEQVLALISKYKGVEQAFKLANKYTNKALREIKKLPAGAYRDDMYRLTKNILDRDI

SEQ ID NO: 24992 - protein, 355 aa, Trichodesmium erythraeum IMS101
MQIVNSQISIEKTSHSRIKEQDINNTPFGKVFSDHMLVATYANNSWQEVKITPYGNISIRPSLSVLHYGQAVFEGLKAYKNYQGKPVLFRLEANYKRINNSAFRLCMPSIPKEIFIDGLKELIRLDTDWIPTKSDSALYIRPIYFATDESVGLKPANSYKFIILSSPTGTFYSAPVKLIVTDKYVRASEGGTGAAKCAGNYAGSFLADKEAKEQGYDNVLWLDGKEKKYIEECGTMNVAFVINDVLITPKLTGSILGGITRDSALTLFRDMGVKVEERLISIDEVAKAYEAGNISEAFGMGTAATIAHISVINYQGKDMILPPVDERKYASQVLQKLEDIKTGKVTDPYGWICQL

SEQ ID NO: 24993 - protein, 424 aa, Myxococcus xanthus DK 1622
MDTPVKKHPSLPRPIQGELKLDRSNQLLAEARRLVPGVTQSMMKRPEMFALGAFPVFLAKGKGALVEDVDGQEYIDFIGGLGANMLGHNDPAVVNAIREHLEEGVLHSLPTPVEVSAAQTLVDLIPGAEMARFFKTGADATSAAVRLARHITGKQKIITVGYNGWHDHFMFDTPGVPAALAALTLRMPLFTPPDEPALLASIEKNASELALVLLSVPYNRPLTPAFLQQVRATCTANNVLFALDEVVTGFRLAVGGAQEFFDVRADFVTLSKSIAGGMPLSAIAGPAKHLSRLSELQVSTTFGGELLSLYVCDAVLKGYRDGAYIQHLAHLGRKLREGVNAQAEAAGSSLRVIGYDAIPFFLFAKDPTEHAKQMQPFQAGMARRGILLRRDVTFLSTAHTEEQIDYAIEMTGEVLRSLAQPAAA

SEQ ID NO: 24994 - protein, 617 aa, Myxococcus xanthus DK 1622
MSSQATPTLRLLGIGASPGVAVGHAFILDRKRIRTPKLRLAEAEVEPERMRMKTAIDLSDRQLAELKEQITRTEGSDHALILEAHRLMLHDPMLVDEVNRLIIEDRINAEWAVRRVARKIKHLFDNIPDEYFRERRSDVDYVADRIIRNLMGQVVDEEVEVPAEAIVVAHDLSPADAALMARSGRVGGFVTDLGGQTSHTAIVARARETPAVVGAGRASEQISPGDLVAMDGIRGVVLVNPSDEQLAVFREEQRRYQESERLALATKDLPAVSTDGFQIRLNGNIEFLEEIPSLLAHGAEGIGLYRTEFMFLDRKTAPTEEEHYRAYRQVLEAMGGRPVTIRTLDLGGDKVPGKTKHEKEPNPAMGLRAIRYCLSNRELFRTQLRALLRASVHGNLRLMFPLICGVSELREARSELEACRTELGRAGVPVGKRFPVGIMVETPSAATIADRLAQEADFFSVGTNDLIQYSLAIDRQNREVAYLYRPLHLSVLRQLRGIIDAGRAANIPVSMCGEMAGDPLYTLVLLALGFDELSMTSGQIPVVKRFLRRVSRVDAMELLQNAMELTTAEEIERYVRTEMDRRFSETMEPGAPGVGNAEPADHEPSEHGASPSGRNTA

SEQ ID NO: 24995 - protein, 779 aa, Zea mays
MPPHKIETGHQDVVHDIAMDYYGKRLATASSDNTIKIIGVSGTSHQQLATLSGHQGPVWQVAWAHPKFGSMLASCSYDGRVIIWKEGSKPDEWALAHTFAEHKSSVNSIAWAPHELGLCLACGSSDGNISVFAARSDGGWDTTRIDQAHPVGVTSVSWAPAMAPGALISAGSSGQFEYVQKLASGGCDNTVKVWKLNNGSWRMDCFPALQMHKDWVRDVAWAPNLGLPKSTIASASQDGTVVIWTAAKEGEQWDGRVLYDFRTPVWRLSWSLTGNILAVSDGNNNVTLWKEAVDGEWQQATYLNHRAAPPPLPRHSGERAGADRWRLPLPSRRYALVSGFLVRTGTTPPSHGGLLRVDVPCRTVPAQVLVPIAAGSEPAEAFVPIAVLRRAGADVTVAAAGAGTGLRVHAMYGVTVVADASVADCADASYDLVVLPVRTRRQPETLARPMTLNDAQGGVPGADNLGGCAALEGIVRRHALGGGLCAAICAAPPLALARWGLLDGVKATAHPEFVDKFPAEVAGVDANVVVDGRVVTGRGPAAAMEFALALVDQLYGKGKVDEIAKPMMVRYEPGYAFEELNPVQWRCSGTPRVLIPVANGSEEMEVLVTVDVLRRAKADVVVASAEEVVVARHGTRIVADALLQDAAGQQFDLIVVPASGRQLLCSSGGMPGVKTTLADKVELMALLKEHAAAGRAYGAIGAATAQVLEPHGLIGGSMKATTCASRADRPSECGSRVVVDGNLATSGSTGTAMEFALAVVEKLLGPEAAREVAEALLFV

SEQ ID NO: 24996 - protein, 405 aa, Myxococcus xanthus DK 1622
MPAPGIRVLPRPTGPGRTPQSNRASHLFPRSGTPGPIMAETSSLNIPTVDLADLASDDSARVERAAAAIREAFGVFGLVYLKNHGVDTQALNRFYDAFAAFIARPAEEKKPYGRADIWYQRGWTPPNTEVAVASNGQPDFKECYFVAPYPNDAQSALEFPELYPENVWPQNAPPYFEDGIMTLGRSLHEAGLKLLRGSAVALGLPETLFTDLCDRAAHVTRALQYLPLTNTQVNTDIVWGEEHTDFNLLTLLPGGRFLDPDGSPAPGPDNKSGLYLRTRATPEAPNGLKVRGTAPAGCIVAQVGQQLEILTGGTFLATPHVITAPGVPGWQRQSAAHFMHVHTNTVLFPLEKFRSADAVRNYAPPVLAGTYDIKTLVDIGLAPASALDKLGYRHYDRLNRQRAGT

SEQ ID NO: 24997 - protein, 297 aa, Candida glabrata CBS 138
MSIEETDSQVVITHPSNSNTSVTILKYGATVTSWKLNGEEQLWLSTAAKLDGSKPVRGGIPLVFPVFGKNQSDELLSKLPQHGFARNSTWEFLGQVKSNPPTVQFGLNPKIANQELVKLWPLDFNLILTIELGEDFLKTAIEVENASEENMKFNWLFHTYLHIEDIEDTMVSNLVGMKVYDQLLKESFIDKHPVVTFHQETDSIYQNVDSDRLIQVVGKGKPLHTVKRENLPDAVVWNPWVDKSAGMGDFEPKDGFKNMVCVEPGHVSDFVVLPPGQKWSAAQILSKQELNYQAIEP

SEQ ID NO: 24998 - protein, 147 aa, Glycine max
FPSVWGTLTFWPHRSATVLLQLCSHGEHVVASRTLYGGTHALLSHFLPRTCGISTSFVEVTDLDMVDAAIVEGKTKVLYFESVSNPTLTVANIPELCHMAHRKGVTVVVDNTFAPMVLSPARLGADVVVHSISKFISGGADIIAGAV

SEQ ID NO: 24999 - protein, 323 aa, marine gamma proteobacterium HTCC2080
MLNDEALLTSGRRTLTLEGQAVTKLAESLSPSFAAACQLILKTQGRVIVTGMGKSGHIAHKIAATLASTGTPAFFVHPGEASHGDMGMITQRDTVLALSNSGTTPEILTLLPLLKRLGVKLVSLTGHAESALACASDVHVDAGVDTEACPLDLAPTSSTTAALAMGDALAIALLESRGFTEEDFAFSHPGGALGKRLLLRVEDLMIKGTDIPLVEPTATLAEALMEITAKGLGMTIVGENGQLKGIFTDGDLRRALEEQPDINSVAITALMSASVKTLPAGHLAAEAMHIMEKNRISSLVVTDAQEQIAGVIHLMALLKAGIN

SEQ ID NO: 25000 - protein, 498 aa, Magnaporthe grisea 70-15
MSKNSSAYGTPAGDTSFRKTRNPEEYAARAKERDESEAAERKARYEAKLAGKKYHKPMTGDEEFTSARSEMMDFSAQVGKTMLVPAGAGQGKRGRGAGFYCEACDLTFKDNIQMLEHINTPQHQIATGRNMNVQAATAEEVHERIEKLWRRQENRKKQTVFKLDERLELRKEEEEKEREEKRRKRHELAERKRAEKEAASQVKTEYGDDVRIEGEHEEDDMMAMMGIAGFGTSKQKQTANIGSRRLFQRALQHVVRETDSHEYAHHSWKAATLLIMNRSINLTPGPARPWPLYSAWGSRTPSPQGSPLRCACRHTLAAMSYNGASSSSQSTSAAALLLGRQLKQMQRDNNPRFSVGLVNDSNLFEWNVMLMIDDDVKFYGGANFRARLSFPPTYPHLPPSMTFQKPIPFHPNIYDNGVLCISILHPPEEDKYGYEAASERWSPVQTPETILLSVISLFSDLNVESPANVEAARLLREDPKEFRKIVRKCVRESTGEDL

SEQ ID NO: 25001 - protein, 293 aa, Magnaporthe grisea 70-15
MLYLIGLGLSDETDITVKGLEIVKTAARVYLEAYTSILLVDQKVLESYYGRSIEVADREMVESNSDEILRNAATEDVAFLVVGDPFGATTHTDLVIRARQLQIPIRTIPNASIMSAIGACGLQLYNFGQTVSMVFFTENWRPSSFYDRVAENRALGLHTLVLLDIKVKEPNFESLARGKLVYEPPRFMTVGTCARQMLEVEEEKVKDGAEGGVCGGEALAIGAARVGGKTEKFVAGTLRELADGADELLGAPLHSLVLLGKKTHELEHDFVREFALNQDNWDRIWKADYQIQP

SEQ ID NO: 25002 - protein, 230 aa, Xanthobacter autotrophicus Py2
MATKPAKKPAAAAEKPAEKAPAPKAAAKAAPKAAAAKVAAPKSTAPKTAAAPAAAPKAAAPKAPAKAAAPKAAAPKAAAKPAAAPKAAAKPAAAKKAAAPKAAAEKPAAEKPAPKAVAAKSPAPKAASAKAAKPAAEKPAKAPAKAAAKPAAKSAAKPAEVKAPAKAATPKPAAKAAKPAAAKPAPAPAPEAKAAAPKAAAPKAAAKPAAKKAAAPKPAAAKAPKAAAKK

SEQ ID NO: 25003 - protein, 434 aa, Ralstonia eutropha JMP134
MDESETGSPVADTSTDTDANVPWYKLMGPGLITGAADDDPSGIVTYAQAGAQFGNGLLWSVLLTLPLMIAIQLVCARLGRISGRGIVANIRRHQSRPLAYAFVVLLVVANTLNVGADLAAMGDALALVLGGARWIYTLALAAGSLLLQLFMPYRRYAAYLKWLSLSLLVYIAAMFLLKIDWHAAALAMVWPRIEFSSAYLLMVVAVLGTTISPYLFVWQAAAEVEELDIDRTALPLHAAPEQARMNFRRINVDTVTGMVVSAVIALCIMLTTSYALHNSGILDIDSSAAAAKALEPVAGKWALLLFSAGIIGTGLMAVPVLAGSVGYAVAEAMRWRRSLEEKPLSARNFYAVIGITMVIGTALCWLPIEPAKMLVWSAVLNGIAAAPAMVMLQLMSRHKAVVGEFRTPGWVHSLAWLATATMWISLLVTIVFAL

SEQ ID NO: 25004 - protein, 779 aa, Bradyrhizobium japonicum
MYTTGRLEVRLKAGRHGVSTPQINADAGRNRIGCRGPDSPVARPAKPRARMMRQYDLVERVRSYNPNTNEDLLNRAYVYAMKAHGSQTRASGDPYFSHPLEVAAILTDLKLDDATIVAALLHDTIEDTEATRAEIDQIFGPEICALVEGLTKLKRLELVSREAKQAENLRKLLLAIADDVRVLLVKLADRLHNMRTLEFVPPESRRRIAEETLDIYAPLAGRMGMQEMREELEDLSFRTLDPEAYSVVMQRLDALAERNRNLIGEIEAQLSNNLRHRGLGARVYGRRKKPFSIWTKMERKSVGFEQLSDIFGFRVVVNDIEACYRALGIVHTTWPVVPGRFKDYISTPKQNDYRSIHTTVIGPGNQRAELQIRTEAMDQIAERGIAAHVFYKEGAGSPTEFLKRESNAFAWLRHTVGILSEMPTPRNSRAHKLEVELFHDQVFCFTPKQADRAAAPRQRQRDFAYAVHTDVGNSAVGCKINGKFSPLSSELQNGDEVEVLTSEAQSAPPSAWETLAVTGKARAAIRPPRHAHRRAHQYVGLGRRIVERLFERAKIEYADDKLKGALPRLARTSIEDVMAAVGRGEIRGLPRRASMYPDYKEERVARYGHQEGARRQAQGEGGLRAAANPGRDPDPRHQFRPAGEVRAERRAVPGDRIVGIVTPGEGITIYPIQAPALKDFEEEPERWLDVRWDIEDTAPQRFPARIRVENVNEPGALAQIATVIAEHDGNIDNISMQRRSPDFTEDDDRSRKVYGPEGSLERDPGPVAREGGRRPRRTC

SEQ ID NO: 25005 - protein, 387 aa, Oryza sativa (indica cultivar-group)
MAAEADARKVCGLPERVQLHGAMLALQFGYAGFHVVSRFALNMGISKLVFPVYRNIIALILLVPFAYFLEKKDRPQLTLSFVVQFFLLALCGITANQGFYLLGLDNTSPTFASAIQNSVPAITFAMAAALRIERVRLDRRDGVAKVLGTLACVAGASVITLYKGPTIFGPKLQLQAVAEVPLRAAIAGEGKNWTLGCVYLIGHCLSWSGWLVLQKPVLKKYPARLSVTSYTCFFGVIQFLIIAAFMERDADAWAFHSGSELFTILYAGFIASGVAFAVQIWCIDRGGPVFVAVYQPVQTLVVAIMASLTLGESFYLGGIIGAVFIIAGLYLVLWGKSHERARLAKDAAAIATDRDAAPCRIIAAGKQSSSVTQPLLLPTSSSSDNAV

SEQ ID NO: 25006 - protein, 901 aa, Medicago truncatula
MGASRKLQGEIDRVLKKVQEGVEVFDSIWNKVYDTDNANQKEKFEADLKKEIKKLQRYRDQIKTWIQSSEIKDKKVSASYEQALVDARKLIEREMERFKICEKETKTKAFSKEGLGQQPKTDPREKAKSETRDWLNNVVGELESQIDNFEAELEGLTVKKGKNRPSRLTHLETSITRHKAHIKKCELVLRLLDNDELSPEEVNDVKDFLDDYVERNQDDFDEFDDVDELYSSLPLDKVDTLEDLVTIPTSVAVAKTISSLPLDEGKTLEDLVTIPTGLAKVAPGLSLKTPLAASASQSASSQTSEQADETASQDSNSDIVAKTPPPKSGGISSSTSTPTGNHATPASVNVSGLNLSSAPAAAILPGSNSVRNILENAIVNQSTSPKEEEINNFPTRRPSPSLSDAALVRGRNSLSNQATASIPLGSGNTVSSIGALGVVPSASEITKRNILGADDRLGSSGMVQPLVSPLSNRLILPQIGKANDGAASVDSSIVNEAAAVSGRVFSPSVVPGMQWRPGSPFQNQNDAGQLRGRTEIAPDQREKFLQKFQQVQQQGPSTLLNMPSLVGGNHKQFSSQQQSPLLQQFNSQGSSVSSQSSMGLGAQSPSLGGISSVSLQQLNSVHSPSGQHPFAGVAKDADKFEEHQQHQNFPDESTTESTSSTGIGKNLTVEDDLKSAYALDSPAGLSASLPEAAQTFRDIDLSPGQPLQSNQSTGNLGVIGRRNGVELGAIGDSFGASSVNSGGVRDQLYNLQMLEAAHFRMPQPRDSERPRTYTPRHPAITPSSYPQVQAPIVNNPAFWERLGLEPFGTDTLFFAFYYQQNTYQQYLAAKELKKQSWRYHRKYNTWFQRHEEPKVATDDYEQGTYVYFDFHIANDDLQHGWCQRIKNDFTFEYNYLEDELV

SEQ ID NO: 25007 - protein, 266 aa, Glycine max
MAIPYPHFIATEKAAMDAGLLHPSSPSVILTQDDLKKIAAYKAVEYVESGMILGLGTGSTAKHAVDRIGELLRQGKLKDIVGIPTSTKTHEQALSLGIPLSDLDAHPAIDLAIDGADEVDPFLNLVKGRGGSLLREKMVEGACKKFIVIVDESKLVNYLGGSGLAMPVEVIKFCWRFTAARLQKLFEEAGCVARLRTFGEKEKEEPYVTDNGNFIVDLYFERSIGDLKAASDAILQLAGVVEHGMFLDMATTVIVAGELGLTVKNK

SEQ ID NO: 25008 - protein, 258 aa, Burkholderia xenovorans LB400
MNTNASPPDNPLSHLFDNNEAWVARKLSEDPEYFSRLAHQQTPEYLWIGCSDSRVPANQIIGLPPGEVFVHRNIANVVVHTDLNCLSVIQFAVDLLKVKHIMVVGHYGCSGVGAALHGRRVGLADNWLHHVQDVRTKHAALIEEWPIGEARHRRLVELNAIEQVMNVCRTTIVNDAWARGQELTVHGWAYGVHDGKVRNLGMTIREPGALDATYQKCVAAVSAGGAHNADNDVVAADAAQLGDVPAIVEGVIKELKHE

SEQ ID NO: 25009 - protein, 575 aa, Trichodesmium erythraeum IMS101
MCQQKNFSHNYLLVWLITQKIIVTNTRKLIIKVQHNKILIVTLTTQTQKNSDSLTQFNRQMIVILDFGSQYSELIARRIRETQVYSEVISYRTTAAKLADINPKGIILSGGPNSVYDEGAPHCDPEIWNLGIPILGVCYGMQLMVKQLGGEVERTQLAEYGKASVSIDDPTDLLTNIEEGTTMWMSHGDSVTKMPSGFEVLAHTDNTPCGAIADHNKKLYGTQFHPEVVHSIGGQVLIRNFVYHICKCEPTWTTEAFVEEAIREIRAKVGDKRVLLALSGGVDSSTLAFLLHQAIGDKLTCMFIDQGFMRKYEPENLVKIFHESFHISVKYVNARDRFLSILKGVSDPEEKRKLIGHEFIQVFEEESKRLGPFDYLAQGTLYPDVIESANTNVDPKTGERVAVKIKSHHNVGGLPKDLRFKLVEPLRKLFKDEVRNVGRSIGLPEEIVRRHPFPGPGLAIRILGEVTDKRLKILRDADFIVRDEIRQQGMYHDFWQAFAVLLPIQSVGVMGDQRTYAYPIVLRFVKSEDGMTADWSRVPYDLLETISNRIVNEVKGVNRVVYDITSKPPGTIEWE

SEQ ID NO: 25010 - protein, 568 aa, Candida glabrata CBS 138
MSQIESVPTKPYQDQKPGTSGLRKKTKVFEDQPNYVENFIQSVMEAIPEGAKGAVLVVGGDGRYYNDVILQKIAAIGAANGVKKLVIGQNGLLSTPAASHIMRTYKEKCTGGIILTASHNPGGPENDMGIKYNLSNGGPAPEPVTNKIWEISKKLTHYKIVKDFPELDLTKLVENKKYGPLLVDVIDTTDAYIQLLKEIFDFELIHKFIAKQRKEKGWKLLVDSMNGVTGPYAKAIFVDEFGLDSKEVLQNWHPQPDFGGLHPDPNLTYAHTLVERVNKEKIEFGAASDGDGDRNMIYGYGPAFVSPGDSVAIIAEYANEIPYFKKQGIYGLARSFPTASAIDRVAKKHGLNCYEVPTGWKFFCALFDAKKLSICGEESFGTGSNHVREKDGIWAIMAWLNILAIFNQRHPDKEASIKTIQNEFWDTYGRTFFTRYDYEKVETDKANKVIENLRQYVADSGTKGSKFPTDSALTVVDAGDFSYTDLDGTISSHQGLYVILSNGARFVVRLSGTGSSGATIRLYIERYTDDKSKYSLDAQEYLKPIIKSIVQFLDLKTILGTEEPTVRT

SEQ ID NO: 25011 - protein, 244 aa, Oryza sativa (japonica cultivar-group)
MLQTPLLVIGFVVLLVSLAGFVGAWFQVALALWLYLLAMMLLIAFLLGLNAFGFAVTAGGGGTQVPGRPYREYHTSDYSSWLQKHIQDAKYWRPALACVVGSKACPKIANWSPMDYLQHDLTPIQSGCCKPPTACAYSGGVAVGAQDEDCFRWNNAAGILCYGCESCRAGVMEKVREDWHKISVLNVMVLVVLICICACGCCAFRNARRSVSEYPYGVNRMHKIHPRWDYYWWRWWRDRREQLY

SEQ ID NO: 25012 - protein, 309 aa, Glycine max
MAKQEVVEGFKFEQRHGKERVRVARVWKTRQGQHFIVEWRVGITLFSDCVNSYLRDDNSDIVATDTMKNTVYAKAKECSDILSAEEFAILLAKHFVSFYQKVTGAIVNIVEKPWERVTVDGQPHEHGFKLGSEKHTTEAIVQKSGSLQLTSGIEGLSVLKTTQSGFVNFIRDKYTALPDTRERMVATEVTALWRYSYESLYSLPQKPLYFTEKYQEVKKVLADTFFGPPKGGVYSPSVQNTLYLMAKATLNRFPDIAYVSLKLPNLHFIPVNISNQDGPIVKFEDDVYLPTDEPHGSIQASLSRLWSKL

SEQ ID NO: 25013 - protein, 681 aa, Oryza sativa (japonica cultivar-group)
MALVCAECRLVDIVRVHANLMVPEMEIQLGEEVGVAKFIKQFVENQNGKHVLGSHRVEGSVVHVEAPWLVDQQNRRREWRRVGADGELVSALFLQFVVLKLWVAIRSNHYRGLAGLEVDVMIDGSGRWEAGWSAKRSSNSASKDGRRSSACSAAQLRSRAKQSTSNTSVATYRRSPCTTPAPRMRSLSATTTRRPWRTGWRGRPMRWASLVVMKLCVEAGVNKGHHLLGRDTRHEAHRASAIDTENRVERDVWFIGVVCVVPFAEISRGVVVLKRPCLQRSGNSAGERQRNWCPGTSQGHGLLEILGLLELDIDADVVGEPRCEELNLLAVGEEVGRAATQRQKALLVRRHRANLSEMLEFTQGIVADRRSILTVTELLERIPIRRTHVLLIMEVPFLCSSSEMTRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDECWNESNSNNSLIAYNRRFVRVAQVSDELFIVQDPALHLEFLANYVAELSLLEYNLLSYPPSLVAASAIFLAKFILQPTKHPWNSTLAHYTQYKSSELSDCVKALHRLFSVGPGSNLPAIREKYTQHKILHAADVIDLNMANAFKNVKILCQCPCQCNLLEEVMLKLFPYWKLSTAV

SEQ ID NO: 25014 - protein, 321 aa, Thermobifida fusca YX
MITVVGEALIDLISSESGTYRSVPGGAPANTAVALARLGVPSSLLARMSTDRFGQQLRAYVGSRGVSTRDIVVSDEPTTLAIATLDETGRATYDFYVKGTVDWQWRPEELPDPLADDVTAIHVGSLAMAMPPGAAVVEEWVARQRGRAVISYDPNIRPALAGTPASARERVERQVALADLVKVSDEDVYWLYEQDPATGSADLLVEVGRSWLRRGPSLITITCGGDQTLVLVRGREDRPLSVAPEPVDVVDSIGAGDAFCAGLLDALGQAGALGADGRERLAALTDAQLTVCVAHAHRVAAHTCRRVGADPGELDFPPLEF

SEQ ID NO: 25015 - protein, 218 aa, Oryza sativa (indica cultivar-group)
MNSRRDFRSHRAALFDGIEEGAIRSSAYSSQIHEHENDQAMDSLHDRVSVLKRLTGDIHEEVENHNRMLDRMGNDMDASRGFLSGTVDKFKMVFETKASRRMATMVASFISVFFLIYYLTKDFRSHRAALFDGIEEGAIRSSAYSSQIHEHENDQAMDSLHDRVSVLKRGNDMDASRGFLSGTVDKFKMVFETKASRRMATMVASFIAVFFLIYYLTK

SEQ ID NO: 25016 - protein, 508 aa, Oryza sativa (japonica cultivar-group)
MSSNLAASRRSSSSSSVAAAAAAKRPAVGEGGGGGGGKAAAGAAAAKKRVALSNISNVAAGGGAPGKAGNAKLNLAASAAPVKKGSLASGRNVGTNRASAVKSASAKPAPAISRHESATQKESVLPPKVPSIVPTAALAPVTVPCSSFVSPMHSGDSVSVDETMSTCDSMKSPEFEYIDNGDSSSVLGSLQRRANENLRISEDRDVEETKWKKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKYKFVAKKPCPPSIPTEFFRDATC

SEQ ID NO: 25017 - protein, 256 aa, Trichodesmium erythraeum IMS101
MEWQENSGNWVLIPSRPKAIIHFLGGAFVATAPHVTYRCLLEILANQGYAVIATPFINTLDHLAIANNVLSSFENCLNHLYTSEILRKKSLPIYGIGHSMGCKLHLLMGSLNSIARAGNILISFNNFGARNAIPMVEQISSVVKVEFTPSPKITNSIIQKRYQIRRNLLIKFNNDNIDQTLRLSDILRLRFPSMVTVQRLNGNHLTPLGQDLSWSVGQVYTPVDAIGQWLKQEIYKDFNKLQREILLWLNPLAPIS

SEQ ID NO: 25018 - protein, 468 aa, Burkholderia vietnamiensis G4
MSLFRKKNVDRMIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLAASAVSVGWSGYLQSLLQGFGLSLPTVLTAAPGAIPGTVTWFNLPAFLVMLVITTLLSIGIRESTRINNVMVFIKVSVVLLVIAVGLFHVTPANWKPFMPHGWNGVFGAAAVMFFAFIGFDAVSSAAEEVKNPKRDLPIGIIASLAVCAVLYVTVAAVATGIVPSAQYANVSHPISYALQIAGEKWVAGFIDLGAVLGMLTVILVMSYGQTRIIFAMSRDGLLPAMLSRVHPRYATPFLTTWLVGLFFGLIAALVPLNVLAELINIGTLAAFSMVSIAVLVLRRTHPELPRAFRCPGVPVVPILAVGACLFLMLNLQPITWAAFGIWLVIGLVIYFLYSRHHSKLARGQHDAH

SEQ ID NO: 25019 - protein, 323 aa, Caulobacter crescentus CB15
MSGRITSAFGAKSTAREVVAGHDLSGRVAIVTGAATGIGVETARALALAGAEVIIAARKPELGEEVANAINEEAGSKRVSFGMLDLSSLEAIRHFVNVWGDRRIDILINNAAVMASPLMRTADGFEMQFGTNHLGHFLLSVLLAPNLIAGAKASGKPSRLVSLSSIGHRRSGIHFDDPNYTTRPYEKWEAYGQAKTANSLFAVGFDKRFKDQGVHANAVMPGGILTPLQRHLPIEEQRALGWLDENDQPREGFKTTEQGAATSVWAAVGSELEGVGGLYLEDCNQALPWSKENPWTGVMPHALDPEAADRLWDLSVDIVGAGA

SEQ ID NO: 25020 - protein, 586 aa, Zea mays
MGSYAYKYCMCFTRKFRSPDAQPPPDVRAAHLSFASDAHALRRFVAGVQGESPADVDRILAMLSGGHSHGIARLVTRSPAASTPTLEDFFAFLFSPDLNPPIAHQVHQDMSAPFSHYFVFTGHSSYLTGNQLNSDSSDVPIVKALQGGVRVIELDMWPNPSKDNVDILHGGTLTAPVEMIKCLKSIKEYAFCASNYPLVITLEDHLTPDLQAKVATMLTETFGDLLFVPNPDPMKEFPSPASLMKRIIISTKPPQEYKEFLKAENNRSGSGNIAELPDQGSLRRIDSNADESDGKDELDEQDEEDSDEDDPKFQQDTACEYRKLITIQAGKPKGHLRDALKVDPDKVRRLSLSETQLAKATISHGAEVIRFTQKNILRVYPKGTRVNSSNYDPMNAWTHGAQMVAFNMQGHDKALRLMQGFFRANGGCGYVKKPDFLLRTGPNGEVFDPKASLSVKKTLKVKVYMGDRWRMDFSKTHFDAFSPPDFYTKVGIAGVKADSVMKKTRVIEDQWVPMWDEEFTFLLTVPELALLRVEVQEYDMSEKHDFGGQTVLPVWELKQGIRAVPLHDRKGVRYKSVRLLMRFDFV

SEQ ID NO: 25021 - protein, 235 aa, Gloeobacter violaceus PCC 7421
MALRAVLFDFNGVLVDDEPLHRALTLQVLGEAFNLEVSRAEYRRHCLGRPDREAFRAVLEARGLAVGDGALAALMRRKTELYRERAAPKDLLVVGVQALLADLVGRGMHLAVVTGSGGEEVSWLLENTGLREYFALIVAAEDIQRGKPDPEGYRTALGRLGREPEEALAVEDSLAGIEAARRAGLRVLALTTAVPMHLLQRRTQWVVDRYEQLDLDAVVQFYGRAAPLPPSGGSA

SEQ ID NO: 25022 - protein, 760 aa, Xanthobacter autotrophicus Py2
MASNISEDLRSGALVYHRLPKPGKLEIQATKPLGNQRDLALAYSPGVAAACEAIAADPLLAAELTIRANLVAVVSNGTAVLGLGDIGPLAGKPVMEGKAVLFKKFSGIDVFDIEIDAKTVERMVDVVSALEPTFGGINLEDIKAPECFEVEAQLRERMKIPVFHDDQHGTAIIVGAAVRNAMEVGKRKIEELKIVASGAGAAALASLNLLLTLGAKKENIWVCDIEGVVYDGRNTLMDPYKEKFAQKTDKRTLDEVIEGAHIFLGLSAGGVLKPEMVKKMADHPLILALANPVPEIMPEVAREARPDAMICTGRSDFPNQVNNVLCFPYIFRGALDVGATDINPEMKMAAVEAIAALARETPSDVVARAYGGETRAFGADSLIPSPFDPRLILRIAPAVAKAAMDTGIATRPIADMDAYIERLDHFVFRSGFIMRPLFAQAKRNIKRVVYAEGEDERVLRAVQAVVEEGIARPIIVARPNVLETRLKRFGLSVRPGHDFDLINPEDDPRYRDYVRDYVEIAGRRGVTPDAARTLVRTHPTVIAALAVKRGEADAMLCGIEGRFTRHLRQVRDIIGLAPGVKELAALSLLITSHGNFFICDTQIQTEPTAADLAEMTVLAAAHVRRFGLEPRVALLSHSNFGSHETLSAKRVRSALSIIREREPNLEVDGEMQADSALLEDIRKRVLPNSTLTGAANVLVMPDLDAADIAFNMLKVLGDALPVGPILMGTAKPAHILGPSVTARGIVNMTAVAVAEAQTEA

SEQ ID NO: 25023 - protein, 484 aa, Thermobifida fusca YX
MTSQSTTPLGNLEETPKPDIRFPSDFVWGVATASFQIEGSTTADGRGPSIWDTFCATPGKVENGDTGDPACDHYNRYRDDVALMRELGVGAYRFSIAWPRIQPEGKGTPVEAGLDFYDRLVDCLLEAGIEPWPTLYHWDLPQALEDAGGWPNRDTAKRFADYAEIVYRRLGDRITNWNTLNEPWCSAFLGYASGVHAPGRQEPAAALAAAHHLMLGHGLAAAVMRDLAGQAGRSVRIGVAHNQTTVRPYTDSEADRDAARRIDALRNRIFTEPLVKGRYPEDLIEDVAAVTDYSFVQDGDLKTISANLDMMGVNFYNPSWVSGNRENGGSDRLPDEGYSPSVGSEHVVEVDPGLPVTAMGWPIDPTGLYDTLTRLANDYPGLPLYITENGAAFEDKVVDGAVHDTERIAYLDSHLRAAHAAIEAGVPLKGYFAWSFMDNFEWALGYGKRFGIVHVDYESQTRTVKDSGWWYSRVMRNGGIFGQE

SEQ ID NO: 25024 - protein, 496 aa, Burkholderia sp. 383
MNKLTLADWQDKAASLKIEGRAFIDGASRDAHGGKTFDCVSPIDGRVLAKVADCGEADVNAAVAAARRAFDAGVWAGLNPRARKAVLLRWAALMREHLDELSLLETLDAGKPIGDTTTVDVPGAAYCVEWFAEAIDKVGGEVAPADHHLVGLVTREPVGVVAAVVPWNFPILMAAWKFGPALAAGNSVVLKPSEKSPLTAIRVAQLAYEAGIPAGVFNVVPGAGEPGKLLALHRDVDCIAFTGSTAVGKLIMQYAAQSNLKRAWLELGGKSPNIVLADCPDLDRAAQTAAGAIFYNMGEMCTAGSRLLVHRDIKDAFIEKLVAAARAYVPGNPLDPSVSMGAIVDGIQLERVLGYIEAGRSEGKLVTGGARVKEETGGFYVEPTVFEVKPDAKIAREEIFGPVLSVIVFDDVDEAVRIANDTEYGLAAAVWTSNLTTAHDVSRRLRAGTVWVNCYDEGGDMNFPFGGYKQSGNGRDKSLHALEKYTELKSTLIRLR

SEQ ID NO: 25025 - protein, 381 aa, Arabidopsis thaliana
MTTMSDLSPDLVGEILTRVPMTSLISVRCTCKMWNALSKEGIFFKAARKQFMGFTMMDSRVCSMKFDLQGIRNNEHDFVDPCIKQIAKLDQIEVSKVLQCDGLLLCVGKDNSRLLVWNPYLGQTRFIKPRKRFNKLEWYALGYDNNHNYKILMNYDTGHLFGYEIYDFSSDSWRVLDVSPDCHIPFHQQSVSLNGNTYFLAQEKIIVEGEEEEVVDEIEKFLLCFDFTTERFGPRLPLPFHSDVLETVAISCVRDDQLAVLYQRFETWEIWVTTKIDPTAVSWSMFLSVDMEPPTGCQFDDEAGSFFIDEENKVAVFFNSDLFNPRVENRNRRYPTAYIIGQDGYFKSATLREAPDLVKPDPYVYCCPLVWSSYAPSLVQL

SEQ ID NO: 25026 - protein, 319 aa, Vibrio cholerae O1 biovar eltor str. N16961
MRIRKAIMATKTADYIWFNGEMIPWANATVHVLTHAMHYGTSVFEGVRCYNTPKGPIIFRHREHAQRLLDSAKIYRFPIPYSIETIMEATRETLRVNKLDNAYIRPLAYVGNVGLGVCPPVGTEMDLMIAAFPWGAYLGEEALENGVDAMVSSWHRAAPNTIPTAAKAGGNYLSSLLVGGEARRHGYAEGIALSVDGYLSEGAGENIFVVKNGVILTPPTTSSILPGITRDSIMTLARDMGYEVREANISREALYLADEIFMTGTAAEVVPVRSVDKITVGAGKRGPITKVVQDAYFGLFKGTTEDKWGWLDYVYPAAK

SEQ ID NO: 25027 - protein, 544 aa, Zea mays
  misc_feature (61)..(61): Xaa can be any naturally occurring amino acid
  misc_feature (73)..(73): Xaa can be any naturally occurring amino acid
  misc_feature (150)..(150): Xaa can be any naturally occurring amino acid
  misc_feature (163)..(163): Xaa can be any naturally occurring amino acid
  misc_feature (197)..(197): Xaa can be any naturally occurring amino acid
  unsure (1)..(544): unsure at all Xaa locations
MSATQLLRRSRKLQSLQNAVGCENFCLVRHFSSGSGSFIARENGVGKRTRGTRFSQQYQPXKELEPFSLGSKXETALARRASNSLTPSAASWLSGSFSCGQVVSARTFSSSADLPPHQEIGMPSLSPTMTEGNIAKWLKKEGDKVSPGEXVLCEVETDKATVXEMECMEEGYLAKIIHGDGAKEIKVGEVIAITVEXEEGVAFEKFKDYKPSSSAEPVAPAEPKAQPEPSQPKAEEKKPTQAPEAKAPKIEEASQSGDRIFASPLARKLAEDNNVPLSSVKGTGPDGRILKADIEDYLAKGGLREAFAAPGLGYVDIPNAQIRKVTANRLLASKQTIPHYYLTVDARVDKLVKLRGELNPLQDASGGKKISINDLVIKAAALALRKVPQCNSSWMNDFIRQYHNVNINVAVQTEHGLFVPVIRDADKKGLGAIAEEVKQLAQKARDNSLKPADYEGGTFTVSNLGGPFGIKQFCAIINPPQSAILAIGSAEKRVIPGSADGQFEFGSFMSATLSCDHRVIDGAIGAEFLKAFKGYIENPTSMLL

SEQ ID NO: 25028 - protein, 795 aa, Debaryomyces hansenii CBS767
MDSLRTAFANQDIEPFYIGGISASVSANGEILATPINEDVVITDLSTHEIIHKIEGDGELITNLLITPDAKKLAILSQSQQLRIFDLNEGEITKTFKMSSPVYMSAVDKTSSLFAFGGSDGVITVWDIEGGYVTHSLKGHGVTICSLTFYGELNSSNWKLASGDIMGTVKIWDLVKRKCISTINEHNSAVRGVGFSESGEYFITGGRDQVAIIYNTKNFKALKTFPVKDQIENAGFIDLPWSRNNDNLYFYTAGSENILKIWNFDSGKLVAQTMTPLQTNEELMIIDVLELENNRLMLVISDQTLAFVDMNEYDDESEIVEIRIINRIAGNHGTIADIRYVGPEFQFLALATNSPSLRILNPDRPFELNICEGHTDLLNAIDVSLDGLWIATASKDNEARLWRWNDNSFEEYAVFHGHAGAVTAISLPKSTNQEFPPFIITGSSDLTVKKWKVPKPTGSVQVVKTSEYTRRAHEKDINSIDISPNDEFFATASYDKLGKVWNLESGETIGVLKGHKRGLWDINFCKYDKLIATSSGDKTVKLWSLNDFTCTKTFEGHTNAVQRVRFFNKNQQIISSGADGLVKLWDVKDLAGECLKTIDNHDNRIWALDVKNDGLEIVTADADGQLSIWSDNTDEFLQEQEAIQKTKVEQEQKLTNYITTKDWSSAFLLALTLDHPMRLYNVIKSSINLNEDSNSAIGSFKLEATIGQLVSDQLLKLFKKIRDWNVNGKFFEISQKLITVILHKFEIDSLIEIPGLMKLVDSIIPYSERHFTRIDDLIEQSYILDYTVKEMDKLD

SEQ ID NO: 25029 - protein, 192 aa, Triticum aestivum
LAWSRPRLYLIGHCLSWSGWLVLQAPVLKKYPARLSVTSYTCFFGVIQFLIIAAFFERDAGAWVFHSGSEVFTILYAGFIASGVAFAVQIWCIDRGGPVFVAVYQPVQTLVVAIMASLTLGEKFYLGGIIGAALIITGLYLVLWGKSEERSRIGKEAAVMAAASSGSGEREVRSAKLASSITQPLLPPSDNV

SEQ ID NO: 25030 - protein, 567 aa, Debaryomyces hansenii CBS767
MFAYRNRGAFGISRSNKIRSSSFTRTPKITYLTINIIRDTNKGTNSSTYRYFIRPGILIVGLGGSAYLIDRYAYSSIMTRSIRALYVMLWIAYEYSRNIAKYETISDLHNVAAERLLNMLRTNRGLYIKLGQAIANQGDFFPKEYQKKFVKLYDDAPVDTWEQIDKVLRKNLGENYEMEVFDSIDHDPVASASIAQVHKGKLKSNGESVAIKVQHHYINEQIVIDLFMYKLISKIYERVFDIPLSFFTKYVSEQMIEEADFVNEMENASKLRQIIKKDESMNNTNIYIPHSYSDLSKRQVLITEWCDGVALTDKDKLIASDIDLTLAMKQYIKVFGKQIFEYGFIHSDPHPGNLLARFDNAGNQQLVILDHGLYISLPNSFRIENCQLWEYLFSFNTQGIEEIGREWGIGSTELFATLVQLKPIKISTESTNRGDSDINSLLRDFLSDEEKFPVELLFLTRTMRMIQNLNRNFGSPVNRINLLTSELINALMLENSHSVTTISSRILQYFKLFKVRCVLFVSNLAFYLVRLRQLLSGDKYGDKSIGIEDYLEVYLQNTALSLGVDWT

SEQ ID NO: 25031 - protein, 225 aa, Triticum aestivum
MDQYSYRGGGDDNGQGGYATVTSAPPKRPAGRTKFRETRHPVYRGVRRRGAAGRWVCEVREPNKKSRIWLGTFASPEAAARAHDVAALALRGRAACLNFADSAALLAVDPATLRTPDDIRAAAIALAETACPAAPASSSAVAAVASAPAPPMMTMMHESAAVHYDDYPMQYGYGGIGDLDQDSYYYDGMSAAGGDWQSGSHMDGADDDCNDSGGYGAGEVPLWSY

SEQ ID NO: 25032 - protein, 1614 aa, Arabidopsis thaliana
MEEFDYISEFPDCLLTQILLNLPTKDSVKTSVLSKRWRNLWLNVPGLRLRTFDFPVFPYPYEEGFVRFMDRFMEFKCRSRLQKFMITYFEHNGYRDRLMELIGTLVDRGIQHLYVYMHTCNRVDFIRQNIYKSKTLVSLKLYNVELKNPEFVVSLPCLKILKLENIFHGEDGPLVVEKLISGCPVLEDLELIRPFDDNVGYGSLTAPKYSRNRDIIGDFLTVISSVRHTIICYSTSKMLYSYSKQLGPIPQFHNLYHLQARFSSSSLQLLPTFLESCPACPNLKNLIMEFPFEPKNIDFHKVPQCLISTLEYVQIEELILKEKSGIKLVDYFLENSAVLKKLTLSFTYHSKKKQDPESYKKLLTSTKLSPTLMGRDRISELPDGLLNHILMYLHIEESIRTSVLSSRWRKLWLKVPGLDVNVHDFPADGNLFESLMDKFLEVNRGRLQNFKLNYESNLYYLMDRFVPWIATVVDRGIQHLDVTATDCPPWTIDFMPANICKSKTLVSLKLVNVGLDTPKFVVSLPCLKIMHLEDIFYSPLIAENLISGCPVLEDLTIVRNHEDFLNFLRVMSQTLKNFRLTFDWGMGSNDFSVEIDAPGLKYMSFRDSQSDRIVVKNLSSLVKIDLDTEFNLKFGLGSPLEPEDLTKRDIIRDFLTGISSVKHMIISHPTLEVLYRYSKIGQLPKFHNLYHLQAVFSSSLLQLLPAFLEICPNLKNLILDYSISAEPEQIDFTNLPRCLISTLEYVEIKQLTMREESGIKLVKYFLENSAVLKKLTLSFIDSPMTNQESEIYMQLLTSTKRSRGCHVSIWFRKPQGPFGPKPKNKINPLVGFLEPDRFKYLTIIFLIIKSNQIKSAVKSKPSRISPTPAIICCQIKSTETDLGMEECDYINELPDSLLTQILLDLRTKDSVKTSVSSKRWRNLWLNVPGLDLFSLQFTNPHHEEGLIKFMDRFMESNCRSRLQKFMIRYFECNGYRDRFMELIGTVVDCGIQHLYVYMHTCNRVDFIRQNIYKSKTLVSLKLYNVELKNPDFVVSLPCLKILKLMKICYGEDGPLVVEKLISGCPVLEDLELIKPFDILTQDVILFLRVSSQTLKSLRLYFATNGSEDPRKRAIICDFLTVISSVRHMIISGSILEELHSYSKLGWIPQFRNLYHLQASFFGTSLQLLPTFLESCPNLKNLIMDYGAFKEENIDFHEVPQCLISTLEWRNLWLEVPGLDLNSVDFPFPYRDIIKNYTERFLEFNSASGLQKFKMTNNHGNYNVCCDRLKEWIAAAVDRGIQHLDFETKNPSLFLKDSMPMNIYKSKTLVSLKLVCVELENPKFVVSLPCLKIMHLENNWYGYDAPLVVEKLIAGCLVLEDLTVVRIHDMVIPDLPLLHVKSLTLKILRLVFDLEMMTTIPISVEIDAPKLEYMSFINRHSDTIMVKNLSSLFKLNLDTEFGYSSLEPRDIIRDVLTGISSVRQMIISQRTLEVICRYSKLGPIPKFHHLSHLKAAFSSTSLQLLPAFLESCPNLKKLILDLYVSAEPEEIDLTNVPRCITSTLECIEINKLIRKEATGVKLVHYFLENSPILKKLKPSFTDSPMSTMTNLPLDHLYKMYLTARKRSRRCQVIIS

SEQ ID NO: 25033 - protein, 412 aa, Zea mays
MAALSVPLHAAAGSRAAAADPVKVPCVRSNGSAHFGRAFPSVAVSSSAARRIQPMRAIATQAPPAVPQYLSGEKTKIGINGFGRIGRLVLRIATSRDDIEVVAVNDPFVDAKYMAYMFKYDSTHGPFKGSICVVDDSTLEINGKKVTITSKRDPAEIPWGNFGAEYVVESSGVFTTTDKASAHLKGGAKKVVISAPSADAPMFVVGVNENSYDSKMNVVSNASCTTNCLAPLAKVVHEEFGIVEGLMTTVHATTATQKTVDGPSMKDWRGGRGAGQNIIPSSTGAAKAVGKVLPELNGKLTGMAFRVPTPNVSVVDLTCRIEKNASYDDVKAAIKAASEGALKGILGYTDEDVVSNDFVGDSRSSIFDAKAGIGLSSSFMKLVSWYDNEWGYSNRVLDLIAHMALVSAAAKL

SEQ ID NO: 25034 - protein, 303 aa, Zea mays
MAAAAAWTGAASPNSLLLSRSPPHAAALAPSPGSSMRRRLLLGVGTPAVAALAAAAPPAVLQDGAVTVLITAGAYSLVRVFDELTERRLIEKSLSRKVVHVLSGVLFMSSWPLFSNSTEARYFAAVVPFLNSMRLLIYGLRLYTDEALVKSVTREGKPEELLRGPLYYVLVLLFSVLVFWRESPIGIVSLSMMSGGDGFADIVGRRYGSAKLPFNRKKSWAGSISMFISGFLLSAMMMLYFSSLGYIDVIWEEALGKLALVALAATVVECVPVTEVVDDNISVPLATMLVAFLLFSSNRTIVN

SEQ ID NO: 25035 - protein, 273 aa, Glycine max
PRINRFLAAAGNPHIRLFDVNSNSPQPVMSYDSHTNNVMAVGFQCDGNWMYSGSEDGTVKIWDLRAPGCQREYESRAAVNTVVLHPNQTELISGDQNGNIRVWDLTANSCSCELVPEVDTAVRSLTVMWDGSLVVAANNHGTCYVWRLLRGTQTMTNFEPLHKLQAHKGYILKCLLSPEFCEPHRYLATASSDHTVKIWNVDGFTLEKTLIGHQRWVWDCVFSVDGAYLITASSDTTARLWSMSTGEDIKVYQGHHKATICCALHDGAEPATS

SEQ ID NO: 25036 - protein, 460 aa, Yarrowia lipolytica
MCVDSCVQRSSLPHLSRPPGNLHKIINSDIYIYIKPHAPTPLLVAFAPTPHPSTTTSPFGQGLHQAHRQRVASLPTYGKTTTFNLPDNRPIKTVHCPSCEHVCRPQTQDAEAQKLQEAVTQRRRRSGAPGNSFPSAITALHPRQTHAPRERPSARQPDKPNGNRWELGVEFKIDIRAQDLRTIQELGAGNGGSVSRVEHIPTGAVMAKKVIHIGGKEAVRRQILRELHIMHECDSPYIVSFYGAFINESSGDVVMCMEFMDCGHLDRIYKKAGPLTEEIVGHITVAVVEGLTYLYNEHRIVHRDVKPSNILVNSHGQIKLCDFGVSGELINSIADTFVGTSTYMSPERIQGGNYTVKSDVWSLGISLLELLLGKFPFDMANGAVGPMGILDLLQRIVNEPPPTLPAEDTRFSPVCRRFVDRCLVKEPERPSPQQLHPTMPFIITSRAKQVDMKAWAMSVQ

SEQ ID NO: 25037 - protein, 495 aa, Debaryomyces hansenii CBS767
MTLVARGATRVSIRARIPHCKKLVPGVGYYRLFHESPNKLNGTFGVNIPHEQAGRSSSSTTSGIAKVGIDHENFKIPDSTTYLKDFKVSELLSYVVIGAATLNKPILNMCIKMFPYVPMSVIKAFVYKLYCGGENIEEVKQTGLRLSKRGINNMMLSLTIEACNGNDNIDPEFIVSETQRSVTEILIPHILTIIKESGKDINSIPPGYVALKPTGFAKDASNVLKYYKTDPHYAAMFEELVDKASNVCGTIYEENLKLSQKFPDRTAPFIVGVIDAEKHELQEGVYELQRRLYAKYNPLNKPVSIVGTLQMYLAGSSDLLALEEKLAMENNYRLGLKLVRGAYIHSEKNREVIHKTKECTDLNYNQGITYCIESILANKENELTIGHLVVASHNADSLKLTTEKLKKSTLVNNKNKNNVILGQLLGMADNITHNLIKTHNVDNVIKYVAWGPPLETKEYLLRRLEENGDAVRADSGFNLIKGVIGVLFKRLFRVV

SEQ ID NO: 25038 - protein, 451 aa, Thermobifida fusca YX
MARPRIVVVGAGFAGLTALRRLEQRIPEGKAEIVLVAPNDYMLYQPLLPQVASGLLTPQSIAVSLHRQLHRTHIIPGIAVGLDTDRNTVVVRKISGEYSYERYDRLILAPGSVTRTFNIPGLIEHARGNKNLAEAVYLRDHVLAQLELANASDDPAERDERCTFIVVGGGYTGVETAASLELLCEAACKQYPKLRPHIQWHVVDIAPRLMPELGEHLGQKTMELLRQRGIEVSLGVSVREVTEDKVTLTDDRVLPCRTLIWTAGTAPSPLIAATGLPTERGKLSVGADLSVPGHPEIFGIGDSAAVPDLSKGEDGALCPPTAQHASTQGPVAADNVIASLLGRSTKHYYYRDRGLLVDLSGRDAVARPFGVEFNGTAALALTRAYHLYSLPSGPARMRVAANWLIQALLGCDVSRLGFLNRSVETLVDVEEYSRYLKPEQAKERVGLAVGG

SEQ ID NO: 25039 - protein, 480 aa, Burkholderia sp. 383
MTYRNESAWIQPAAPSATAAAPRATQARTTAEYRALDAAHHIHPFSDMGALNRAGSRVIVKADGVYLWDSDGNKVIDGMAGLWCVNVGYGRKELADAAYRQIQELPFYNTFFKTTHPPVIELSAMLAEVTPKGFNHFFYCNSGSEGNDTVLRLVHQYWRVQGQPQKKFVISRKNGYHGSTIAGGTLGGMGYMHEQMPSKVENIVHIDQPYFFGEAAAGETPEAFGLARAQQLEAKILELGAENVAAFIGEPFQGAGGVIFPPSTYWPEIQRICRKYDILLVADEVIGGFGRTGEWFAHQHFGFEPDLITMAKGLTSGYVPMGAVGIHERVARPIIDNGEFNHGLTYSGHPVAAAVAVANLKLLRDEGIVERVKNDTGPYFQALMRETFARHPIVGEVHGHGLVASLQLAESPAERRRFANGGDVGTICRDFCFNGNLIMRATGDRMLLSPPLVISRPEIDELVSKAKKAVDATAQQLGIS

SEQ ID NO: 25040 - protein, 185 aa, Oryza sativa
MYAMTPRCHLPPPCRAASTTPATSTALSTPPPSRAGPDELRSTWARRAWTLAGSAAVLSSLSTSATLAAADADANGAAAAFAAPLAAALAAYSLADLATGVYHWLVDNYGDADTPVLGPQIAAFQGHHRHPSTITRREPCNNLHALARAVALALPPSGAALAAAGAPASAHAFAAVFAACVVLSQ

SEQ ID NO: 25041 - protein, 490 aa, Triticum aestivum
  misc_feature (163)..(163): Xaa can be any naturally occurring amino acid
  unsure (1)..(490): unsure at all Xaa locations
MASFARQEHQFLAELGLAPRNPGSFACGAWGGSGPVVTTTNPSNNEVIAEVVEASMDDYEKGMSACFDAAKTWMAIPAPKRGEIVRQIGDALRAKLHHLGRLLSLEMGKILPEGIGEVQEIIDMCDYAVGLSRQLNGSIIPSERPNHMMMEVWNPLGASADAXGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTTSKESFLKGIQTIKSQGGKILLGGSAIESEGNFVQPTIVEISPDAPVVREELFGPVLYAMKFLTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 25042 - protein, 414 aa, Oryza sativa (japonica cultivar-group)
MQPASPVSGDAGPVAEAVPPRGAPQVLVRRRSVPFSPDSPLAPGSRGGGERRSTFREDVSHAAAETYLVTRLAFILLRYLGVGYRWISQLAALIIYAILLMPGFIRVGYYYFFSRQVLRSVIYGDQPRNRLDLYIPRDPKKPSPVVAFVTGGAWIIGYKAWGALLGRRLAERGIIVACIDYRNFPQGTISDMVSDASDGISFVCETVGAYGGDPNQIYLMGQSAGAHIAACALLEQAAKESRGEQISWSVTQIKAYFGLSGGYNIENLVDHFHERGLYRSIFLSIMEGKKSLPHFSPETVAKKLCPETIALLPQIVLLHGTDDYSIPFSASETFAGVLKQAGAKAKLLLYEGKTHTDVFLQDPLRGGRDKLVEDVISVIHADDADAREKDALAPIPGRLVSEWQIKLAHRISPF

SEQ ID NO: 25043 - protein, 219 aa, Triticum aestivum
MDQYSYGGGDGDQAGQGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 25044 - protein, 390 aa, Trichodesmium erythraeum IMS101
MHLSKRLKPLSFNVFADMDRAKGRAKAAGQDLIDLSLGSSDLPAPRHALEAISQSLQDSNTHGYSLFSSTQAFREAVARWYSNKFDISLNPETEVLALIGSQEGTAHLPLAILDPGDFALLQDPGYPSHSGGVYLAGGQVYPMPLLAENKFLPVLGDIPQHVLAQAKMMILSYPHNPTTAIAPISFLQEAVAFCQKHNLVLVHDAPYLDFVFNSSSEAPSIFQADVEKSVSIEFFTMSKSYSMGGFRVGYAIGNAQLIQALRQVKACIDFNQYRGIFNGAIAALTGPQEVVRKTVDIFRQRRDIFIEALDNIGWTVPMPSATMYVWTKLPKLWSNDSVDFCVDLVENTGVAVAPGAGFGKAGEGYVRFALVHRPEVLSRAVEKISVFLQR

SEQ ID NO: 25045 - protein, 479 aa, Caulobacter crescentus CB15
MREYTKFYIDGAWVDPAAPNTLDVINPATEEVCGVISMGSEADVDKAVRAARKAFASFSQTSREERIDILERIIAEYQKRFEDMAKAITEEMGAPAWLAQRAQAAMGIGHVQTAAAVLKGYKFEEDRGTTRIVKEPIGVCAFITPWNWPVNQIACKVGPAIATGCTMVLKPSEIAPFSGYIWTEIMHAAGVPAGVFNLVNGDGPTVGAALSRHPEVDMVSFTGSTRAGIEVAKNAAPTVKRVHQELGGKSPNIILDDADFSRAVAGGVASVMMNSGQSCNAPTRMLVPGARMDEVIAIAKAAAESHTVGDPNGNHKMGPVVSETQWNKIQGLIQKGIDEGATLVTGGVGRPEGLDKGYYVKPTVFANVTNEMTIAKEEIFGPVVSILGYDTVDEAVTVGNDTEYGLAAYVSGGDQDEVRKVASRLRAGQVTLNGAGPDLMAPFGGYKMSGNGREWGDHAFGEFLETKAILGYSAKVAAE

SEQ ID NO: 25046 - protein, 209 aa, Edwardsiella ictaluri
MKKIIRVGIGGPVGSGKTAIIEVITPRLMQRGIKPLIITNDIVTTEDAKQVKRTLKGILDEEKIVGVETGACPHTAVREDPSMNIAAVEELEARFPDSDVIMIESGGDNLTLTFSPALADFYIYVIDVAEGEKIPRKNGPGLVQADILVINKTDLAPYVGADLSVMESDTKVVRGDRPYVMTNCKTGEGVEELVDMIMRDFLFTHSEIK

SEQ ID NO: 25047 - protein, 203 aa, Triticum aestivum
  misc_feature (197)..(197): Xaa can be any naturally occurring amino acid
  unsure (1)..(203): unsure at all Xaa locations
NKFVQKSSPVPVRNSRDIVDPRVRAVKQALDVARGMAYVHALGFIHRDLKSDNLLIAADRSIKIADFGVARIEVKTEGMTPETGTYRWMAPEMIQHRPYDHKVDVYSFGIVLGVLWAGMLPFTNLTAVQAAFAVVNKGARPAIPLDCLPSLTHILTPCWVANPEVRPPFTEIVCMLENAEMEVVSHVRKARFRCCVXEPMTTD

SEQ ID NO: 25048 - protein, 482 aa, Arabidopsis thaliana
  misc_feature (146)..(146): Xaa can be any naturally occurring amino acid
  unsure (1)..(482): unsure at all Xaa locations
MASAAASSAFSLLKSTGAVASSAGTRARASLLPIPSTSVSARPLGFSATLDSRRFSLHVASKVESVRGKGSRGVVSMAKKSVGDLTSADLKGKKVFVRADLNVPLDDNQTITDDTRIRAAIPTIKYLIENGAKVILSTHLGRPKGXVTPKFSLAPLVPRLSELLGIEVTKADDCIGPEVESLVASLPEGGVLLLENVRFYKEEEKNDPEFAKKLASLADLYVNDAFGTAHRAHASTEGVTKFLKPSVAGFLLQKELDYLVGAVSNPKRPFAAIVGGSKVSSKIGVIESLLEKCDILLLGGGMIFTFYKAQGLSVGSSLVEEDKLELATELLAKAKAKGVSLLLPTDVVVADKFAPDANSKIVPASGIEDGWMGLDIGPDSIKTFNEALDTTQTVIWNGPMGVFEMEKFAAGTEAIANKLAELSEKGVTTIIGGGDSVAAVEKVGVAGVMSHISTGGGASLELLEGKVLPGVIALDEAIPVTV

SEQ ID NO: 25049 - protein, 425 aa, Pseudomonas putida GB-1
MPTMSDLKTAALEYHAQPRPGKLSVELSKPTATARDLALAYSPGVAEPVREIGRDPELAYKYTGKGNLVAVISDGTAILGLGDLGPLASKPVMEGKGVLFKRFAGIDVFDIEVESESPQAFIDTVRRISITFGGINLEDIKAPECFEIERTLIEQCDIPVFHDDQHGTAIVTAAGMINALEIAGKKLEDAKIVCLGAGAAAISCMKLLVSMGAKVENIYMIDRSGVIHAGRDDLNQYKAQFAHATDKRTLADALDGADVFVGLSGPNLLSPEGLKSMAANPIVFACSNPDPEISPELAHATRSDVIMATGRSDYPNQVNNVLGFPFIFRGALDVRAKRINEEMKIAAAIALKDLAKLPVPKEVCEAYGVEGLEFGREYIIPKPLDARLITVVSDAVAKAAIESGVATLPYPKHYPLTSVDEVFNG

SEQ ID NO: 25050 - protein, 646 aa, Oryza sativa (indica cultivar-group)
METQSVRIRLGTEVVYKEQPSSVDGCEVEADVLLEAPLAAASSRSMCCCRRFIEAVAGQQEPRDAAQAGAAANSTVMACVASTRPAIAAPVAQAIRQMPDPRVAQRTSRRLRRALRRRRSRWFLRPTKLRCMPWKPAAGAGNGLGIWSNRRKASNAQSRCGAASGGACGISARRSVMGPYSARARRSARRRGEAEQRRVVRAAEVVRGEAGQLRVRRVPQRALHHRVLRLEHAGEGAPVLVLLIFLPTTTTTDAALPLPIPAVHMDLRPDLVVGAGVDGERVLLAQGAWVLKPKSQEPSFVVHFVGGIFVGAAPQITYRFFLERLADKGALVIATPYASGFDHFFIADEVQFKFDRCLRNMVEPVNDLPTFGVGHSLGSVIHLLIGSRYAVQRSGNILMAFNNKEASLAVPLFSPVIVPMAQSFGPIFSQLTSYPTLRFGAEAAIKQLENLSPPVVKQLLPLVQQLPPLYMDLVKGREEFVPKPEETRRLVKSYYGISRNLLIKFKDDQIDETSILAQVLSSESAISSLLDMSIRSLPGDHGLPLQQVLPDVPPAMADAVNRGSELLTNLATGTPWEAVAKEVGTGGAQYCTVLSANLQFSFTRNVHLVATEDGYFIRLLQQQQQQQLILSRMGSTYPDIKYCMCV

SEQ ID NO: 25051 - protein, 410 aa, Oryza sativa
MRRRSRRERDVGHQQRWRSLHAGAAAPGSRGRSGECRRRGGGGGAGKRQHVMRTFQGHNPNTMKVHSRKSQPSKKKPREFYDTVEVHIIDDDSDGDANIHKDYSMEDTSKHLVMYNPEITYDKQGEVEVTEPIDNYTSLNQRYMKPRHGYNTVLPSIGAYTVQCAHCFKWRIIPTKEKYEEIRENICQDVFVCERAREWNRVISCVDPEDISQDGSRVWAIDKASISQTPPGWDREVRIRGEGCSKFADVYYTSPTGKKLRSLVEVGRYLAENPHYIRQGVNLTQFSFATPKPLQEDYVRKHTYAATPELPELLETAQVDPLCWAAPPTRSELLGELGASTSRSVDVSQSEVSYPVDLHQPEESAPLPPRTKKKTMKRGRVSATGSQSTPPGSSKDQSGGCVSDVEFVSL

SEQ ID NO: 25052 - protein, 452 aa, Burkholderia sp. 383
MDFDYDLFVIGAGSGGVRLARMSASYGARVGIAEEEQIGGTCVLRGCIPKKLLVYASHYPHEVEDAKGFGWRFGAGTLDWPALIAAKDREINRLSDIYINLLRQSGVEMHAGRATLVDAHTVAIGDRTIRARHIAIATGSRPSMPARPGIEHAITSREALSLAALPKRIAVVGGGYIAVEFAGIFNGFGSHVDLFYRGEKILRGFDDDVRQFLTDEMTKQGVTIHARSVVESIERADDGTLSVRVGDARHGPYDQVLYATGRVPNVDGLGLEQAGVALDARGAIAVDAYSATSVPSIHAIGDVTSRPQLTPVATRDGALLARTLFGGSRVAADHEWVPSAVFSQPEVATVGLTESTARDLYDGDVDIYRTSFKALRHTLSGRDERTLMKLVVARDSQRVVGAHMVGRDAGEIIQGIAIAIRAGATKAQFDDTIGIHPTAAEEFVTMRQKVAD

SEQ ID NO: 25053 - protein, 129 aa, uncultured marine group II euryarchaeote DeepAnt-JyKC7
MQFDPLSDAFVRIFNAEQAGHYEVTVSPASKLLGNMLSIMQVSGYVGEYQQVEDGRGGSFRVELIGAINRCGVIKPRHSVRRTDFDKWESRYLPAQDFGLLILTTNQGIMNHHDAKKERVGGRLLAYIF

SEQ ID NO: 25054 - protein, 435 aa, Burkholderia sp. 383
MSDSYFPRWRVQSTGAASRVVGPDERLAWPQMVAMGVQHVVAMFGSTVLAPLLMGFDPNLCIFMSGIGTLLFFVLVGGRVPSYLGSSFAFIGLVIAVTGYGGSGPNPNIPVALGGIIACGVVYVAIGALVQAIGTNWIETLMPPVVTGAVVAVIGLNLAPIAVKGVSGSTFESVMALVTVLCVGGVAVFSRGMVQRLLILVGLVIAYAIYAVVTNGMALGKPIDFSIVEHAAWFGVPSFRAPVFDPHAMLMLAPIAVILVAENLGHIKAVSAMTGTSLDRYVGRAFIGDGLATIVSGSVGGTGVTTYAENIGVMAVTRIYSTLVFAVAAVIAIVLGFSPKFGAVIQTIPGPVLGGVSIVVFGLIAVTGARIWVVNKVDFSDNRNLIVAAVTLVLGAGDFSLKIGGFGLGGIGTATFGAIILYAILRKEKEPGPVV

SEQ ID NO: 25055 - protein, 235 aa, Triticum aestivum
SSSPSSSSVSSSPEHAAGRASLAKRPAGRTKFRETRHPVYRGVRRRGNAERWVCEVRVPGKRGARLWLGTYDTAELAARANDAAMLALGGRSAACLNFADSAWLLAVPSALSDLGDVRRAAVEAVANLQRRKAGNGSLTATVTEEASCDAPEESSSESDSAGSSETSEPSADREFEVPVAVDTDMFGLDLFPEMDLCSYYASLAEALLVDPPARVTTTDTYWDNGDGGADVALWS

SEQ ID NO: 25056 - protein, 500 aa, Caulobacter crescentus CB15
MQSMADAETADTFGCHALVGGTPKVSFWTRRKAIDTITAGHADSHQLKKTLSWPHLVALGVGAIVGTGIYTLTGVGAGLAGPGVILSFLIAGAVCACAALCYAELSTMIPASGSAYTYSYAAMGEPVAWFVGWSLILEYTLVCAAVAVGWSAHAHGLFKMIGFPDALLAGPHQGGLINMPAVFISMAVAGLLALGTRESATVNMVLVFVKIIALIVFVVLCLPAFNLAHFTPFMPNGFQAHVPEGAAADAAKVGVMAAASLIFFAFYGFDAVSTAAEETKNPKRDLTIGIVGSMAVCTAIYMIVAAVSIGASRTEVFSKSEAPLVFILESLNHGKIAQLVALAAVIALPTVILAFMYGQSRIFFVMARDGLLPRALSKVNAKTGTPVMMTLLTGVLAAVISGLLSLKDIAELANAGTLWAFIAVGASVILLRLREPNRPRVFSTPLWPIVAPAGILGCLYLFLSLPGKTQLYFLYAHLIGAVVYLAYGMRKSVLAQQERA

SEQ ID NO: 25057 - protein, 246 aa, Triticum aestivum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLSDVRRAAVEAVADSQRREAANGSLTVTATVTEEASCGAPEESSSESDSVGSSETSEPSADGEFEVPVAVDTDMFRLDLFPELDLCSYYASLAEALLLDPPAPVTTTYAYWDNGDGGADVALWSY

SEQ ID NO: 25058 - protein, 596 aa, Solanum tuberosum
MDVRRRPVKPLYTSKDASAGEPLKQQEVSSPKASDALPLPLYLTNGLFFTMFFSVMYFLLVRWREKIRNSIPLHVVTLSELLAMVSLIASVIYLLGFFGIGFVQSFVSRSNSDSWDIEDENAEQLIIEEDSRRGPCAAATTLGCVVPPPPVRKIAPMVPQQPAKVALSQTEKPSPIIMPALSEDDEEIIQSVVQGKTPSYSLESKLGDCMRAASIRKEALQRITGKSLEGLPLEGFDYSSILGQCCEMPVGYVQIPVGIAGPLLLDGREYSVPMATTEGCLVASTNRGCKAIFVSGGADSVLLRDGMTRAPVVRFTTAKRAAELKFFVEDPLNFETLSLMFNKSSRFARLQGIQCAIAGKNLYITFSCSTGDAMGMNMVSKGVQNVLDYLQSEYPDMDVIGISGNFCSDKKPAAVNWIEGRGKSVVCEAIIKEEVVKKVLKTEVAALVELNMLKNLTGSAMAGALGGFNAHASNIVSAVYLATGQDPAQNVESSHCITMMEAVNDGKDLHVSVTMPSIEVGTVGGGTQLASQSACLNLLGVKGANRDAPGSNARLLATIVAGSVLAGELSLMSAISAGQLVKSHMKYNRSIKDISK

SEQ ID NO: 25059 - protein, 602 aa, Solanum lycopersicum
MDVRRRSEEPVYPSKVFAADEKPLKPHKKQQQQQEDKNTLLIDASDALPLPLYLTTNGLFFTMFFSVMYFLLSRWREKIRNSTPLHVVTLSELGAIVSLIASVIYLLGFFGIGFVQTFVSRGNNDSWDENDEEFLLKEDSRCGPATTLGCAVPAPPARQIAPMAPPQPSMSMVEKPAPLITSASSGEDEEIIKSVVQGKIPSYSLESKLGDCKRAASIRKEVMQRITGKSLEGLPLEGFNYESILGQCCEMPIGYVQIPVGIAGPLLLNGKEFSVPMATTEGCLVASTNRGCKAIYASGGATCILLRDGMTRAPCVRFGTAKRAAELKFFVEDPIKFESLANVFNQSSRFARLQRIQCAIAGKNLYMRLCCSTGDAMGMNMVSKGVQNVLDYLQNEYPDMDVIGISGNFCSDKKPAAVNWIEGRGKSVVCEAIITEEVVKKVLKTEVAALVELNMLKNLTGSAMAGALGGFNAHASNIVSAVFIATGQDPAQNIESSHCITMMEAVNDGKDLHISVTMPSIEVGTVGGGTQLASQSACLNLLGVKGANREAPGSNARLLATVVAGSVLAGELSLMSAISSGQLVNSHMKYNRSTKDVTKASS

SEQ ID NO: 25060 - protein, 287 aa, Triticum aestivum
MSSGRYMAYSPSPSTTPHSPRISGLRASSAAVADQEKYLAELLAERHKLNPFVPVLPHSIRLLNQEILRVSTLLENASLLNQSGFEHGSPLTLGGLYSNGAATDMNGWTSAFQSESSSAYSWLGGSQGSSSGLIVKKTMRVDIPVDKYPTYNFVGRILGPRGNSLKRVEATTDCRVLIRGRGSIKDPAREEMMRGKPGYEHLNEPLHILVEAELPVEIIDARLMQAREILEDLLRPMQDESQDFFKKQQLRELAMLNGTLREEGMQRSGSASPFHNSLGMKRAKTRG

SEQ ID NO: 25061 - protein, 245 aa, Triticum aestivum
MDMGLEVSSSSPSSSSVSSSPVHAAGRASLAKRPAGRTKFRETRHPVYRGVRRRGNAERWVCEVRVPGKRGARLWLGTYATAEVAARANDAAMLALGGRSAACLNFADSAWLLAVPPALSDLGDVRRAAVEAVADFQRREAANGSLTATVTEEASCGAPEESSSESDSAGSSETSEPSADAEFEVPVAVDTDMFSRLDLFPEMDLCSYYASLAEALLVDPPSTVAIIDSYWDNGDDGADVALWSY

SEQ ID NO: 25062 - protein, 149 aa, Zea mays
RAGVQYASKDVKALKSVADAHKDRSIHAYKKVLETYKEQLVDDPIVYAHLNQLYENLLEQNLLRLIEPFSRVQIDHVAALINLPRAVVETKLSELILDGKLKGILDQGSGDLIIFDEDTEDKTFETTLQVYKELNLVADKLYAKAARLH

SEQ ID NO: 25063 - protein, 274 aa, Ostreococcus tauri
MGDARVIAVEPLSWYPRAFALRNALDETEMRAILALARTRVARSTVIDSESGKSVVNPIRTSKQTFLSRNDPVVRKVLERMSSVTHLPWYHCEDLQVLEYSAGEKYDAHEDVGEEGTKSGDQLSKNGGKRVATILLYLEEPEEGGETAFPDSEWIDPERAKTETWSKCAHRRVAMKPTRGDGLMFWSVRPDGTIDHRALHVGCPPTRGTKWTATIWVHADPYNWIKPPDPVPTIGCEDKSDRCRGWANIGECDKNPSFMLENCKWSCRVDGCDH

SEQ ID NO: 25064 - protein, 278 aa, Vibrio cholerae O1 biovar eltor str. N16961
MASQIDQYAVFGNPINHSKSPFIHTLFARQTQQSMIYTAQCVPVDGFTEAAKHFFAQGGRGCNVTVPFKEEAYRFADRLTERARLAGAVNTLKKLDDGEILGDNTDGEGLVQDLLAQQVLLKGATILLIGAGGAARGVLKPLLDQQPASITVTNRTFAKAEQLAELVAAYGEVKAQAFEQLKQSYDVIINSTSASLDGELPAIDPVIFSSRSVCYDMMYGKGYTVFNQWARQHGCAQAIDGLGMLVGQAAESFMLWRGLRPGTKQILRELRKNLEGAL

SEQ ID NO: 25065 - protein, 738 aa, Oryza sativa (japonica cultivar-group)
MSRRAPPTMLALPAPPRLGWGGRTVVVGVRDDAEGRELLTWALAMVAFAGDRVVALHVATPAAAAGADQEGAMRMAARRIRATESLAALLRAYDGFCDLNQISLELRICHGSSIKKALVNEASSYGAAHLILGVTNNSRSHLRPSSSPSSSSAAVAKYCAKRVPPSCSVLAVGNGRVVYRRDAAQQQLNQCISPLVETPRRIYRKIYRKLVRAATTITREKSQDDAAIAGGGRHLRRNISTPTSAPVSPVVAFTPRQAEVAAGWPLLSPDLKSALPEWTEMSVARWAMQLPSRCPAPSPLNPRNNSGDQATSPAITASETPSPATDEAAEQVAQELASLRNKYSSKYTMFSYSELARITSNFSPDRIIGKGGASEVYKGCCDDGKEVAVKVLKSSDKVMEELVSEMEIVSSVRHGNAMPLTGFCLDGGGGAAKIMLVYDYMARGSLEEILHGEKEGKDLFGWPERFKVAAGVARALVYLHGGDGDGRPVIHRDVKSSNILVSEDFQPKLCDFGLALWAAEAASPVTGDDVAGTFGFVAAAASSHLLEEFKYLAPEYFMHGKVSDKIDVYAFGVVLLELVSGRKPVSSGGGKGKESLVMWANTIIQGGKLTDLVDPSLPTDGSGVAGEVERMTLAAALCIRRSPQRRPSIANVLKLLDGDGDAVRWVRSQAGLSAGDDTDDGDGASPEKKDIQSYINLALLDVVDDSASVSSGGGDFTAANVSLEEYTKGRWSRSSSFD

SEQ ID NO: 25066 - protein, 350 aa, Debaryomyces hansenii CBS767
MNTSIPQTMKAIVLSGPYEVSTVTKQSPTIQDPTDVILKVKYSGLCGTDLHTYRGHIKLGSKDQIIGHEFLGTIVSRGSAITDSDFKIGDDVLSTFTIQCGECWYCKHGYSGQCDKTNTFGKVGLDGGQAEYVRVPYAMSTLIRKPESKSTEDDAVYVMMADIFITGYYGVKKILNHLKNESADGYTKSDIKDITILQLGVGPVGLCALRILKHFGFEKVVCVDSVTSRLEEARRFGAFKAINFETEKNGVADFIKESTNNVGFDVVLEVVGASSALRTAYDSVRGNGFICSIGMAHDPLPFTGLDCYLKNVNISFGRCHAWSLFPEALDLFEVLKPDFTIFIDFNLFLY

SEQ ID NO: 25067 - protein, 924 aa, Lathyrus sativus
MMELQVIWIIRLVVACVLCLCIFIISASSATEGFESIACCADSNYTDPKTNLNYTTDYRWYSDKSSCRQIPKILLSHRSNVNFRLFDIDEGKRCYNLPTIKDQVYLIRGIFPFDSVNSSFYVSIGATELGEVTSSRLEDLEIEGIFRAPKDNIDFCLLKEDVNPFISQLELRPLPEEYLHDFSTNVLKLISRNNLCGIEEDIRFPVDQNDRIWKATSTPLNALPLSFNVSIVDLNGKVTPPLKVLQTALTHPERLEFVHNGLETEDYEYSVLLYFLELNNTLKAGERVFDIYLNSEIKKESFDVLEGGSKYSYTVLNISANGSLNITLVKASGSKFGPLSPALKILQARPWIDETNQTDLEVIQKMRKELLLQNQDNEALESWSGDPCMLFPWKGVACDSSNGSSVITKLDLSSSNLKGTIPSSVTEMTKLQILNLSHNHFDGYIPSFPPSSLLISVDLSYNDLTGQLPESIISLPHLNSLYFGCNQHMSNDDEAKLNSSLINTDYGRCNAKKPKFGQVFMIGAITSGSILITLAVVILFFCRYRHKSITLEGFGGKTYPMATNIIFSLPSKDDFFIKSVSVKPFTLEYIELATEKYKTLIGEGGFGSVYRGTLDDGQEVAVKVRSATSTQGTREFDNELNLLSAIQHENLVPLLGYCNEYDQQILVYPFMSNGSLLDRLYGEPAKRKILDWPTRLSIALGAARGLAYLHTFPGRSVIHRDVKSSNILLDHSMCAKVADFGFSKYAPQEGDSYVSLEVRGTAGYLDPEYYKTQQLSEKSDVFSFGVVLLEIVSGREPLNIKRPRVEWSLVEWAKPYIRASKVDEIVDPGIKGGYHAEALWRVVEVALQCLEPYSTYRPCMVDIVRELEDALLIENNASEYMKSIDSLGGSNRYSIVMDKRGVPLTSTSAESTLPAQNVSHPQPR

SEQ ID NO: 25068 - protein, 444 aa, Arabidopsis thaliana
MATITVVKARQIFDSRGNPTVEVDIHTSNGIKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGAASFKEAMKMGVEVYHHLKSVIKKKYGHDATNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 25069 - protein, 202 aa, Oryza sativa
  misc_feature (165)..(165): Xaa can be any naturally occurring amino acid
  misc_feature (172)..(172): Xaa can be any naturally occurring amino acid
  misc_feature (180)..(180): Xaa can be any naturally occurring amino acid
  unsure (1)..(202): unsure at all Xaa locations
IYQWATQFGDRIDETEEMLTDNRIWIERLRGVGVVPAAEALNLSFTGVMLRGSGVPFDVRKNQPYDAYDQVEFDVPVGTNGDCYDRYLCRMEEFRQSLRIIHQCLNKMPAGPVRVEDYKVSPPPRAAMKENMEALIHHFLLYTKGYAVPPGETYSPIEAPPGGDXGVYPPFXGRERPLTXHIGVSGFGHFAGSPPPPQRSFP

SEQ ID NO: 25070 - protein, 198 aa, Gibberella zeae PH-1
MASHDDDTMPEETQGYKLSQPKQSLAEYQQMDAGDESLQRYKESLGLGGGTDISDPNDPRVCIILSLTMDSPGRPPVTIDLSTPGSETTLKDKPFNIKEGAKFTMSAKFKVQHEILSGLHYVQVVKRKGIRVSKDSEMIGSYAPSTDKQPTYIKKFQEEEAPSGMLARGHYNAISSFVDDDKKKHLEFEWSFDIAKDW

SEQ ID NO: 25071 - protein, 491 aa, Oryza sativa (indica cultivar-group)
MPAASSLVVGVAFTAAVAVAVAAAVARRAWRQQGPPVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLELRVEGREAMIYGGTDTTATAIEWSMARVMDNPSIQARLHGEIMQRVGDARPVDDRDTDGMPYLQAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 25072 - protein, 144 aa, Brassica napus
MADAKQQQAAAPTGVWKTIKPFVNGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLP

SEQ ID NO: 25073 - protein, 758 aa, Arabidopsis thaliana
MERNTPVRNPHTSTADLLSWSETPPPPHHSTPSAARSHQPSDGISKILGGGQITDEEAQSLNKLKNCSGYKLKEMTGSGIFTDKGKVGSESDATTDPKTGLRYYQQTLNGMSQISFSADGNVSPKKPTTLTEVAKQRELSGNLLTEADLKSNKQISSAKIEEISGHDIFAPPSEIQPRSLVAAQQEARGNRDMGEPAPRNLRTSVKVSNVSLAIAFALRGNSNLVPNQISKFSLLFQQPAGGQSNILFSEEPVVKTSKKIHNQKFQELTGNGIFKGDESPGSADKQLSSAKLREMSGNNIFADGKSESRDYFGGVRKPPGETTPLGIEPRISGFVDQRLIHWAMESYLTKNFYKRIRVKKEEEEMGKHKSFRSKAVHFVTDLTAGLLNPISDKPSSAHPPPPLPDEEDESKRNQLESTTAEQPKDLVDEPDTSSFSAFLGSLLSSDPKDKRKDQDPEDEEDEEEDEEEDSEAETSDTSSSSANPTRTMKETTSGGAAKKSFLSKYKQHFRNFYQAVKFPGVKERKGNSDVIPDDEETEYYDGLEMKPMQNNNVKEEVTVVVQAIIPEISEPSLLLSEQSRRSLYTSLPALVQGRKWILLYSTWRHGISLSTLYRKSLLWPGLSLLVVGDRKGSVFGGLVEAPLIPTDKKYQGTNSTFVFTNKSGQPTIYRPTGANRFYTLCSKEFLALGGGGRFALYLDSELLSGSSAYSETYGNSCLADSQDFDVKEVELWGFVYGSKYDEILAHSKTMEPGLCRWS

SEQ ID NO: 25074 - protein, 181 aa, Brassica napus
MAYSMLSSAAVVTSPAQATMVAPFTGLKSSSAFPVTRKANNDITSIVSNGGRVNSMQVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 25075 - protein, 351 aa, Populus tremula x Populus tremuloides
MMMASRGEGVKLASSMMLFSRSFSTAISRGIIAKEAVTAKAVECHGDVVRKNIGEFWVRGSVFGVRHGSTMSFGEKDQQKVEMKQTQSVAEGGDKEEKKEIASYWGVPPSRVTKEDGAEWKWNCFRPWETYSADLSIDLKKHHVPATFLDKMAYWMVKALRFPTDLFFQRRYGCRAMMLETVAAVPGMVGGMLLHCKSLRRFEHSGGWIKTLLDEAENERMHLMTFMEVAKPRWYERALVITVQGVFLNAYFLGYIISPKFAHRMVGYLEEEAIHSYTEFLKELDKGNIENVPAPAIAVDYWRLPPDATLRDVVLVVRADEAHHRDVNHFASDIHYQGRELKEAPAPIGYH

SEQ ID NO: 25076 - protein, 179 aa, Triticum aestivum
  misc_feature (80)..(80): Xaa can be any naturally occurring amino acid
  misc_feature (91)..(91): Xaa can be any naturally occurring amino acid
  misc_feature (109)..(109): Xaa can be any naturally occurring amino acid
  misc_feature (118)..(118): Xaa can be any naturally occurring amino acid
  misc_feature (131)..(131): Xaa can be any naturally occurring amino acid
  misc_feature (134)..(134): Xaa can be any naturally occurring amino acid
  misc_feature (137)..(137): Xaa can be any naturally occurring amino acid
  misc_feature (141)..(141): Xaa can be any naturally occurring amino acid
  misc_feature (143)..(143): Xaa can be any naturally occurring amino acid
  misc_feature (147)..(147): Xaa can be any naturally occurring amino acid
  misc_feature (151)..(151): Xaa can be any naturally occurring amino acid
  unsure (1)..(179): unsure at all Xaa locations
MAPTVMASSATSVAPFQGLKSTAGLPVSRRSSSAGLGSVSNGGRIRCMQVWPIEGIKKFETLSYLPPLSTEALLKQVDYXIRSKWVPCLEXFNKVGFVFREHNNSPGYXEGRYWTMWXLPISGATTPKKCXNKXEEXKKGXPXAYFXVNRXPKTCAKWNWVSFIPLRQPGLPRIWEGLK

SEQ ID NO: 25077 - protein, 328 aa, Petunia integrifolia subsp. inflata
MAVNGASSGGLIVSFGEMLIDFVPTVSGVSLAEAPGFLKAPGGAPANVAIAVTRLGGNSAFVGKLGDDEFGHMLAGILKENGVKAEGINFDTGARTALAFVTLRADGEREFMFYRNPSADMLLTPDELNLDVIRSAKIFHYGSISLIVEPCRSAHLKAMEVAKEAGALLSYDPNLRLPLWPSAEEARKQIKSIWDKADVIKVSDNELEFLTGSDKIDDESAMSLWHPNLKLLLVTLGEKGCRYYTKNFHGGVEGFHVKTVDTTGAGDSFVGALLTKIVDDQSILEDEARLKEVLTFACACGAITTTKKGAIPALPTESEALTLLKRGA

SEQ ID NO: 25078 - protein, 96 aa, Zea mays
  misc_feature (27)..(27): Xaa can be any naturally occurring amino acid
  misc_feature (37)..(37): Xaa can be any naturally occurring amino acid
  misc_feature (54)..(54): Xaa can be any naturally occurring amino acid
  unsure (1)..(96): unsure at all Xaa locations
GRSVVHGDDCVFERLTTEYKREVYEVXAYGADTMADXITELVAHTHIYAISLLXPRILLLMKGTHCCGALADHYEPLIANVHQHETPNKASVIPRE

SEQ ID NO: 25079 - protein, 479 aa, Trichodesmium erythraeum IMS101
MAKPIKFGTDGWRGVIADDFTFERVTLVAPIAAKILDKNYADSTNNSKTIIVGHDRRFMAEEFAQVAAEAIQNAGFDVLLTDTYAPTPAFSLAAFQKKALGAIVMTASHNPGKYLGLKVKGAFGGSVPPEITKQIEDLLTVETEKNLVQEGKIETFNPWQNYCETLKKMVEIHSIKSAINEGKLKVFADVMHGAAAGGLQQILGVEIEEVNGNRDPFFDGGAPEPLPRYLSKLFKRIKSYRAANEGSLAIGLVFDGDSDRIAAVDGEGNFLSSQILIPILIEHLTTTHGCSGEVVKTISGSDLFPKVAELYKMPVFETPIGYKYIADRMLSTQVLVGGEESGGIGYGTHIPERDALLSALYLLEAVVMSSEDLTTIYRHLQEKTGFSSVYDRIDLPLLNMGVRSRLLEELINNPVTEVAGQKVLDCITIDGYKFRLADGRWLLIRFSGTEPVLRLYCEATDMQKVKQTLEWAKNWANSI

SEQ ID NO: 25080 - protein, 262 aa, Prochlorococcus marinus str. MIT 9211
MRFRPLLALVLAFCLTFIAAPSSVSASGERGNDKFANIVNTGKANDCPTISAGSGSISVDGGLTDICMHPTEVYVKVARSKRSKADFAPAKIISPRNNTTVEQVYGDMSGGTFKEKGGIDFQLITVLAPNGEEYPFVFSAKEMAVDFKGKSISPGTEASGTTFTPSYRTGDFLDPKSRAKDTGVEYAQGLVALGGDDEELAKENIKRDLSGEGVITLSIDSVDSDTEEFSGSFVAIQPSDNDLGSKEPVDVKIVGELYGRKA

SEQ ID NO: 25081 - protein, 273 aa, Ostreococcus tauri
MQEIINAYNPNHPDYKFRTYFYNVVKDPRMRVKPQNVSERKWRELLDAVGGENNPDCLWPVQYDGFEGLMRRKTEASTEIKAQEEFVQAVETATRQIMQWANTEMTRRMQNIKNKAMEHQHRLIKVFRAINQQQMKSYADANGGATPPVSAEEIELLNRFKDLSKRVNRSAASLPRRAEALAAAARLRQDIAPADEIQISDEEKNRIMDVIEKQRAQIDDIERQIEERFAKREELRARRDAERNDAAQRHSSPLSSYALAPASSLFSQPSLRR

SEQ ID NO: 25082 - protein, 356 aa, Magnaporthe grisea
MSRANPPSNSSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQENNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPDDEPTAPPIPEEFFDFDKHKDNLSKEQLKQFIYQEIMR

SEQ ID NO: 25083 - protein, 645 aa, Vibrio cholerae O1 biovar eltor str. N16961
MSNRKQARLEAKRFIDTLSVEPYPNSQKSYLLGSRPDIRVPVREITLSDTLVGGSKDAPIFEPNEPICVYDTSGVYTDPSHDIDLYKGLPKLREEWIEERRDTHILPSMSSHFARERLADETLDELRYGHLPRIRRAMGQHRVTQLHYARQGIITPEMEFVAIRENSRRLAHQDPSLLQQHAGQNFGAHLPDLITPEFVRREIAEGRAIIPCNINHPESEPMIIGRNFLVKVNANIGNSSVSSSIEEEVEKLVWATRWGADTVMDLSTGRNIHETREWILRNSPVPIGTVPMYQALEKVNGVAENLTWEVMRDTLLEQAEQGVDYFTIHAGLLLRYVPMTAKRVTGIVSRGGSIIAKWCLSHHQENFLYTHFREICEICAQYDVALSLGDGLRPGSIADANDEAQFAELRTLGELTQIAWEYDVQVMIEGPGHVPMHLIKANMDEQLKHCHEAPFYTLGPLTTDIAPGYDHITSGIGAAMIGWFGCAMLCYVTPKEHLGLPNKEDVKTGLITYKLAAHAADLAKGHPGAQIRDNALSKARFEFRWEDQFNLALDPVTARAFHDETLPQESGKVAHFCSMCGPKFCSMKISQEVRDYANNQTLDTTVIDLVMPAESIQLAMQDKSREFLASGAELYHPLVKEPIEE

SEQ ID NO: 25084 - protein, 737 aa, Arabidopsis thaliana
MKIIRKDFVRNGPGSVKMMAEDSDDLWYTYNLIGPEDSVMAITFRKVGGEGRDSTPSLSRIESKYLGKKRSFTRTERVKLKLEVQVEEVDYDKDGDVMRIRGKNIMENEHVRIGAFHTLEIELKRPFLLRKENWDSLALDTLKQASDLAASADLAVVLMQEGLAQIFLAGKSVKSCGARIKTSIPWKHGAGTAGYESVLKKFFENVVQAFLKHVDFSVVRCAVIASPGFTKDQFHRHLLLEAERRQLRPILENKSRFILVHTNSGYKHSLSEVLHDPNVMNMIKDTKAAKEVKALNDFFTMFSNDPNRACYGPKHVEVAHERMAIQTLLIIDGLFRNSDVKTRKKYVDFVESVKDSGGEVFIFSSMHASGEQLAQHTGIAAILRFPLPDLEDIEISDKLGLTWTKWVRVLTSESLFLFQLASQGFIASNIMEKEVDKKFVWVIKDLNVFYPKQSHSDPFLIAGSRWRLLALPKGTNYEFFYQYMGVADSCQSLTSSWRRHVKLRLTIVNGISHKRSIVTDSDLYFDENLPACSYPTVPPPFNLLARDAGFLICREITIVIEVVSLEVIGTSNNDGANSIDLLKQTQQIIDVNGFQVLPSQVESVKRIFEIYPNIASEVPSMKPCLKTLYMNVLLGIIETLCQLPAELSDTDLDEASIAVLFVSQGGFKVDWLEKKLKEVKEKKKNVDNGKARLQQIEEDLQKLNQKRLDLKDILDKEKANDLTANVPLSFNDVLKMF

SEQ ID NO: 25085 - protein, 629 aa, Zea mays
  misc_feature (35)..(35): Xaa can be any naturally occurring amino acid
  unsure (1)..(629): unsure at all Xaa locations
MPKRDKAASPRASPPHTPPPGTDSEAEEANRRPGXASAAEMGTYKCCIFFTRRFALGDTSTPEDVRALFSLYAGGSPYMLADDLRRYLAAWGGADGEVPEQIIDRILQDRSRTPRFGRPALTVDDFLHFLFSEDLNPPLRYSKVHQDMNAPLSHYFIYTGHNSYLTGNQLSSDCSDVPIIKALQLGVRVIELDIWPNSCKDDIDVLHGRTLTAPVSLIKCLRSIKEYAFVASPYPVIITLEDHLTPDLQERVAKMVLEVFGDILYYPESKHLQEFPSPEALKGRVMLSTKPPKEYLEAKGDTMKEKEIEARIKRGEREAAAWGVEVPDIQDEMQVADKDEDELLYRERGADGDDGKETKHVAAEYKHLITIKAGKPKGPLVDAIKNDPDKVRRLSLSEQELAKVAAHHGPNIVSFTHRNMLRIYPKGTRFNSSNYNPFLGWVHGAQMVAFNMQGYGRALWLMHGFYKANGGCGYVKKPDFLMQTCPDGKVFDSKADLPVKATLKVKVYMGEGWQKDFKQTHFDSYSPPDFYVKVGIAGVPLDSVMRKTKAVEDSWVPVWEEEFAFPLTVPEIAVLRVEVHEQDVNEDDFGGQTALPVAELRPGIRAVPLFDHKGLKFKSVKVLMSFEFA

SEQ ID NO: 25086 - protein, 210 aa, Sinorhizobium meliloti
MPSRKLWARTCKTTLRSRSEAAMSRALDKAGRWIGWAFFADLANGLALTFGYMFSRPVTMQYPDKEKWLPYSRYRGHHFLKRDDEGEIKCVACELCARICPCDCIEVVPYEDEKGNRRPAKFEIDTARCLFCGLCEDACPADAIALGQQYEFSSFSSRDLVIGRDDLLAKPGKAMTGGGVVAARLNTERDVLVEASEPRGYNWWRNIRRK

SEQ ID NO: 25087 - protein, 335 aa, Prochlorococcus marinus str. MIT 9211
MATITGGIDIKVFFLVIFRVIEGFTKKRMSDLQVLLVAGTHGNEINASWLLDQWKKNPGLIKTHGLGFSTVIGNPLARQLCKRYIDRDLNRSFSKDLLNSSKIDDYEIKRAKELLDLYGSRAIEPCQIAIDFHSTTSSMGSSLVVYGRRPADLALAGLIQNRLGLPIYLHEGEKSQTGFLVESWPCGMVVEIGPVSQGVLHNKIINQTLIALQTFIDEIALAKSGKAKFPKNILVHRHLKSIDFPRDESGNQCGFIHSQIQGKDWIPINRETPLFEDTEGNTVKLSAENFQEDLIPVFINEAAYLEKGIAMSLTVRESWRFERNWYEDLKKIVIR

SEQ ID NO: 25088 - protein, 503 aa, Debaryomyces hansenii CBS767
MPQDTETMYSGRVVNKVYNQDFIIDRRFKIVKELGHGAYGIVCSAKYDDGSDNEDGSYVAIKKITNIFSKKILCKRSLRELKLLQFFRGHKNITCLYDLDIIPNPITGEFNEIYLYEELMECDMHQIIRSGQHLTDSHYQSFIYQTLCGLKYIHSADVLHRDLKPGNLLVNADCELKICDFGLARGFLECPEQNVGFMTEYVATRWYRAPEIMLSFTNYTKAIDIWSVGCILAELLGGKPIFRGKDYVDQLNQILLILGTPKESTLTKIGSVRAQNYVRSLPFMRKVHYSELFPTANPLALDLLEKMLTLDPYERITVEEALNHPYLSVWHDPQDEPECQIKFDFKSFETVDDMKSMKNLIIDEVKNFRDFVRKPLQEQQQIQLQMQIQQQEREKQKNDSMDLSTPINQQQFNEMLSSSSNSNSNSNSNPETGVNTDTPKMTNDNDLQYYQSIPKPQELDEFTFSHNSKGLSPTDNNDNHTDLFRLEEELGFGLDGAGMFNNI

SEQ ID NO: 25089 - protein, 542 aa, Leuconostoc mesenteroides subsp. mesenteroides ATCC 8293
MTTTGYSILRNPFLNKGTAFSAAEREQLGLTGTLPSQVQMIEEQAEQAYKQFQAKSPLLEKRTFLMNLFNENVTLFYHLMDQHVSEFMPIVYDPIVAESIEQYNEIYTNPQNAAFLSIDHPENIESSLKSVADGRDIKLVVVTDAEGILGMGDWGVNGVDIAVGKLMVYTAAAGIDPATVLPVSIDAGTNNKILLENPLYLGNKHERIAGEKYLEFIDKFVTAEQKLFPASLLHWEDFGRSNAQVILDKYKDSIATFNDDIQGTGMIVLAGIFGALNISKEKLVDQRFLTFGAGTAGMGIVNQIFSELKQAGLSDAEARSHFYLVDKQGLLFDDTEDLTEAQKAFTRSRKELVNSEQLDNLEAVVNEIRPTVLIGTSTQPGTFTEAIVKSMAQNTERPIIFPLSNPTKLAEATAENLIKWTDGKALIATGIPAANVTYKGVTYKIGQGNNALIYPGLGFGLVASTAKLLTQETISAAIHALGGLVDADEPGAAVLPPVSNLTEFSQKIAEITAQSVLKQGLNREKIADPKQAVQDAKWSAEY

SEQ ID NO: 25090 - protein, 453 aa, Thermobifida fusca YX
MNRQQEFVLRTLEERDIRFVRLWFTDVLGYLKSVAVAPAELEAAFTEGIGFDGSAIEGFARVYESDMLAQPDPTTFQVLPWRNEPHGAARMFCNILLPDGSPSYADPRNVLKRQLSRASDLGFTFYTHPEIEFYLLKKKPERGELPEPSDEGGYFDHTPHSLARDFRRNAIMMLEEMGISVEFSHHEGGPGQQEIDLRYADALTTADNIMTFRMVMKEVAIEQGVYATFMPKPFTEHPGSGMHTHMSLFEGDRNAFYEAGAEYQLSKIGRGFIAGLLRHAAEITAVCNQFVNSYKRLWGNAAASAGAGGEAPAYICWGHNNRSALVRVPMYKPRKSNSARIEFRALDSACNPYLAFTVILAAGLKGIEEGYELPPGASDDVWALTDAERRALGIMPLPQSLDEALRVMERSELVAEALGEHVFDFFLRNKKAEWEDYRRQVTPYELERYLPTL

SEQ ID NO: 25091 - protein, 466 aa, Escherichia coli O6
MDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 25092 - protein, 209 aa, Trichodesmium erythraeum IMS101
MITSNFKTQENVSQAITLASWLAGEYSSIKYTLEDARTNPHIRIFFRPLPYDFFGGIGFYSEEIYDHDPWHPHYQFVKRVIPQGDSVRVENYALKDPDLHTGAGQDLEILATLTPDNIELRKGCAMIFKRQGDTFVGGVEPGHKCLIPRGDGSMTYLVSEVKVTQKTWTSRDTGYDVNTHEKIWGSNSGPFKFDKVQDFSGEIPDIAIL

SEQ ID NO: 25093 - protein, 335 aa, Desulfotalea psychrophila LSv54
MKVKATGGPAGAGVDPAHARQLLYQMVRIRRFEEKAAELYTKMKIRGFLHLYIGEEAVAAGVSAALEPEDATVATYREHGNALARGISAGAIMAEMYGKQEGCSRGRGGSMHIFDDKTRFYGGNAIVGGGLPLAVGLALADKMQGKKRVTCCFFGDGAVSEGEFHESMNLAALWNLPVLFICENNLYAMGTALERSQSVTDLTRKAVSYRIAASAVDGMDVLAVEAAANEAVNAVRSGQKPYFLECRTYRFRAHSMFDPELYRSKAEVEKWKKRCPISSFVKRLKKQDLLDDGDVEELERQVAREIEEAVAFAENGTWEPVEDLMRFVYSERGAA

SEQ ID NO: 25094 - protein, 945 aa, Oryza sativa
  misc_feature (186)..(186): Xaa can be any naturally occurring amino acid
  unsure (1)..(945): unsure at all Xaa locations
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAYNILLKIPVWAGVILTVFSTLLLLGVQRFGARKXLEFINTAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSEFALLLQKQQYPEFLIWIQMILSFELPFALIPLLKFCNSSKKVGPLKESIYTVVIAWILSFALIVVNTYFLVWTYVDWLVHNNLPKYANGLISVVVFALMAAYLVAVVYLTFRKDTVATYVPVPERAQAQVEAGGTPVVDASAADEDQPAPYRKDLADASIICISNWEDEDFIAWHPDLHGRFSVRSAYYLALNLKNQEDTGPSNMAGDRRWDLIWKCEVPQKVRSFAWKVATDSLATMANKTKRKLERIATCGVCGSETEDTQHALLRCSQSRFLLMAMQGDGHFPVLTDVRMDNKAWLFDLLDRLSESERAALLLVLWRNWFVRNEIVHEKTPPTIESSKRFLESYIQSLFNIRQKSVVGSEKGKNVLICLGLWERGPSRIKTSLQTKMGETANRMVEEKGGIGIVMRDWEGRVIFASCKTLNSCHSALEAELVACREGIALALQWTLLPVQVETDCLVALQMIQAKEVERSELAFAVREIKDLLAGSRECLLRKVHRSQILVSHMLANKSRSENLSGFWCENDCTFISKLVIDDIIPE

SEQ ID NO: 25095 - protein, 455 aa, Ostreococcus tauri
MTAINDDVDIAVSFVTRLPERYRVSESAIEVPGRLTRYGLSEVVNHLLGNEKPTPFDFLIDGALLRTSLAKLALRLGKSAEATLSRAKEWISSIDGSWRRDRDWFVRRKAYVWSPKGKLMCELDGHCERVCAVSLAPPAGDAENSCVVISASADGSVRAHELTVTGTKCDIGEVRVFKGHESTVLDVASAIGTRLFASSSVDGTARIWRLEGGELATEKPTKKRKKPSKMTGGDDDDDDDAENNGLGEELVLNGHTDQVCAVSWESSRVLWTGSYDHTIRAWDVETGVEKESNPTNSSVHCLSVAPSGNVFAFGGCDRFVNVWDPQVADEQLLDSRTLVREGTINHSNFLLRLFLYIFRAENCFGKRQVTDRSLKSSQGWVSCLRWNPSNENHIVSTSYDGSVKLWDIRGKVPLHSVTTHNGKNFAVDYHGGERLVSGGDDGNLRFWNVSSTLDD

SEQ ID NO: 25096 - protein, 522 aa, Oryza sativa (japonica cultivar-group)
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 25097 - protein, 169 aa, Frankia sp. EAN1pec
MVTWRPAGRGGQNGRVTARASDLDPAIARQLKRDGSGLFPAVAQQYDSGEVLMVGWMDDEALHRTLTTGRATYWSRSRAEYWVKGDTSGHVQWVRSVALDCDGDTVLVQVDQVGPACHTGTRTCFTARELQVGGARPLQPPAVNPTPTPTSTPMSMPAAAPAPTTGAPR

SEQ ID NO: 25098 - protein, 274 aa, Brassica napus
  misc_feature (210)..(210): Xaa can be any naturally occurring amino acid
  misc_feature (244)..(244): Xaa can be any naturally occurring amino acid
  misc_feature (262)..(262): Xaa can be any naturally occurring amino acid
  unsure (1)..(274): unsure at all Xaa locations
STHASVYLHAHGHIHRDVKAGNILLDSSGTVKLADFGVSACMFDTGDRQRSRNTFVGTPCWMAPEVMQQLHGYDFKADVWSFGITALELAHGHAPFSKYPPMKVLLMTLQNAPPGLDYERDKRFSKAFKEMVGTCLVKDPKKRPTSEKLLKHPFFKQARPPDYLAKTILNGLPPLGERYRTIKSKEADLLMQNKSEYEAHLSQQEYIRGXSAWNFNLEDLKNQAALISDDDSSHAEEPDFNKKXCEIQDESALSPERASSSXTAPSQDDELTTL

SEQ ID NO: 25099 - protein, 535 aa, Arabidopsis thaliana
  misc_feature (497)..(497): Xaa can be any naturally occurring amino acid
  misc_feature (506)..(506): Xaa can be any naturally occurring amino acid
  unsure (1)..(535): unsure at all Xaa locations
MSFDELLRFVSEVQGERHAGLDYVQDIFHSVKHHNVFHHHGLVHLNAFYRYLFSDTNSPLPMSGQVHHDMKAPLSHYFVYTGHNSYLTGNQVNSRSSVEPIVQALRKGVKVIELDLWPNPSGNAAEVRHGRTLTSHEDLQKCLTAIKDNAFHVSDYPVIITLEDHLPPKLQAQVAKMLTKTYRGMLFRRVSESFKHFPSPEELKGKILISTKPPKEYLESKTVHTTRTPTVKETSWNRVANKILEEYKDMESEAVGYRDLIAIHAANCKDPSKDCLSDDPEKPIRVSMDEQWLDTMVRTRGTDLVRFTQRNLVRIYPKGTRVDSSNYDPHVGWTHGAQMVAFNMQGHGKQLWIMQGMFRGNGGCGYVKKPRILLDEHTLFDPCKRFPIKTTLKVKIYTGEGWDLDFHHTHFDQYSPPDFFVKIGIAGVPRDTVSYRTETAVDQWFPIWGNDEFLFQLSVPELALLWFKVQDYDNDTQNDFAGQTCLPLPELKSGVRXPSGFTIEQXQGLQEHEASRQLRLGSSLYVSLNLVFFPK

SEQ ID NO: 25100 - protein, 677 aa, Nicotiana tabacum
MKQHLKTLLLYLLITILSCIQSASATDFVFNGFKPSDMSAYGDATIESGILSLTLDATSFSDGRALHPSKIVTKAPNSSQVLPFSTSFIFAMAPYRDRLPGHGIVFLFVPHTGIYRGSSSSSQNLGFLNFTNNGNPNNHVFGVEFDVFKNQEFNDINNNHVGIDVNSLESVFAHEAGYWPDKYNKYNDNGILNEEFFKTLKLNNGRNYQVWIDYADFHINVTMAPVGMKRPKQPLLDFPLNLSQVFEDEMYVGFTASTGSLAQGHKILAWSFSNSNFSISDALITHGLPSFELPKDPIYQSKGFIAGMTILLFFLVVVTSLLLIKRNRRMKREKEGMEDWELEYWPHRITYQEIDAATKGFADENMIGIGGNGKVYKGVLAGGSEVAVKRISHESSEGARQFLAEISSLGRLKHRNLVALRGWCKKGRGSLILVYDYMENGSLDKRLFECDKGNMLSFEDRIKILKDVALGVQYLHEEWEAKVLHRDIKASNVLLDKEMHARIGDFGLARMHYHGQVANETRVVGTVGYLAPEFAKTGRASTQTDVFSYGVLILEVMCGRRPIEEGKPPLMDWLWELMKQGELSNAFDNQLRSNQGFNEEEALRVLQLGMICASLDPKARPTARQVVKFFERNSEVAESEAEDMDFYLLESMRPNTILSNYCSSRPISWTNSLVEGR

SEQ ID NO: 25101 - protein, 195 aa, Frankia sp. EAN1pec
MARTARVERKTKESHVLIELDLDGTGLASAETGVPFFDHMMEQLGKHGGFDLTVRTEGDLHIDAHHTVEDTAIAFGTALREALGDKAGIRRFGDATVPLDEALVQSAVDLSGRPYCVHVEPELVGLIGTYDTTLTRHIFESITASARIALHVRVLSGRNAHHVVEAQFKSVARAMRDAVALDARVAGVPSTKGVL

SEQ ID NO: 25102 - protein, 187 aa, Arabidopsis thaliana
MDSSTSTKKNTKLFVRNQTCFKKSSLSSSNAKKTTNLSMREQTMFKKALELSTLCDIEVCVIYYGRDGKLIKTWPEDQSKVRDMAERFSRLHERERCKKRTNLSLFLRKQILHDKKLSEKVLEMEDSLESGLRVLQDKLLLLQPEKNQTELGQSCAVYSTTYPLSSPSLIEDHQHQQQWTEPLSNTE

SEQ ID NO: 25103 - protein, 381 aa, Gloeobacter violaceus PCC 7421
MRHASMPRILIFHASLGSGHIHAANALGEAFSRYPDVEVRIEDALAYASPILRETLIRAYEQLSEKAPQLYRLIYEGSDVSDLKESMSNTLLLSKIERPFFRKFEQLIKQTAPDVFICVQQIPSRLVQLFKQEFDWPQPHYVVITDAVAHSTWINYEVDGYFLASDLTANILTKQGVDPELLHVTGIPVKLEIAEAKPARQMRERHDLPLDAPVIALFGGGLQPRRVRLMVAGLLESPFAGTLAVVAGRNHALGTALADLEDGPAMRLRSLGQIDFVDDLIAASDLVITKAGGLIASEVMARGTPMVIVDPIPGQEEWNADAIAAYGAGIQLRLPEMVAPTVQFLLSAPEHLAFMRFQARKYGRPTAALAVVESILARLSV

SEQ ID NO: 25104 - protein, 116 aa, Xylella fastidiosa Ann-1
MSMSEETIFAKIIRREVPATIVYEDEEVLGFKDIMPRAPVHVLFIPKRQIIPTLDDLHPEQGPLIGKLVLAAAEYARREGFAQDGYRIVMNCREHGGQTVFHLHLHLLAGAPLGTW

SEQ ID NO: 25105 - protein, 455 aa, Zea mays
  misc_feature (234)..(234): Xaa can be any naturally occurring amino acid
  unsure (1)..(455): unsure at all Xaa locations
MTKKQRREAGAMRRRDRHHHHRRQPRDERCVSCTTFNILAPIYKRMDNENCRESQYRAYWFSRNEKIIDRLLADHSSIICLQEVWLGNDELVDMYQKRLGDANYMLFKLARTNNRGDGLLTAVHRNYFNVLNYRELLFNDIGDRVAQLLHVESAMPFLQNRSTSCVHQQSLIVNTHLLFPHDHSLSIVRLRQVYKILQYIEAYLEEHKLGPLPIILCGDWNGSKRGQVYKFLRXSQGFVSSYDTAHQYSDSEEDAHKWVSHRNHRGNICGVDFIWLLNPDKCRKPLKTSWNEAVFGIIKYFLQVAFLSEENAFALLKADSLYDHITYSSFYQALCQLGMVHPDRLKSEEIEELWSEADRDGDGVINYKEFQCIWSPNCCSQEEEDTEIDITDESLDTFEANNEAFGFTVKEAVLFPPEVEKGMWPENYSLSDHAPLTVVFSPIRMPCSPRNRGEL

SEQ ID NO: 25106 - protein, 474 aa, Thermobifida fusca YX
MFSNADEALAYIRTEGVQFVDVRFTDLFGGVHHVTLPAEKVDEDFLTNGQMFDGSSIRGFQAIHESDMLLLPDLSTAVLDPFREYKTLNITFFVHDPLTRESYSRDPRNVARKAEAYLKSTGIADTAYFGPEAEFYIFDDVQFATAPNTGFYAIDSVEGAWNTGSKREGGNLGYRPRYKGGYFPVEPSDHYSDLRSRMVRTMIEVGLPVELHHHEVGTAGQSEIGIKFGTLLQQADRVQLYKYIVKNVANAAGKTVTFMPKPLFGDNGSGMHCHQSLWKDGAPLFFDENGYAQLSDIARYYIGGLLKHAPSLLAFTNPTINSYHRLVPGYEAPINLVYSQRNRSACIRIPLTGSDPKAKRLEFRVPDPSANPYLAFSAMLMAGIDGIQNKIEPPEPLDKDLYELPPEEAAEIEKVPASLEEALDHLEEDHEYLVEGGVFTEDLIETYINYKRTVEIDSVRLRPHPREFELYYDV

SEQ ID NO: 25107 - protein, 341 aa, Desulfotalea psychrophila LSv54
MSEKSMGGGMSEKSMIQTTYREAVRAAMREAMQRDERVFLLGEDVGRYGGCFAVSKGLLEEFGPERIIDTPLSESAFTGAGIGAALGGMRPIVEIMTVNFSLLAADQIINNAATFLHMSGGLFNVPLVIRMSTGGGKQLAAQHSHSLEGWYAHIPGIKVLTPATLEDARGMLWTALEDPDPVLIFEHQGLLNMEGPLAADAGAVDIDRALIRRRGRDLTIITYGASLFKALDAAEALAGEGIEAEVIDLRTLRPLDEETFLSSIATTHRALIVDEGWRSGGISAEISARIMEGAFYDLDAPVERICGAEVPMPYAKHMEEAAMPQAETIVTTAKRMVGSND

SEQ ID NO: 25108 - protein, 397 aa, Desulfotalea psychrophila LSv54
MTEFRMPSLGADMKEGRLVEWKVKLGDQVKRGDIIAEVETAKGVIEIEVFTDGVIEQILVQRGEKVPVGTVLATIRTAGEQGKVPGEAAPPEPVFKYKACLIAAHREEPAAEPPPAVATAAGKRLRISPLARKLAAELAVELSTVQGTGQGGAITHADIKRAAATKKASAPQVPSAPGAAMRQAIATAMARSNREIPHYYLATRIDMSNTLRWLEAENKKRSIKERILPVVPLIKATALALAKVPELNGYWVDNRQQPEEAVHIGFVISLRQGGLVAPAIHHADLKSLPELMEALYDLITRARSGHLRSSELTDATVTITSLGDLGVEVVHGVIYPPQIALVGFGKILEQPWAKDGMLGIRPILTATLAADHRATDAHRGAQFLEALNHHLQKPEEL

SEQ ID NO: 25109 - protein, 580 aa, Thermobifida fusca YX
MSTPVTMPDLGESVTEGTVTQWLKQEGDTVEVDEPLLEVSTDKVDTEIPSPVSGVLTKILVGEDETVEVGAQIAIITPAGEAPPAQPAPETAAEPAAQPEPEPEPAPQPAAEARTEPAAPVADAGAATPVTMPNLGESVSEGTVTQWLKQEGDTVEADEPLLEVSTDKVDTEIPSPVSGVLTKILVGEDETVEVGAQIALISPAGQAAAPAAPAAPQPAPEPKPEARPEPAPQPAAQPEAAARTEPAPQPRRTRDDETPTVDLETISGTGQVLGTDATSEGYVTPLVRKLAAQEGVDLSQVKGTGVGGRIRKQDVLEAARRMREQRQRAAAAPAPAAADTALRGRTETMSRLRQTFAEQIVESLHTAAQLTQVVEVDVTAIARLREQVGERFAAETGVELGFFPFFALAVVEALQRHPKLNAVIDGTEVTYHDTENLAVVVDTEQGVLAPVVKDAGRLSLRELARRIDDLGARARTARLVPDELSGGTFTMVDSGAYGALVETPIIHQPQVAVLSTGTVVKRPVVVEEPQLGEVITVRSMVYLSLSFDHRLIDGADAARFLSDVKRRLEEGAFEDAVGLK

SEQ ID NO: 25110 - protein, 650 aa, Symbiobacterium thermophilum IAM 14863
MEKAKSGHPGAPMGCADMAFVLWTQFLRFDPENPEWPNRDRFILSNGHGSMLLYSLLHLSGYDLDMEQIQSFRQWGSRTPGHPEYGHTPGVEVTTGPLGQGIAHAVGMAAAAEMLAARVNTDDFRPVDHYIYGICGDGDLMEGVVAEAAALAGQWKLGRLIFLYDDNEISIEGNTDIAFSEDVAKRFESYGWHVDRCDGHDHLAIAAAIERARAVTDKPSLIICRTVLGHGSPNKAGKAVAHGAPLGPEETRLTKEALGWPQEPAFYVPDEVRQFFAELKAEKQAEARRWQEQFDAWRQANPEKAQLWDQHKNLMVPADLDAQLVEAARSEKPLATRKYSEMVIQRAAALVPSLVGGSADLAESNLTTIKGGGDVGPACRIDEYDFSWSGRNFHFGVREHAMGSIVNGVVLYGGFRAYGATFLVFSDYMRPPIRLAALMQVPSIFVFTHDSFFLGEDGPTHQPVEHLWSLRMIPHVTVFRPADGLETAMAWAYALMEAKEPTILALTRQNVPHLERPAGFAIRDVWKGGYVVSDAANPVATLIATGSEVGLAVEAQKLLAERGIAVRVVSMPSVELFLRQPREYQEQVLVGRLAAIEAGRTDGWYRIIGRDGLAIGHEDFGASAPAGVLAEKFGFTPAQVAARVVEWLEG

SEQ ID NO: 25111 - protein, 459 aa, Thermobifida fusca YX
MSESGGTFDLVILGGGSGGYSAAIRASELGMRVALIEKDKLGGTCLHYGCIPTKALLHAGEVADTVRASEKFGVRASFDTIDMARVHEYKDKVVSGLHRGLTGLIKARGITLVEGEGKLTGVDEVTVNGVAYKGRHIILATGSQARSLPGLEIDGERIITSYEALRLDRVPKSAIILGGGVIGVEFASVWRSFGAEVTIVEALPHLVPAEEESSSKLLERAFRKRGIKFELGSPFESVKLTETGVSMTLASGKTVEGELLLVAVGRGPVSQGLGYEEVGIRLERGFVQVDENLHTGVGNIYAVGDLIPTPQLAHVGFAEGIFVAEHIAGLNPVNIDYDGIPRVTYSDPEVASVGITSKTAAERGIETTEFVYNLAGNGKSQILQTQGAVKVIAAKDGPVLGVHMVGSRVGELITEGQLIYNWEALPSEVAQLIHAHPTQSEALGEAHLALAGKPLHVHD

SEQ ID NO: 25112 - protein, 521 aa, Glycine max
MFKQIFSKLPRKSSKGSEHGGSGRTHHGVTTSSKSSESVSVTPGGTKPGNSSSAGPNHGNRVPLPLAVNENNIHNNPNNGNFGSYEALPAFRDVPSSEKPTLFIKKLRMCCVVFDFTDPAKHIKEKEIKRQTLVELLDYVTSANAKFVENMMQEVVKMVSANIFRTLSPQPRENKIVDGVDVEDEEPSMDPAWPHLQIVYELFLRFVASPELDAKLAKRYIDQSFILKLLDLFDSEDPREREYLKMTLHRIYGKFMAHRPFIRKAINNVFFNFIFETEKHNGIAEFLEILGSIINGFALPLKEEHKLFLVRILIPLHKPKCLAMYHQQLSYCITQFVEKDCKLADTIIRGLLKYWPITNSPKEVMFLSELEEVLEATQPPEFQRCMVPLFRRIARCLNSPHFQVAERALFLWNNDHIMSLIKQNRKVIMPIIFPALERNARSHWNQAVHGLTLNVRKIFNDVDADLSKECLQKFEEEESKKSEVMAGREATWKRLEELAAKKAASGEAVLIGKAPPRNSAG

SEQ ID NO: 25113 - protein, 82 aa, Oryza sativa
  misc_feature (12)..(12): Xaa can be any naturally occurring amino acid
  unsure (1)..(82): unsure at all Xaa locations
MPATPTSIVGPXLGLGTQMYSNALRKLPYMRHTWEHAVGMDLGARFVNQLVQCDEKLKEESRMMLARTKQASERRYSDDDDD

SEQ ID NO: 25114 - protein, 385 aa, Triticum aestivum
  misc_feature (117)..(117): Xaa can be any naturally occurring amino acid
  unsure (1)..(385): unsure at all Xaa locations
MLRLRGCVLTQLLSSSSASPVSHLRRLLSAAAPAISPSIGFAVEDYLVRTCGLTRPQAAKASPKLSHLKSPAKPDAVLAFLAGLGLSAADVAAVVAKDPLLLCAKVEKILAPRRRRXSPGLGLSRPQIAHLVSVAGEKFRCRAIIDRLHYYLALFGSSGKLLRVLDRSPYILSSNLERVVKPNAVFLRECRIGACDIAKLCVAQPRMLTSNVERVRAMAASAEGLGVPRGSRMFWRMLNALAFLREKDITAKVEYLKDTFRWSDAEVGIALCKALMVLALSKDLLQRKLEFLISEVGLEPAYIAHRPTVPTYSLEGRLRPRYYTLKFLKENGLLDHDRDYYCAVMLREEVFMEKFICPYKEAAPQLAEDYAAACKGEVPARFRFT

SEQ ID NO: 25115 - protein, 319 aa, Arabidopsis thaliana
  misc_feature (179)..(179): Xaa can be any naturally occurring amino acid
  misc_feature (184)..(184): Xaa can be any naturally occurring amino acid
  misc_feature (193)..(193): Xaa can be any naturally occurring amino acid
  misc_feature (237)..(237): Xaa can be any naturally occurring amino acid
  misc_feature (317)..(317): Xaa can be any naturally occurring amino acid
  unsure (1)..(319): unsure at all Xaa locations
MKSRRQNVSVARQTILGRDENFEPIPIDLVIEIFSRSPVKSIARCRCVSKLWASILRLPYFTELYLTKSCARPRLLFACQKHRELFFFSTPQPHNPNESSSPLAASFHMKIPFDGRFNIISPIGGLVFVRYEQILKGRKTPEFVSAICNPSTGQSLTLPKPKTRKRIWGTSHFGYDPIXKQFKXFEKFSYIKXLKPTTTLISYNGKLASLVWEGPGYICGKRFEMWVLGDPEKHEWXKHTYELRPRWQNVLGEDLLIFAGMTGTNEIVLSPKYPSHPFYVFYYNLERNTIRRVEIQGMGAFKVNEDYIFLDHVEDVXLI

SEQ ID NO: 25116 - protein, 576 aa, Ostreococcus tauri
MSTYVYVDADGGGTERKAVQRRTVDYTATTVRYVEERLYSKDPWDSPACLPRPLPGALLDFMPPVAYPHLPATSFATKFVHVSSNKIRTSVNKVAFMPDGRRLLTCSQNGEFTLWNGMSFNFETILQAHSGPIRCAEFSNNDNWLLTGDDEGNVKYFQMTFNNLRSFQVHKEPVTSISFARSDLKFATGSDDATVKIVDFARAETEYTLSGHTGDVKTVQWHPWLGLVASGGKDGAVKMWDPKSGHCATTMHGHKGAITCSKWNKNGNWLVTGSKDQTLKVWDLRMLKEIGTYRGHGKDVTEVIWHPTHEPLFTSGSLDGSMNYWLVGAGEAPHAEIKGGHEGAILSLAWHPAGHILVSGSADNTTKFWCRNRPGEVARDTAAGRMPAGGAVEEVIPTTVPRPNAPPGLPPGLTPSDYTRAMWDKDFKVTETVTLKDGALEAVLTVENPGEEAFEFTGSFHTYLAADINKAAVGGLNGCKTFDRLGESESTVNGDVKFSGPIDSVYYGVPETLTLATGKRTVTIKSSKAWTEAVVWTPWTDMPACYEEFACVESAAVTPVTVAPGTSWTATTTLSA

SEQ ID NO: 25117 - protein, 546 aa, Streptomyces coelicolor A3(2)
MQHDRAGRPAGPEDLIDVARLVTAYYALHPDPGEPAQRVAFGTSGHRGSSLVAAFNDDHIAATSQAICEYRSAQGTDGPLFLGADTHALSEPARVTALEVFAANDVTVLIDSADGYTPTPAVSHAILTHNRGRTSGLADGVVVTPSHNPPADGGFKYNPPNGGPAGSDATSWIQDRANEIIAAGLKDVRRIPYARALAAPGTGRHDFLDAYVRDLPSVLDLDAIRSAGVRIGADPLGGASVAYWGRIAEQHRLDLTVVNPLADPTWRFMTLDWDGKIRMDCSSPHAMASLIQGRDRFDIATGNDADADRHGIVTPDAGLMNPNHYLATAIAYLYAHRADWPAGAGVGKTLVSSGMIDRVAADLGRRLVEVPVGFKWFVDGLVDGSLGFGGEESAGASFLRRDGSVWTTDKDGIILALLASEITAVTGKTPSEHYAALTARFGDPAYARIDAPATREEKARLARLSPAQVTADTLAGEPVTAVLTEAPGNGAPIGGIKVTTENAWFAARPSGTEDVYKIYGESFLGADHLRQVQDEAKLVVLGALGG

SEQ ID NO: 25118 - protein, 432 aa, Prochlorococcus marinus str. MIT 9211
MIDSLDLVIDTVLAREVLDSRGNPTVEAEVLLEGGAIGRAIVPSGASTGAYEAHELRDAGDRYFGKGVLKVVENIEERIAPTICGLSASDQATIDGVMSELDGTENKSKLGANAILAVSIATARSAANGYGMPLYRYLGGPMASLLPVPLMNVINGGAHAANNLDFQEFMLVPHGANTFREALRMGAEVFHTLKQLLSEKGLSTAVGDEGGFAPNLQSNQAAGDLLVKSIEKAGFIPGEQISLALDVASTEFFKDGAYFFGGRNYSTEGMIEELVKLVNAYPIVSIEDGLAEDDWEGWGLLTKELGEKVQLVGDDLFVTNTSRLQRGINQKVANSILIKVNQIGSLTETLQAIDLANRSGYTSVISHRSGETEDTTIADLSVATRAGQIKTGSLSRSERVAKYNQLLRIEDELGSEATYAGSNDLGPLCGKK

SEQ ID NO: 25119 - protein, 636 aa, Schizosaccharomyces pombe
MSDNVQQQVDSVGSVTEKLQKTNISRPRKYIPPFARDKPSRGAAPAVGDDESVSSRGSSRSQTPSEFSSNYGGRREYNRGGHYGGGEGRQNNYRGGREGGYSNGGGYRNNRGFGQWRDGQHVIGARNTLLERQLFGAVADGTKVSTGINFEKYDDIPVEVSGGDIEPVNEFTSPPLNSHLLQNIKLSGYTQPTPVQKNSIPIVTSGRDLMACAQTGSGKTAGFLFPILSLAFDKGPAAVPVDQDAGMGYRPRKAYPTTLILAPTRELVCQIHEESRKFCYRSWVRPCAVYGGADIRAQIRQIDQGCDLLSATPGRLVDLIDRGRISLANIKFLVLDEADRMLDMGFEPQIRHIVEGADMTSVEERQTLMFSATFPRDIQLLARDFLKDYVFLSVGRVGSTSENITQKVVHVEDSEKRSYLLDILHTLPPEGLTLIFVETKRMADTLTDYLLNSNFPATSIHGDRTQRERERALELFRSGRTSIMVATAVASRGLDIPNVTHVINYDLPTDIDDYVHRIGRTGRAGNTGQAVAFFNRNNKGIAKELIELLQEANQECPSFLIAMARESSFGGNGRGGRYSGRGGRGGNAYGARDFRRPTNSSSGYSSGPSYSGYGGFESRTPHHGNTYNSGSAQSWW

SEQ ID NO: 25120 - protein, 71 aa, Enterococcus faecium
RSVGVMGDGRTYDYTVGIRAVTSIDGMTADFARIPWEVLQKISVRIVNEVAHVNRIVYDITSKPPATVEWE

SEQ ID NO: 25121 - protein, 697 aa, Nicotiana tabacum
MNQHLKTLLLYLLITIFSCIQSVSAIDFVFNGFKPSDISLFGIATIESGILTLTNDSTFSIGRALHPSKIVTKAPNSSQVLPFSASFIFAMAPFKDRLPGHGIVFLFVPQTGIDGTTSSQNLGFLNFTNNGNPDNHVFGVEFDVFKNQEFNDINDNHVGIDVNSLASVFAHEAGYWPDKYNKFSDDGSLNEESFETLKLNNGRNYQVWIDYADFQINVTMAPIGMKRPKQPLLDFPLNLSQVFEEEMYVGFTASTGDLAQGHKILAWSFSNSNFSISDALITQGLPSFELPKDPVHRSKGFIAGMTVSLLFLVVVTAVVSLFLIKRNRRMKREREEMEDWELEYWPHRISYQEIDAATKGFADENVIGIGGNGKVYKGVLAGSSEVAVKRISHESSEGARQFLAEISSLGRLKHRNLVSLRGWCKKDRRSLILVYDYMENGSLDKTLFECDETNMLSFEDRIRILKDVASGVLYLHEGWEAKVLHRDIKASNVLLDKDMNARLGDFGLARMHDHGQVANTTRVVGTVGYLAPEFVKTGRASTQTDVFGYGVLVLEVMCGRRPIEEEGKPPLLDWLWELMRRGELINAFDRRLRTSQDFNEEEALRVLQLGMICASLDPKGRPTMRQVVKFFERNSEADESEAEDMDVYLLETLRSNTMLSNFSLSLSHGSHPTFEEIREGLSSSMSISWTNSLVDGR

SEQ ID NO: 25122 - protein, 329 aa, Glycine max
MESLPKIRHSHISLNHSLLQRGSQCHRSSFPTPFSSLSPPLPPFSPIRVSSSPSPSPKPQNPLTLNLLLPPLVKPTCIAIAATAFFFMRLHSPPVAFASTPVAPPESAESETLPNESATEEQLRTTDTDALQSLLQTKIRALEINEAIRVLDRLSELEPEESEYPLLKAHLHMRYGEHELAAKVFEELLHRDPFHVEAYRGLLMLTSETNKPTEELLKRIEEAAAKVCEEQERDSDVRDLKLLIAQIKVINGDLSEALKVYEELVKEEPKDFRPYLCQGIVYSMLRKKDEAEKQFEKYRALVPEDHPYKHHFEENTQFLERRGVGGAKS

SEQ ID NO: 25123 - protein, 152 aa, Oryza sativa
  misc_feature (50)..(50): Xaa can be any naturally occurring amino acid
  unsure (1)..(152): unsure at all Xaa locations
MALEQTFIMIKPDGVQRGLIGEVIGRFEKKGFYLKAMKLINVEKSFAEKXHYADLSSKPFFGGLVEYIVSGPVVAMVWEGKQVVSTGRKLVGATNPLAAEPGTIRGDFAVDIGRNVIHGSDSVENARKEIALWFPEGIAEWRSNQHPWIYEV

SEQ ID NO: 25124 - protein, 312 aa, Symbiobacterium thermophilum IAM 14863
MPLAREAEAFLKQLAEAGGPALNELSPADARKMTEQMAAFGGDAEPVAGVVDRTVPGPAGKIPVRIYTPAGEGPFPVLLYFHGGGWVLGSPDTVHATCALLANRAGAVVVSVDYRLAPEHKFPAAAEDCYAATVWVAENARTIGGDPRRIAVAGDSAGGNLAAVVSLMARDKGYPDLAYQVLIYPVTDHNFDTPSYRENGNDYFLTTAMMQWFWDHYIRSEADGRDWRASPLQAADVSGLPPAFVITAEYDPLRDEGEAYARKLIEAGSAVTVKRYLGQIHGFCTLLGAMPAGRQALEDAAAHLRLAFAARE

SEQ ID NO: 25125 - protein, 174 aa, Populus trichocarpa
MAKMSEPLVVGRVIGDVIDHFTANVKMTVTYQSNRKQVFNGHELFPSAVTHKPKVEVHGGDMRSFFTLVMTDPDVPGPSDPYLREHLHWIVTDIPGTTDATFGREVMNYEMPRPNIGIHRFVFLLFKQKGRQTVTTPASRDKFNTRKFAEENELGLPVAAVFFNAQRETAARKR

SEQ ID NO: 25126 - protein, 327 aa, Arabidopsis thaliana
MAKAATILLPSQTGFDISRSPVCSAPDPNLNYRPVIGILSHPGDGASGRLSNATDASSIAASYVKLAESGGARVIPLIFNEPEEILFQKLELVNGVILTGGWAKEGLYFEIVKKIFNKVLERNDAGEHFPIYAICLGFELLTMIISQNRDIFEKMDARNSASSLQFVENVNIQGTIFQRFPPELLKKLGTDCLVMQNHRFGISPQSFEGNIALSNFFKIVTTCVDDNGKVYVSTVQSTKYPVTGFQWHPEKNAFEWGSSKIPHSEDAIQVTQHAANHLVSEARKSLNRPESKKVLSNLIYNYKPTYCGYAGIGYDEVYIFTQQRSLL

SEQ ID NO: 25127 - protein, 192 aa, Thuja plicata
MAMKAARVLHLCFLWLLVSAIFIKSADCRSWKKKLPKPCRNLVLYFHDIIYNGKNAENATSALVSAPQGANLTIMTGNNHFGNLAVFDDPITLDNNLHSPPVGRAQGFYFYDMKNTFSAWLGFTFVLNSTDHKGSITFNGADPILTKYRDISVVGGTGDFLMARGIATISTDSYEGDVYFRLRVNITLYECY

SEQ ID NO: 25128 - protein, 326 aa, Arabidopsis thaliana
MPSATILLPSQTAFDISRSPVMLCSESEPKLQTGYWYSDHPGNGASGRLSNAIDAPSIAASYVKLAESGGARVIPLIFNEPGEILFQKLELVNGVILTGGWAKEGLYFEIVKKILNKVLERNDAGEHFPIYAICLGFELLTMIISQNRDIFEKMDARNSASSLQFVENVNIQGTIFQRFPPELLKKLGTDCLVMQNHRFGISPQSFEGNIALSNFFKIVTTCVDDNGKVYVSTVQSTKYPVTGFQWHPEKNAFEWGSSKIPHSEDAIQVTQHAANHLVSEARKSLNRPESKKVLSNLIYNYKPTYCGYAGIGYDEVYIFTQQRSLL

SEQ ID NO: 25129 - protein, 192 aa, Thuja plicata
MAMKSERALQLCLLWLLMSAILLKPADCHGRKKRLPKPCKHLVLYFHDILYNGKNAHNATSALVAAPEGANLTIMTGNNHFGNIAVFDDPITLDNNLHSPSVGRAQGFYFYDMKDTFNAWLGFTFVLNSTDHKGTITFNGADPILTKYRDISVVGGTGDFLMARGIATISTDSYEGDVYFRLRVNITLYECY

SEQ ID NO: 25130 - protein, 757 aa, Rickettsiella grylli
MLKMLRRIVQEISSVQGFEKALRILVRRIREALNIQSCTVFILDDEKNYVLLATEGLNPHCIRKIRFNFNQGLVGLVGQTRELINIENAPEHPDFLYITDVGEERYKAFLGVPIIHNRALLGVLVAQQEEQRCFDETEEAFLVTMAAQLGGVLAHAEATGEILSLFKENKKKLQQDIFFQGIASAPGIAIGEAVVVFPFADLEAVPCKKVDNLSAEIIQLKKAFKAARDDIHRLKKHMMVVLPEEEQALFDVYLAILNKASLEKEVITTIKTTHQWAQAALQLVINKHVQQFEKVDDDYLRERASDLRDLGRRILMHLQNNPFRPPRYPENTILIGEEVSPSALAEVPEGRLIGIVSVKGSSHSHFSILARSLGIPAVTGVENLPVNQLEAQTLIVDGSQGRIIIAPSERVKKSFTTLMRQQSEITNSLEALRELPAQTLDGYNIALWVNTGLMADASLSLTAGAEGIGLYRTEVPFLIRDCFPAEDEQYGLYRQLLAAFSPRPVVMRTLDIGGDKALPYFPIKEDNPFLGWRGIRVTLDHPEIFLIQIRAMLRANLEFNNLRIMLPMVSCIAEADHALRLIDQAYEKVVSEDSQACKPPIGIMIEVPSAIYQVRGLAERVEFLSVGSNDLTQYMLAVDRNNPRVANLYDPFQPAVLKALVHIVEAAHLAKKPISICGEMASDPLAVPLLLAMGFDALSMNSFSIPRIKSVIRQTSLSQAKNTLIHILAMDNAADIRKYLSEAVPQFNVDCLMPVTG

SEQ ID NO: 25131 - protein, 190 aa, Thuja plicata
MKAIRVLHLCFLCLLVSAILLKSADCHSWKKKLPKPCKNLVLYFHDIIYNGKNAENATSALVAAPEGANLTIMTGNNHFGNLAVFDDPITLDNNLHSPPVGRAQGFYFYDMKNTFSAWLGFTFVLNSTDHKGTITFNGADPILTKYRDISVVGGTGDFLMARGIATISTDSYEGEVYFRLRVNITLYECY

SEQ ID NO: 25132 - protein, 395 aa, Methanosarcina acetivorans C2A
MNEQGLSEKEIFSYLENAKSEDTDYYRVLSSMCTHPHKIAVEANRLFIEANLGDLGLFAGASRLEQEVVGMLGELLHAPSIDVPFGGSCESSACGYLTTGGTESNIQAVRGMKNLVTTGKKELKGAPNIVIPESAHFSFDKVADMMGIEVRRASLDSEFRVDMASIESLIDANTIGLIGIAGNTEFGQIDPIDKLSEIALENELFLHIDAAFGGFVIPFLEKPQPFDFKLPGVTSIAVDPHKMGLSTIPSGALLFRSASFLDSLKVNTPYLTTKAQFTLTGTRSGASAAATCAVMKYLGNEGYRKNVQYCMQLTEKLVIEARKIGFEPLLEPVMNVVALKVPNPDFVREQMLERFGWNVSITRTPRALRLVLMPHNTLEDIEIFVQDLKEVTVEI

SEQ ID NO: 25133 - protein, 190 aa, Thuja plicata
MKAIRVLQLCFLWLLVSAILLKSADCHSWKKKLPKPCKNLVLYFHDIIYNGKNAENATSALVAAPEGANLTIMTGNNHFGNLAVFDDPITLDNNLHSPPVGRAQGFYFYDMKNTFSAWLGFTFVLNSTDHKGTITFNGADPILTKYRDISVVGGTGDFLMARGIATISTDSYEGDVYFRLRVNITLYKCY

SEQ ID NO: 25134 - protein, 192 aa, Thuja plicata
MAIWNGRVLNLCILWLLVSIVLLNGIDCHSRKKKLPKPCRNLVLYFHDIIYNGKNAGNATSTLVAAPQGANLTIMTGNYHFGDLSVFDDPITVDNNLHSPPVGRAQGFYFYDMKNTFSAWLGFTFVLNSTDYKGTITFGGADPILAKYRDISVVGGTGDFLMARGIATIDTDAYEGDVYFRLRVNITLYECY

SEQ ID NO: 25135 - protein, 352 aa, Glycine max
  misc_feature (157)..(157): Xaa can be any naturally occurring amino acid
  unsure (1)..(352): unsure at all Xaa locations
MATEMEELVSFLSSPSPQIRKAAVDIVRGLTGSVEGLQSLANYSNALLPALSRLLTLPKEVSEAAAEALVNLSQNSSLAEVMVRMGLVKTAMDVLYKPDCGIARLLVMLLVNLTQLEAGAASLLQTEDEKVLGLYVIKLVRSFCRTTHENNVFSLGXSTCIGEFRFKDDAFEHVGSILVNISKQRKGRELLLDPKRGLLKQIIRQFDSNSSLRKKGVSGTIRNCCFEAENQLQNLLLVSEFLWPALLLPVAGNKIYSEQDRSKMPLELGTALSIERELVNDPEIRIQALEAIYLIILQEAGRRAFWSVNGPRIVQIGYEDEEDPKVMEAYEQLGSLLVHSSSAEEPSSQTTK

SEQ ID NO: 25136 - protein, 529 aa, Debaryomyces hansenii CBS767
MSSDTFHEFGVLFDRIQPYLTSLWAICIGAYILFSISTRINDRILMKKLGAKPMQMNAPNSFWGIPLMFRLLKAKREGTMVDVTKERYKELGVDTFNVNIAGTHAVVTRDPENIKAILATQFNDFALGKRHTHFKPLLGDGIFTLDGAGWKHSRTMLRPQFAREKVAHVKALEPHLQTLAKHIINSKGERFDIQPLFFRLTIDSATEFLFGESVENLHDESVGLTRDPVDFDGKSGFADAFNTSQTWLASRAVTQNLYFLVDGRSFRSSNAKVHKFADYYVRKALEASSEDLEKASRDGYIFLYELVKQTRDPVILRDQLLNILLAGRDTTAGLLSFTFFELARNQDVYDKLKEEIYEKFGEGEDSRVDEITFESLKKCEFLKCVLNEILRMYPSVPQNFRFAIRNTTLPKGGGPDGKSPIFVSKGKNLFYSMYSAHRNPKYYGKDAEEFRPSRWLEPEIRKVGWAFLPFNGGPRICLGQQFALTGASYIVVRLIQMFPNLSSFCEEYPPRKNTQLTMSHQNGVYIGMF

SEQ ID NO: 25137 - protein, 525 aa, Debaryomyces hansenii CBS767
MSSSAHELFRSIEPYLTNWWIICIGTYVLFSILTWINERILMKKLGAKPIQFIAPDPFWGIPLMFRLLRKKKDGTMVDMTKERFEEFGIETFSFRVGGTPVITTKDPENIKAMLATQFNDFALGKRHTYFKPLLGDGIFTLDGAGWKHSRAMLRPQFSREQVAHVRALEPHLQTLAKHIINSKGERFDIQPLFFRLTIDSATEFLFGESVENLHDESVGLTRDPVDFDGKSGFADAFNTSQAWLASRAVSKNLSLFVDGKEFRNSNAKVHKFADYYVRKALEASPEDLEKASRDGYIFLYELVKQTRDPVILRDQLLNILLAGRDTTAGLLSFTFFELARNQDVYDKLKEEIYEKFGEGEDSRVNEITFESLKKCEFLKCVLNEILRLYPSVPLNTRCATKNTTLPRGGGPDGQSSIFIPKGKSVLYSVYATHRNPKYYGKGAEEFRPSRWLEPEIRKVGWAFLPFNGGPRICLGQQFALTEASYIIVRLIQMFPNLNSFCEKYPPRKSSHLTMCHQDGVSIGMF

SEQ ID NO: 25138 - protein, 171 aa, Synechocystis sp. PCC 6803
MMSKVFFDITIGSDTAGRIVMELFDEVTPKTAENFRALCTGEKGVGKAGKPLHFKGSHFHRVITDFMAQGGDFTRGNGTGGESIYGEKFADENFQLKHDRPGLLSMANAGPNTNGSQFFLTFVPCPWLDGKHVVFGEVVEGLEILEQLEANGSQSGQTKQAIVISDCGEIK

SEQ ID NO: 25139 - protein, 162 aa, Haemophilus ducreyi
DQLRAMGIEVFNANEVAGLDVYIDGADEITPQGAMIKGGGAALTREKIVSSLAKQFICMVDSSKQVDVLGSSFPLPVEVIPMARSYVARQLVALGGSPEYREGVVTDNGNVILDVHNFNIYEPLKMEHTINNIAGVVTNGIFAQRYANIIIVGTAEGAKIIK

SEQ ID NO: 25140 - protein, 525 aa, Debaryomyces hansenii CBS767
MSSNFHEVVESIEPYVTNWWFICIGAYVLFSILTWINKRILMKRLSAKPMQVTARDAFVGIPLVFNLLKAKREGTMVDMTKERYEEFGVDTFDFRIAGTHAIATRDPENIKAVLATQFNDFVLGKRHAHFKPLLGDGIFTLDGAGWKHSRAMLRPQFAREQVAHVKALEPHLQTLAKHIINSKGERFDIQPLFFRLTIDSATEFLFGESVESLHDESVGLTRDPVDFDGKSGFADAFNNSQAWLASRAVSQNFYFLLNGKDFKDSNANVHKFADYYVNKALETSPEDLEKASRDGYIFLYELVKQTRDPVILRDQLLNILLAGRDTTAGLLSFTFFELARNQDVYDKLKEEIYKKFGEGEDSRVDEITFESLKKCEFLKCVLNEILRMYPSVPQNFRFSIKNTTLPRGGGPDGKSPILIPKGQNLLYSVYATHRNPKFYGKDADEFRPSRWLEPEIRKVGWAFLPFNGGPRICLGQQFALTEASYIIVRLIQMFPNLGSFCEEYPPRKSSHLTMCHQDGVFIGMS

SEQ ID NO: 25141 - protein, 468 aa, Burkholderia sp. 383
MSLFRKKNVDRMIAGAHAAGLKKALGAIDLTFLGIGAIIGTGIFVLTGTGAVQAGPALMLSFVIAAIACGLAALSYAEFASTIPVAGSIYTYSYATLGELVAWIIGWDLMLEYGLASSAVSVGWSGYLQSLLQGFGLTLPTVLTAAPGAVPGVVTWFNLPAFLVMIVITTLLSIGIRESTRINNIMVFIKVSVVLLVIAVGVFHVTPANWKPFMPHGWNGVFGAAAVMFFAFIGFDAVSSAAEEVKNPKRDLPIGIIASLAVCAVLYVTVAAVATGIVPSAQYANISHPISYALQKAGETWVAGFIDLGAVLGMLTVILVMSYGQTRVIFAMSRDGLLPAALSRVHPRYATPFLTTWLVGLFFGLIAALVPLNVLAELINIGTLAAFSMVSIAVLVLRRTHPDLPRAFRCPGVPVVPILAVASCLFLMLNLQPITWAAFGIWLVIGLVIYFLYSRHHSKLAHGHHDAH

SEQ ID NO: 25142 - protein, 192 aa, Thuja plicata
MAIWNGRVLNLCILWLLVSIVLLNGIDCHSRKKKLPKPCRNLVLYFHDIIYNGKNAGNATSTLVAAPQGANLTIMTGNYHFGDLAVFDDPITVDNNLHSPPVGRAQGFYFYDMKNTFSAWLGFTFVLNSTDYKGTITFGGADPILAKYRDISVVGGTGDFLMARGIATIDTDAYEGDVYFRLRVNITLYECY

SEQ ID NO: 25143 - protein, 286 aa, Prochlorococcus marinus str. MIT 9313
MDSPSTTANGWIDEHHQGVRYGLQGRVLVDETSPYQRITVIDSSRYGKGLLLDGCWMTAEHQERHYHESLVHPALCSAAQLERVLVIGGGDGGTARECLRYQDVKHLDMVEIDRRVVELSQKHLPSLGSHAWSDPRLQLNLENGIAWVANATESSYDVILIDGSDPAGPAEGLFNQTFFEHCRRILRPGGVFATQSESPEAFRQVHIDTVRLIRQVFGYADPLYGWVPMYPSGWWSWTFAAIDGPRYRNPLPARAAAISAGCEIWSPRWQQGAFEAIPAFIERELT

SEQ ID NO: 25144 - protein, 326 aa, Oryza sativa (indica cultivar-group)
MSDTSKGIPQEQLPSQELHPPPMPVINLGHLSLDDPTVRSRVVNDIAKACRDLGYFQVISHGISQSVMDGAIEAASEFFKLPNEIKKEYASDDIRQPVRYDTSSKDGISMSRAFLKHYAHPLCDWLQYWPQQPPIYREYMAKYAVEVRVVALKLMEAILEGLGIGKEYMQEKFEEGLQLLSVNCYPKVSQSDTSIGLAAHSDYGLLTILLTSCQGLEVVDRSSNSWKVVQQLPHALHVHVGDHMEVLSNGRIKTVVHRAVLNPQEARISLASIHGFALHEKVSSAKELVDEENPQKYKESSFNDFLEHLTANMDNRQRNFLESLRM

SEQ ID NO: 25145 - protein, 382 aa, Hibiscus syriacus
MSSAGQVIRCKAAVAWEAGKPLSIEEVEVAPPQKDEVRIKILFTALCHTDVYYWECKGYTPLFPRILGHEASGIVESVGEGVTDVKPGDHVLPIFTGECKQCRHCLSEESNNMCDLLRINCDRGVMLADGKTRFSINGKPIYHFVGTSTFSQYTVVHVGQVAKINPTAPLDKVCPISCGICTGFGATVNVAKPKKGQTVAIFGLGAVGLAAAEGARICGASRIIAVDLNPRRFEEAKRFGITEFVNPKDYDKPVQEVIVEMTGGGVDRSVECTGSVQAMISAFECVHDGWGVCVLVGVPKKDDAFKTHPMNLLSERTLKGAFYGNYKPRTDIPMVVDKYLNKELGLDMDKFITHSVPFADINKAFDYMLQGIGLRCMIHLDA

SEQ ID NO: 25146 - protein, 195 aa, Tsuga heterophylla
MAIKNRNRAVHLCFLWLLLSSVLLQTSDGKSWKKHRLRKPCRNLVLYFHDVIYNGSNAKNATSTLVGAPHGSNLTLLAGKDNHFGDLAVFDDPITLDNNFHSPPVGRAQGFYFYDMKNTFSSWLGFTFVLNSTDYKGTITFSGADPILTKYRDISVVGGTGDFIMARGIATISTDAYEGDVYFRLCVNITLYECY

SEQ ID NO: 25147 - protein, 347 aa, Rickettsiella grylli
MATHELEGTIQRLTIHGKGILAADESQATIAKRFSPLHIESTAENRRHYRELLFTTPGIEAFISGVILHEETLGQKTKDGLLFSDYLDNEGIVPGIKVDKGLISLNTEEKMTQGLDGLAERLLTYKNLGACFAKWRAVFSISNTLPSSLAITANTQALARYASICQHNGVVPIVEPELLIEGDHSLSRCAEATETVLYSVFEELHKHHILLECMLLKPSMVIAGNQYTPQPHIAEVAAATLKILRRTVPAAVPSINFLSGGQSPEAATAHLNTMNKLQPSRHPWRLSFSYARALQEPALKIWNGKAHNIKAAQRAFYKRAKLNAAACKGHYQSSMEKEEKEVETNFV

SEQ ID NO: 25148 - protein, 210 aa, Arabidopsis thaliana
MNIFTKKPNPREVLRESKREMTQATRGIEKEIGSLQSEEKKLVLEIKRTAKSGNEGATKILARQLIRLRQQIANLQGSRAQMRGIATHTQAMHAHTSVAAGMQGATKAMAAMSKNMDPAKQAKVMREFQKQSAQMDMTTEMMSDSIDDALDNDEAEDETEDLTNQVLDEIGIDIASQLSSAPKGKIGGKKAEDVGSSGIDELEKRLAALR

SEQ ID NO: 25149 - protein, 185 aa, Tsuga heterophylla
MAIKSNRAVRFCFVWLLLLQSGFVFPLPQPCRNLVLYFHDVLYNGFNAHNATSTLVGAPQGANLTLLAGKDNHFGDLAVFDDPITLDNNFQSPPVGRAQGFYFYDMKNTFSSWLGFTFVLNSTDYKGTITFSGADPILTKYRDISVVGGTGDFIMARGIATISTDAYEGDVYFRLRVNITLYECY

SEQ ID NO: 25150 - protein, 121 aa, Campylobacter coli RM2228
MKEKTVFELIVEGKIPCNKVLENNDFLAFHDIAPKAPIHILIIPKKHFKDFQEFDPKLMEKMTSFIQELAVLLGVDKSGYRLVTNCGKNSGQEVFHLHFHMLGGFRLPKEKDENENPQALF

SEQ ID NO: 25151 - protein, 189 aa, Campylobacter coli RM2228
MSKKVLIPLAQGFEEAEFIGIADVLKRAAELSGNLEVIIASLDNELLVKGANGISIKADCSLEAVDTKNLDAIALAGGFDGMNNLKNSNEILSIIKKLHSEGKIVSAICASPIVLNAAGVLEGEFTCYPSCETGLQGNRVNKAVVVNKNVITSAGPATAILFGLELAKQLCGDEIYNSLYEGLLIPLTK

SEQ ID NO: 25152 - protein, 402 aa, Prochlorococcus marinus str. MIT 9211
MAKRSLSSLSAEELCGKRVFVRVDFNVPVNAEGDITDDTRIRAALPTIKDLIDKGARVILSAHFGRPKGQVNDAMRLTPVAQRLSELLGHTVIKTDSCIGSDAQAKAQSLNNGDVMLLENVRFIQGEEKNDPDFAKELSELAEVYVNDAFGAAHRAHASTEGVTKFLSPNVAGYLMEKELQYLQGAIDSPKRPLAAIVGGSKVSSKIGVLESLIDKCDKVLIGGGMIFTFYKARGLSVGKSLVEDDKLELAKALEEKAKSKGVELLLPTDVVLADNFSPDANSQIAQINSIPEGWMGLDIGPDSVKLFQDALEDCQTVIWNGPMGVFEFDKFANGTNSIATTLSVLSQKGCCTIIGGGDSVAAVEKAGLADKMSHISTGGGASLELLEGKTLPGVAALDELD

SEQ ID NO: 25153 - protein, 590 aa, Asparagus officinalis
MCGILAVLGCSDDSQAKRVRVLELSRRLKHRGPDWSGLCQHGDCFLSHQRLAIIDPASGDQPLYNEDKSIVVTVNGEIYNHEELRRRLPDHKYRTGSDCEVIAHLYEEHGEDFVDMLDGMFSFVLLDTRNNCFVAARDAVGITPLYIGWGLDGSVWLSSEMKGLNDDCEHFEVFPPGNLYSSRSGSFRRWYNPQWYNETIPSAPYDPLVLRKAFEDAVIKRLMTDVPFGVLLSGGLDSSLVAAVTARHLAGSKAAEQWGTQLHSFCVGLEGSPDLKAAKEVAEYLGTVHHEFHFTVQDGIDAIEDVIFHIETYDVTTIRASTPMFLMARKIKSLGVKMVISGEGSDEIFGGYLYFHKAPNKEEFHHETCRKIKALHQYDCLRANKATSAWGLEARVPFLDKEFMDVAMSIDPESKMIKPDLGRIEKWVLRKAFDDEENPYLPKHILYRQKEQFSDGVGYSWIDGLKAHAAKHVTDRMMLNAARIYPHNTPTTKEAYYYRMIFERFFPQNSARLTVPGGPSIACSTAKAIEWDARWSNNLDPSGRAALGVHDSAYDPPLPSSISAGKGAAMITNKKPRIVDVATPGVVIST

SEQ ID NO: 25154 - protein, 815 aa, Gibberella zeae PH-1
MNVRQSSFSLAPPGPERRPSVVSRLSSVFSNADREAGTTTSTGAGLIEEEIAEIKRYEDFTTIDWVQDAAREQAKRKVRRKQAAGLYDKGQPGWRYQLWKSYDAAQAWIVVTIIGVAIGLNAALLNIITEWLSDVKMGYCETGFYLNENFCCWGEGNGCDQWHRWTGFEPFNYFVYLVFASFAPYAAGSGISEIKCIIAGFVMKGFLGWWTLIIKSICLPLAIASGLSVGKEGPSVHYAVCTGNVISRLFDKYKRNASKTREFLSASAAAGVAVAFGSPIGGVLFSLEEMSNQFPLKTLWRSYFCALVATAVLAAMNPFRTGQLVMFQVEYKNDWHFFELLFYVLIGIFGGLYGAFVIKWNLRVQSFRKRYLKDYAVLEATLLAAGTAIIAYPNAFLRIDMTESMEMLFSECGHGESYHGLCEPSKRWWNITSLFLATFLRLFLVILSYGCKVPAGIFVPSMAVGASFGRMVGIIVQAIHEANPTSVFFSACKPDEPCITPGTYALLGAAAALSGIMHITISVVVIMFELTGALNYILPTMIVVGVTKAVSELFGKGGIADRMIWFSGMPFLDSKEEHNFGVPVSAVMRTSVVSMPVHGLTLGEVQRLLADDRYQGFPVVEDKHTKVLIGYIGSIELRYAIDKMSRTSPLSETSRCTFAPSSSNLSTTSLHGDSSHSSTLDFSRYVDSTPVTAHPRLPLETVMELFQKIGPRVILIEYHGKLTGLVTVKDCLRYQFKVEAAENPKDNHRMEEGQEQLWNLLLRAGNWFSCRVSRYSGGRIRLSSSSGDERPLGRGQILDGDEEVLDEGVELESRR

SEQ ID NO: 25155 - protein, 484 aa, Campylobacter coli RM2228
MNIIKRALTFEDVLLRPCYSEVLPKQVKIHTKLTKNITLNMPLISAAMDTVTEHRAAIMMARLGGLGVIHKNMDITSQVREVKRVKKSESGVIIDPIFVGPKASVAEALEIMAEYRISGVPVIDSDRKLIGILTNRDLRFENDYSNLVENVMTKAPLITAPKGCTLDDAEKIFSKNKVEKLPIVDEQGRLEGLITIKDLKKRKEYPDANKDSFGRLRVAAAIGVGQMDRVDALVEAGVDAVVLDSAHGHSKGIIDTVKSVKEKYPNLDLIAGNIATAAAAKALCEAGADAVKVGIGPGSICTTRIVSGVGVPQISAIDECAMEAKKYGVPVIADGGIKYSGDIAKALAAGASSIMIGSLLAGTDESPGELFTYQGRQYKSYRGMGSIGAMQKGSSDRYFQQGTAQDKLVPEGIEGRVPYVGSIKNVVHQLLGGLRSSMGYVGAKDIEDFQARAEFVEITSAGLKESHVHDVTITHEAPNYKVNQ

SEQ ID NO: 25156 - protein, 576 aa, Ostreococcus tauri
MVARARVHASRGVDARRVRARGRARVDVIARAVKEPSSAPEEALPDENFKPEQLKFQDIVSLWVTQILQTYGGKESKDNAPVCEGVIDDLVGGPIFLALYPYFRRYGGVFKLAFGPKVFMVLSDPVIVREVLKEKPFSFDKGVLAEILEPIMGQGLIPAPYAVWKNRRRQLVPGFHKAWLDHMVGLFGHCSNELVRNLDKSAEDGEVVDMEERFCSVSLDIIGLAVFNYDFGSVTKESPIISAVYNCLQEAAHRSTFYFPYWNIPFATDIVPRQREFKQNMKIINETLNGLIQKAQKFEGTEDLEELQNRDYSKVKDPSLLRFLVDIRGADVTDSQLRDDLMTMLIAGHETTAAVLTWGLFCLMQNPELMKRIQADIDEVMGDDDRTPTYDDIQKLESVRLCIAEALRLYPEPPILIRRCLEDVTLPKGAGDAEVTLIKGMDIFISVWNLHRSPECWENPEEFDPFRFKRPFANPGVKDWAGYNPELFTGLYPNEVASDFAFIPFGAGARKCIGDQFAMLEATIAMAMVLRRYDFELTTDPKDIGMTMGATIHTEKGLPCRVRRRQPVTTATAAAV

SEQ ID NO: 25157 - protein, 506 aa, Lithospermum erythrorhizon
MALPAIPLAIIIFLIISYKLYQKLRLKLPPGPRPLPIIGNIYQVKPVKFRCFYNWSKTYGPIFSIYYGSQMNVIVSTTELAKEVLKENDQHLADRFRTRSSASMSRGGKDLIWADYGPHYVKVRKLCNVELFSPKRLEAIRPMREDEYTALVESIYKDCTKPELKGKSLLVREYLSSVAFNNITRLAFGKRFMDSNGVVNEQGQEFKKITHDGIKITAKLSIAEYIPWIRWMFKVEQDALDKFAADRDHLTRVIMEEHIKSGNTKQHFVDALLTLQKQYDISEDTIIGLLWDMIAAGMDTATISTEWAMAELVRNPRVQRKAQEELDRVVGPDRIMTEADVPKLPYLQCIVKESLRLHPPTPLMLPHRASANVKIGGYDIPKGSIVHVNVWAIARDPAYWKNPEEFRPERFMEEDIDMKGTDYRLLPFGAGRRICPGAQLAINLITSSLGHLLHQFTWSPQPGVKPEEIDLSENPGTVTYMRNPVKAVVSPRLSAVHLYKRVESDM

SEQ ID NO: 25158 - protein, 221 aa, Brassica napus
MEGGGGGSRSAAAGVVPESATEAVKQTLSHLEKLKPQLEQMMTSLAKPEALSQMQPLQRAKTMYLLAEAATTIFTLRLRCTGVNPDDHRVKSEIERLNVYREKLHLCMDRSKEPLRPTTVLNRQAATRFIEHSLPDHTSTQKQNIRDLSIGEKSSMTYSETAAKKRKCQSDERQSVQSTAKEFLEKAARELNNGDNEDGLKGPLMAAADGSDDAEPSNGSS

SEQ ID NO: 25159 - protein, 136 aa, Oryza sativa
  misc_feature (109)..(109): Xaa can be any naturally occurring amino acid
  unsure (1)..(136): unsure at all Xaa locations
MSLFGGVSSQARSRNLVEFKAGKMNLRGNMVHPDKRKGLVYLYQGNDMLMHFCWKERTNNTPEDDLVIFPDEIEFKKVTQNTTGRVYILKWRSNARKLFFWMQEPKDDXDEEWCKKINDLLNHPPTPGFGGDESNG

SEQ ID NO: 25160 - protein, 877 aa, Streptococcus agalactiae
MKGQKIIALAGLVLSCHFALTACHTQEHKNSYHIKTKQVAKKKANKKKVSVKESHKKRKGVAGVDFPTDDGFLLTKDSKILSHTDSGIVVAHGNHSHFIFYSDLKGSKFSYLIPNANAKTNKNQAVRNFKAGAVAVNTLNDGYVFNPADIVSEDANGYVVRHGDHFHYIPKASLSQQKQVQASRAVSRLGNQSNSHYRVNSSKIAGLHYPTSDGFLFNGRGIKGTTPTGILVEHHNHLHFISFADLRKGGWGSIADRYQPQKKADSKKQSPSSKKPRNENTLPKDIKDKLAYLARELHLDISRIRVLKTLNGEIGFEYPHDDHTHVIMAKDIDLSKPIPNPHHDDEDHHKGHHHDESDHKHEEHEHTKSNKLSDENQKKLIYLAEKLGLNPNQIEVLTSEDGSIIFKYPHDDHSHTIASKDIEIGKPIPDGHHDHSHAKDKVGMATLKQIGFDDEIIQDILHADAPTPFPSNETNPEKMRQWLATVTKINIGQRTNPFQRFGLSLMPNIEVLGIGFTPINDMTPVLQFKKLKQLWMTNTGITDYSFLDKMPLLEGLDISQNGIKDLSFLTKYKQLSLIAAANNGITSLKPLAELPNLQFLVLSHNNISDLTPLSNLTKLQELHLDHNNVKNLSALSGKKDLKVLDLSNNKSADLSTLKTTSLETLLLNETNTSNLSFLKQNPKVSNLTINNAKLSSLDGIEESDEIVKVEAEGNQIKSLVLKNKQGSLKFLNVTNNQLTSLEGVNNYTSLETLSVSRNKLKSLDIKTPNKTVTNLDFSHNNVPTSQLKLNEKNIPEAVAKNFPAVVEGSMVGNGSLAEKAAMASKEDKQVSDNTNHQKNTEKSAQANADSKKENPKTHDEHHDHEETDHAHVGHHHH

SEQ ID NO: 25161 - protein, 196 aa, Schizophyllum commune
MQAIKCVVVGDGAVGKTCLLISYTTNAFPGEYIPTVFDNYSANVMVDGKTISLGLWDTAGQEDYDRLRPLSYPQTDVFLICFSLVSPPSFENVRTKWYPEISHHAPQTPVVLVGTKLDLREDPATIEKLRDRRMSPIQYSQGVAMMKDIGAVKYLECSALTQKGLKTVFDEAIRVVLYPSARSDNKRSKGRSCIVA

SEQ ID NO: 25162 - protein, 1020 aa, Gibberella zeae PH-1
MVATKLDGNAIAKSIREKLCAEVNEKQKINPRFKPCLKIIQATYVRMKLKAAAEAGIDSQLLHYPESISEAELLDHIRQHNNDPAVHGILVQLPLPKHISEYTVTSFVADEKDVDGFGTKNIGELAKRGGKPLFIPCTPKGCMILLKESGIDLKGKNAVVLGRSDIVGSPVSYLLRNADATVTVVHSKTQNIEQHVRNADVLVAAIGQPLFVPGSWIKPGAVVIDVGTNFLPDATKKSGHRLVGDVDYASAVEVASAITPVPGGVGPMTVAMLMQNVVDATTWYFESQKLRKTIPLPLKLEDPVPSDIAVSRAQTPKDITRIAAEIGIAPHELEPYGAYKAKVDLGLMQRLEHRRNGRYVVVTGITPTPLGEGKSTTTMGLAQALGAHVGRMTFANVRQPSQGPTFGIKGGAAGGGYSQVIPMDEFNMHLTGDIHAIGAANNLLAAAIETRIFHENTQKDGPLYKRLVPVKNGARKFAPVMFRRLKKLGIDKTNPDELTEDEIHRFARLDIDPETITWRRVLDVNDRHLRGITVGAAPTEKGQTRETGFDITVASECMAILALSNNLAEMRERLGSMVVATSRGGDPVTADDLGAGGALTALMKDAIKPNLMQTLEGTPVFVHAGPFANISIGQSSILADKLALKLAGTEADEDHQKKAGFVVTEAGFDFTMGGERFFNIKCRTSGLVPDVVVIVATVRALKVHGGAPPIAPGAALSPVYKEENVDILRAGCVNLKKQIANAKSFGIPVVVAINKFATDTDAEIAVIREEAVSAGAENAILSNHWAEGGKGAVDLAHGVIAAAEKPKDLKFTYNLEGTVQERLEAIGKQMYGAEKVELSELAQKKVDTYTRQGFGHLPICVAKTQYSLSHDPDLKGAPTGFTVPIRDVRLAAGAGYFYALAADIQTIPGLPTAPGYLNVDVNVETGEIEECSTAATKSRAYDAGNMPVIQLKVYRMGTTDSKLTIGRNRIATRSHGERRPLLDTNTYPNKLGSTSISPDVTTEEFNPTNGSDLSLSVRYG

SEQ ID NO: 25163 - protein, 394 aa, Fulvimarina pelagi HTCC2506
MLQTISAFDRIGEENAFAVLARANTLSGEGHDVVNLGIGQPDFLTPPHIVEAAVKALQDGHHGYTPATGLPATREAVARRTFSLTGVEISPDSVMIMPGGKPTMFAAILMFGEPGAEILYPDPGFPIYRSMIEFTGAKPVPVPIREENGFAFSAEETLSLITDKTRLLILNSPANPTGGVTPKQEIDKLVAGLENFPDVAILSDEIYDVMTYDGEVHTSLLTYPEIRDRLIVLNGWSKTWAMTGWRMGWSIWPEKLYGMVRKLAVNCWSCVNAPSQIAGIAAIDGPQEDVKRMMEAFDRRRKLVVERANALPGVTCATPKGAFYAFPNISQTGWKSKKLSSALLEKAHVALVGGPDFGILGEGYIRISYANSEMNIARAMDRVAKFLEETEPQT

SEQ ID NO: 25164 - protein, 136 aa, Brassica napus
KCPERKGTADFLQEVTSKKDQEQYWVDRNRPYRYIPVSEFASRYKSFHVGQKLSNELSVPFDKSRGHKAALVFDKYSVSKMELLKSCWDKEWLLMQRNAFFYVFKTVQIIIIAAITSTLFLRTEMHTNNESDAHLY

SEQ ID NO: 25165 - protein, 163 aa, Brassica napus
GSDSSYVTTRVMGTFGYVAPEYACTGNLNEKSDIYSFGILIMEIITGRNPVDYSRPQGETNLVDWLKTMVGNRRSEEVVDPKIAEPPSSKALKRVLLVALRCVDPDANKRPKMGHIIHMLEAEDSLYRDERRTTRDHGSRDKQETAASESGESGSRHHQQKLR

SEQ ID NO: 25166 - protein, 262 aa, Ostreococcus tauri
  misc_feature (1)..(1): Xaa can be any naturally occurring amino acid
  misc_feature (262)..(262): Xaa can be any naturally occurring amino acid
  unsure (1)..(262): unsure at all Xaa locations
XTMTIETPVPFKGHLIEPPSQMVETSRGEIIDMFTQAYMMRRLEIAADVLYKGKMIRGFCHLYDGQEAVVVGMERALTKEDAVVTSYRDHCVHLGRGGTPLEVMAELMGRVDGAAKGIGGSMHMYKRDANFFGGNGIVGAQTPIGAGLGFAFKYNKQPNVAVTMYGDGAANQGQLFEALNIAALWDLPVIFMCENNHYGMGTAQERSAKSPVYYKRGDYVPGLRVDGMDALAVKQAIKFAKEHCVSGKGPIVMEMDTYRYHX

SEQ ID NO: 25167 - protein, 379 aa, Candida albicans SC5314
MSSLSSVTRSAKLATQSLKYNTRPSLSKIGQFQTSKITYRANSTQSTPVKEITVRDALNQALSEELDRDEDVFLMGEEVAQYNGAYKVSRGLLDKFGEKRVIDTPITEMGFTGLAVGAALHGLKPVLEFMTWNFAMQGIDHILNSAAKTLYMSGGKQPCNITFRGPNGAAAGVAAQHSQCYAAWYGSIPGLKVLSPYSAEDYKGLLKAAIRDPNPVVFLENEIAYGETFKVSEEFSSPDFILPIGKAKIEKEGTDLTIVGHSRALKFAVEAAEILEKDFGIKAEVLNLRSIKPLDVPAIVDSVKKTNHLVTVENGFPGFGVGSEICAQIMESEAFDYLDAPVERVTGCEVPTPYAKELEDFAFPDTEVILRACKKVLSL

SEQ ID NO: 25168 - protein, 244 aa, Deinococcus radiodurans
  misc_feature (106)..(106): Xaa can be any naturally occurring amino acid
  unsure (1)..(244): unsure at all Xaa locations
MQTLLALNWKMNKTPTEARSWAEELTTKYAPAEGVDLAVLAPALDLSALAANLPAGIAFGGQDVSAHESGAYTGEISAAMLKDAGASCVVVGHSERREYHDESDAXVAAKARQAQANGLLPIVCVGENLDVRERGEHVPQTLAQLRGSLEGVGADVVVAYEPVWAIGTGKTATADDAEELAAAIRGALREQYGARAEGIRVLYGGSVKPENIAEICGKPNVNGALVGGASLKVPDVLGMLDALR

SEQ ID NO: 25169 - protein, 192 aa, Triticum aestivum
  misc_feature (48)..(48): Xaa can be any naturally occurring amino acid
  misc_feature (66)..(66): Xaa can be any naturally occurring amino acid
  unsure (1)..(192): unsure at all Xaa locations
TQSRLKLQIFFIDEGKGGRFFTTTGGGFSGGKKKKGLKKKLQEKLPGXKTPRGGQVTAIPQPAAPXSVQTHHETDVFFEKIDGDVKTEATPPVPEEEKKGFLEKIKENLPGGHKKPEDAVSVPVTHAVPAPVTHAVPEPVHAPAPAPEEVNTPYPKEKKGLLGKIMDKLPGYHKTGEEDKAPPPTGEHKPSA

SEQ ID NO: 25170 - protein, 97 aa, Zea mays
  misc_feature (19)..(19): Xaa can be any naturally occurring amino acid
  unsure (1)..(97): unsure at all Xaa locations
CFIRSIEKHIRVTGFQWHXRKNAFEWGSSKIPHYEAAVHVTQLIANYLVGEARKSRGGPSPEKVLSNLIYNYKPTYCGYEGRGYDEVYIFAQQRSLL

SEQ ID NO: 25171 - protein, 397 aa, Oryza sativa (indica cultivar-group)
MAGRWLRAARGMGGRRRRGWSEAPAFAAEQRATLVNVKLKWVKDRALDGAVSRERDLRAAHHLLDVVSARPGHRVSRPELLADSSVRRAFGGVDGVDAFLARYHTLFTLRRGGGVSLTDAALDLRRREVDCLVESEPDLVSRLRRLLMLTLPRSLPLHTVDLLRWDLGLPRDYRASILRRYPDHFALDQPEGDERVWLRLLWWDDGLAVSELEKSTAGGGGGDTTCLPFPVSFTKGFGLRSKCINWLKEWQALPYTSPYADPSGLDRRTDVSEKRNVGVFHELLHLTVAKRTERRNVSNMRKLLGMPQKFTKVFERHPGIFYLSRVLGTQTVVLREAYGGGSLLLAKHAHPLATIREEYSAVMRAALPPRRRRSRESDSCSEQDEECVGGEEFELTE

SEQ ID NO: 25172 - protein, 369 aa, Zoysia japonica
MAAASTPNGDPPVRSLATTVPVQAVLFDIDGTLCDSDPLHHVAFQELLLEIGYNNGVPIGHGFFQVVNHGIDQEPLAEAHRCMDNFFTLPLPEKQRAQRRQGESCGYASSFTGRFACKLPWKETLSFRYSSNPSSPDLVVDYFVEKLGEDYRHHGAVYARYCSEMSRLSLEMMGILGESLGVGRDHFRRFFQPNESIMRLNYYPPCQRPLETLGTGPHCDPTSLTILHQDHVGGLQVFTDGRWRSIRPHAGAFVVNIGDTFTGALQRPVPKLLHRAVVNSLVPRKSLAFFLCPEMDKVVCPPEGLVEAGMPRAYPDFTWRTLLDFTQRRYRADMRTLEVFSNWLRHGQDKTPPTSLIHRSKIVTVHHPS

SEQ ID NO: 25173 - protein, 494 aa, Oryza sativa
  misc_feature (370)..(370): Xaa can be any naturally occurring amino acid
  unsure (1)..(494): unsure at all Xaa locations
MAESYHKEVIAGLKDKSLFIQEAFIDGQWVAKDNKFDVFEPSTATVLGQVANCALEDFQTAIKSADVAQTNYFDSTTGASRGALLRTWYDLVLANQEDLANILSLENGKTYSEALGEVLYSASFISWFAEEATRSYGVTIPSSAPHTTLMTVREPVGVCGIITPWNFPAAMITRKIAPALAAGCSVVIKPPSETPYSALAFTKLAIDAGLPPATIQVLPTRDRQAATELATNPLVKKISFTGSTGVGKYLAKLAAGTLKKLSLELGGNAPFIVFEDADLDLAAEGAMFCKFRCSGQTCVCANRLYVQKSVAKEFTAKLVEKVNALKMGSGLDKSTTQGPLVNKAAVDKVKEHIADATSKGAQIATGGSTXRSPGFFHQPTVLTGVTQEMAVAKDETFGPLAPIFEFDTEEDAIRLANDTEFGLAGYFFSKDISRVMRVAHKMQVGMVGANTGKISAAEAPFGGVKESGYGKEGSLYGMAEYQNIKSITIGNLNN

SEQ ID NO: 25174 - protein, 580 aa, Zea mays
MTYPHSSQVVSPLQSPLSSRTTKKPVPPFAMSSEAGCSAPAAAAPDGAGGGRVEIDTSAPFESVREAVDRFGGSAAWSSDLVRRMFAPSKKHEHSDQAAEAINAEEQAAQLENELAVKERETLDVLKELEATKKIIADLKLKIRKEATETSPEEAAKSDETDQVSEAGAQQQKPENTNIDVVVDMEGVEENHSGSVPVDLEQAKANLNRATCDLAAVRAAVELLRNSIAKEKVLLERAREKLSSDTSSVSSLEDDLDQTAQKMETLKDLQRRRKDPSDIFVEIKKMTTEVQQLRSMADDSKSEAMVLAAEIEQVKASICTAEVRCIAARKMEDAARAAEALALAEIKALVSSGSSFEGDTASDGGGVTLSMEEYFKLCSRALEADESSRRKVENAMLQVDAADDSESESVKRLEDARVEVEECKKALQEALRRVEAANHGKFAVEEILRRWKSESGHKRRSLGGSPRFKRAAAHRREDSHATDMISDASDRPPKPTLSIGQILSMKLMGPDGYDKSVWDDKTGEIPEISLGQIINRSGVLCREDVAARRRISGKRKKFALTGLSVLLAKQSKNKKKRESF

SEQ ID NO: 25175 - protein, 373 aa, Porphyra yezoensis
MAFITPAAAASVTARVAARPAVIGARATAFAGAAVAPTSRRSVVRAAPAALRMAQSGETLEEFLAGSDPKLAKCVAAMFASCKEVAYKIRTASCDKMACFNDFGDEQLAIDMLADKIIFDNLEASGVVATASSEEVPKEVTITAGAPYSVAFDPLDGSSIIDTNFTVGTIFGVWPGDKLVGTTGRELVAGGMVLYGPRTTVTLAMDGVEGAHEFLLIDDFSSRHGSWVHTATFTSVNEGKLYAPGNLRAAEDNPGYADLIDYYRKEKFQLRYSGGMVGDVNQILVKGKGVFCNPSSPSAKAKLRLLYEVAPIGYVMEKAGAKSSDGSGSVLDIKVQTTEDRSQVCYGSAGEVARFEQMVGKKVEMNATVDTTA

SEQ ID NO: 25176 - protein, 552 aa, Gibberella zeae PH-1
MTEPENFEDDLFADLYDDNDAPKPAPAAPVAAPAAPPAPEVQPPTNNTHDNDDHNATYQHQDVAGDEYMTQDQDDDDDDVDFNLGGGGGGYGSHTGQAGMHDDDQAPPYGTVHKASAKEDGKMFIGGLNWETTDQSLRDYFAQFGEVVECTVMRDSSTGRSRGFGFLTFKDAKTVNIVMVKEHFLDGKILILLQIDPKRAIPRDEQEKTSKIFVGGVSQETTDQEFKEYFAQFGRVVDATLMMDKDTGRPRGFGFVTFENEAGVDACINVPLEIHGKPIEVKKAQPRGNLREEEEASRRGKFRKDGDQSNQGSMGQQMGNNNGMTPQVMAQYFQRMQQYFTMMQSQMAMSRGMPMNPAMWQNMMQMQQMQQQMMGGRGGGANAQNMMQNMNPQMAQQMQQQMQQMMQQQGQQGGQDAGSGSASPTASTNGGAGRGYDNNNNFNQYQQQQPQGGRRGGRGGYGGHGGGHGGYNMGGGGGAPTSWEGMYDDVPQPNPNQGPGSFNRAGSVGGSSDPQHAPPANAPTGPKNAGKPGANYRGGGRGGNRGFHPYSR

SEQ ID NO: 25177 - protein, 512 aa, Spiroplasma kunkelii
MKTTNKIIILDFGSQYTQLIARRIRDLEVYCEVWPYNTALEKIKTTSMKGIILSGGPASVYEEDAFLIDKQLFELKVPVLGICYGMQIISHLHEGTVQRATKQEFGFSELIIDNQEDLFANIPVKSQVWMSHADYIEGMPTNFIQIAHSENSISAIKHSEKKIYGLQFHPEVTHTLIGQQLLSNFVFNICGCQPKWKITEFISAAITEIKNKVGTDNVVLALSGGVDSSVCAVLLHKAIGKQLTCIFVDTGLLRQNSGWNDLQKFQEKFKLNIIKINAQERFLTALKGVTNPEEKRKIIGNLFIEIFNEEAIKIQNVKWLGQGTIYPDVIESVSVKGPSATIKSHHNVGGLPKDLPFQLIEPLRELFKDEVRRTGEALGIDFKFVYKHPFPGPGLAVRIIGEITAEKIALLQAADQIFIDELYQANLYDQVAQAFVVLLPVQSVGVMGDVRTYGYTAVVRSVDTTDFMTANWSRLPFELLEKVSARIVSEVHGINRITYDITSKPPGTIEWE

SEQ ID NO: 25178 - protein, 459 aa, Symbiobacterium thermophilum IAM 14863
MEITMPQLGESVTEGTINRWLVAPGDVVKRYQPIAEVITDKVNAEIPAPADGRILTLDVPEGSTVPVGARIATMEVAGEDAGQAPAPVGASAQAASQAAAPQGAPAVGGGSGAPDRASRGRYSPAVLRLAQEHGVDLSQVRGTGLGGRITRKDVEAFIAARAAGAPAAPPAAAAAPAGVAAPAPAGVAASAPAAPASGVAVAATSAPSVAAPTPSAPAAAPVQPAPGDRVIPVDPVRRRIAAKMVQAKHEAPHAWTMMQVDVTNLVKLREQAGPEFRARTGRPLSYVPFFIKAVVESLREYPILNSQWNGDEIVIRQDINISVAVATEDALAVPVIKHADRLSIAGLNEAVADLAERARAGRLTLDDVTGGTFTVNNTGAFGSFLSAPIINYPQAAILSFEKITKMPVVLENDAIAIRSMMNICLSLDHRILDGLVCGRFLQAVKRRLESYGPGTVSLY

SEQ ID NO: 25179 - protein, 327 aa, Symbiobacterium thermophilum IAM 14863
MPVMNLVEAVRDALRTEMRRDPDVWIVGEDVGKKGGVFGATLGLYDEFGPQRVMDSPLTESAIVGVGIGAALYGTKPVCEIQFADFIFPAMNQIVSEAAKMRYRSNSAWTVPMVIRAPFGGGVHGGLYHSQSVEQYFTNTAGLKVVVPSTPYDAKGLLISAIRDPDPVLFFEHKGLYRAVKGEVPEGDYTIPIGKAEVKRDGTDITVITYGKVVHFCLEAAELLAREGYEALVLDLRTLLPLDREAIVAAARKTGKVLIAHEAGKTHGVGAEVAAIIAEECLFDLDAPIKRLCGPDVPAMPYAGPMEKFYMLSTEKCLAAMRELAQF

SEQ ID NO: 25180 - protein, 415 aa, Schizosaccharomyces pombe
MDVSTQTRHATYFQDENQLQKDHIYVKKKSHIKLNTGVPAPFKAVDNINQQDEPTLIEGNNESSISSSTGDTFEEDFAYQDKVEIEERSIRSTPKSIGDDDLENREGSFDAPEGILTHGKHRLPTIPEWTKEDLAALSEAAARLQANPSPEDIETDPSMVPDYDPEIFHYMQSLERKLAPPPNYMSVQQEIDWVTRHMLVDWIVQVQIHFRLLPETLFLAVNLIDRFLSIKVVSLQKVQLVGLSALLIACKYEEIHPPSIYNFAHVVQGIFTVDEIIRAERYMLMLLDFDISWPGPMSFLRRISRAHSYDHDIRMLAKYLQEVTLMDEIFIGAHISFIAATAYYLSMQMLGHLDWTPCHVYYSGYTARQLKPCANIIWECLVDAPNHHNAIYRKYSENRMKRVSAFAHNWVLSVI

SEQ ID NO: 25181 - protein, 551 aa, Rickettsiella grylli
MMKSMARLARLMQIGFVLFRYNLDELIFSLHVFRHLRFLIYLNPYWKVNKKIPRGKRIRCALEDLGPIFVKFGQTLSTRRDFIPLDIADELAKLQDRVPAFSGEQAKSMVQTHMKKPLCEVFSEFNIVPLASASIAQVHAAKLITGQDVVVKVLRPKIYKKISRDVDLLYVLASLSLRCFRPAKQLRPREIVAEFEACLKNELDLLREGANASQLRRNFLNSDLLYIPEVYWPYTSHHVLVMERIYGISISDLSALKKQGIHLKKLAERGVEIFFTQVFRDSFFHADMHPGNIFVSPKEKENPQYLGVDFGIMGSLSSEDQRYLAENLVAFFNRDYRRVAQLHVESGWVAKNTRINEFEAAIRTVCEPIFGKPLKEISFGQLLLRLFQTARQFNMEVQPQLILLQKTLFNIEGLGRQLYPELDLWSTAKPFLEHWLRRQVGPTIFFKKIREYAPLWLEKLPEFPNLIYQVMLELRHKKKSNCLYCAEKKKKQTTKKSFWFISLGIAITGMVWVMLNWMNKNVYLTPIYQWIIALGCVGLFLITVKKIKKID

SEQ ID NO: 25182 - protein, 365 aa, Ostreococcus tauri
MAPSDERACTRALGLEGSANKIGVGVVRSDGTIESNPRETYVTPPGSGFLPNDTARHHRARVVDLVRKALREAGVTMGEIDVVAYTRGPGMGAPLTAVAACARTLAGLYDKPMVGVNHCVAHIEMGRLVTGCDDPVILYASGGNTQVIAYNERRYRIFGETIDIAVGNMLDRFARVCGLSNDPAPGYNIEQEAKKGKKFVEGPYGVKGMDVNLSGILTFYKTYAEENLGKGEVTVADLCFSMQETVFSMLVEITERAMAHVNAKDVMIVGGVGCNLRLQEMMAIMARERGGKLYGLDENGRMDDRFCIDNGAMIAHTGLIQYLNGETTPIEETECTQRFRTDEVLVTWRDKAGTKRTAEGSPAAS

SEQ ID NO: 25183 - protein, 318 aa, Ostreococcus tauri
MPEGTVFIGNVPYDATEASLTEIFCECGPVRELRLVTERDTGKLKGYGFVEFDDFATAMSAVRNLNGREYNGRQLRVDHAETMKNGGGQTGVSAIHGDGGVGHAAPSASVSLRADAPIGTNAAKASQQGMRHAFEGVVTSTTGAAMDLLTKRVADLTPTQLYEIMSQVKQMTESDPAQARTLLVNNPQLSLALFQAQLVLGMVKPPAGGATAPPMAPHLVGQQARRTVPPPPPPPVVRAVNVPPPPMAPVRAPPAAPVAPMAPPSTVPGQGMDQQQALLRQVLSMTPQQIAMLPPDQRAQVEYLRQLAAQQGMVRVNA

SEQ ID NO: 25184 - protein, 344 aa, Clostridium thermocellum ATCC 27405
MLQSVMVSPGKIEFHEVEKPELKPGQVLIKIMRIGICGSDIHVNHGKHPFTKYPVTQGHEVSGKIVEVAEDVEHLKVGQKVTIEPQVVCGKCHPCRTGKYNLCEELKVMGFQTVGAGSEYFAVDAKNVTTVPDHLSYDEAAMIEPLAVTVHAANRVGDVKDKDIVVIGAGPIGILLVQTLKAKGARKVMVTDVSDYRLELALKCGADFAVNTKKEDFGEAMLRCFGPDKADVIYDCAGNNTTMEQAIKHSRKGSIIVLVAVFEGMATVDLATLNDKELDLNTTMMYRHEDYVEAIELVEAGKVKLTPLMSKHFAFRDWEKAYEYIDNNREITMKVLIDVNNDDD

SEQ ID NO: 25185 - protein, 394 aa, Prochlorococcus marinus str. MIT 9211
MSQLETRTEPMVVNFGPHHPSMHGVLRLVVTLDGEDVVDCEPVIGYLHRGMEKIAENRTNVMFVPYVSRMDYAAGMFYEAIVVNAPERLAKISVPKRASYIRVLMLELNRIANHLLWLGPFLADVGAQTPFFYIFREREMIYDLWEAATGQRLINNNYFRIGGVACDLPSGWLEKCTDFCKWFGPKIDEYEKLITNNPIFRRRIEGLGAISREEAINWSLSGPMLRASGVSWDLRKVDHYECYDDFDWSISTATEGDCFARYRVRIEEMRQSLKILLQACEMIPGGPTENLEASRMLEGKGSKFAGFDYQYVAKKVAPTFKIPDGELYTRLESGKGEIGVFIQGNNDVTPWRFKIRAADLNNLQILPHILKGAKVADIMAILGSIDVIMGSVDR

SEQ ID NO: 25186 - protein, 1456 aa, Methanosarcina acetivorans C2A
MEEKLRTSGIDIIGDIPWGTHFCQFYQTKEDLMDVLVPYLKAGLENNEFCMWVTSQPLDVKDAKEALRRAVPDLDTYLEKGQIEIIPYTHWYVQEGSFDSERVLNGWIEKLNKALANGYDGLRLTGNTFWLEKKDWNDFVDYEEEVDRVIGNYRMIALCTYCLEKCNSTEIVDVVINHQFALIKREEKWEQIESSKRKRAEETALQAAKDWKYTFDAVPDLIAILDTEYRIVRANRAMAAKLGVTPEECVGLTCYHAIHGTDEPPSFCPHRQLLKDELEHTTEVCEDCLGGCFLVSVSPLYDSKGNLIGSVHVARDITERKQTEETLFEAYENIQVQSEELHAQAEELQAQNEELHAQAEELMKTNEALIESKKRFELLSEANAFLLSSKEPETTILTIAENVMRYLKCDVFFNYVFDRENGKLHLNACGGISAEAAKEIEWLDKGVAICGCVARDGCRIVAEDVQYNWDKRADLVRSMGIQAYACHPLHVGETTIGTLSFGTKSRKDFKEDELALMKTVADQVSVAIERKRAEEALSEAYENLQVQSEELQAQSEELNEAYELLRKSEKRFRTLAENSPDVIARFDRQNRHLYVNPAATEPYGRSPEEIIGKTNSELGMDPELVTFWEGHYQTVFASGKTEKMEFHYISPSGKEYYFSTRIVPEFVDGEVTSVLAISRDITDIKEAEIELKEARDNLKKLVEKRTLKLRKAYKLLKESEKGLAEAQKMSHLGNWNWNIVSNKLFWSDEIYRIFGFRPQEFCATYDSFLSYVHPEDRVLVDDAVKEAFNGKTYSIDHRIIRADGKERIVHEQGEVVFDRENVPVQMKGTVQDVTERKLAEKTLELASKYNRSLIEASLDPLVTIGADGKITDVNSSTETITGYSRDELIGTDFSDYFTEPEKAKEGYRHVFQKGLVRDYPLEVLHRDRHITHVLYNASVYRDEIGEVIGVFAAARDITELKKAEEKIKTLVSAVESSDDAVITMSLDGMITSWNKGAERVYGYPAEEILGKKMSVLEPANLKGEIKQLIERIKQGEGINHYETVRLKKDSTLVDISVALSPVFDDSGKIIALSAIARDITERKKAEEALRLSNIYNRSLLEASLDPLVTIGPDGKITDVNKATEQITGYSRGELIGTDFTNYFTEPEKAKEGYQQVFRKGAVLDYALEIQHRNGSVTPVLYNASIYRDESGQVIGVFAAARDVTELKKAEKILELKLEELARSKADLEQFAYVSSHDLQEPLRMIASYLQLLQRRYQGELDERADKYIYFAVDGASRMQSLINDLLEFSRVTTKAREFEPTDCESILNYVLSDLEVSIKENEATVSYDSLPEIMADGTQLTQVFQNLISNAIKFRSKEAPKIHVSAEKEDDKWRFSVQDNGIGINPKYSEKIFEVFKRLHKREEYPGTGIGLSICKKIIERHGGDIWVKSEPGRGSTFYFTLPASFEKIALNKIKE

SEQ ID NO: 25187 - protein, 308 aa, Oryza sativa (japonica cultivar-group)
RRRRGGGGGGGWDDWDDDFRPDMRRNQSVGSFGESGAESGRQPPRSKSTQDMYTRQQLEASAANKDSFFARRMAENESKPEGIPPSQGGKYVGFGSSPAPSANRNGAAAQGDVMQVVSQGIGRLSLVAASAAQSAASVVQVGTKEFQSKMREGGYDQKVNETVNVVANKTAEIGSRTWGIMKGVMALASQKVEEYAKEGGNGWGDDWQRREQGSEPYHRFERETNGNGWNSSSHDGSSKNYNSNSWDDWDEPVKKDEPAKERQSSDSWAGWDDGKDDNFDSYNHSTPSKGSNQNGTTGGSYWTEGGFR

SEQ ID NO: 25188 - protein, 562 aa, Glycine max
MAPSTTVPNGTLPSGSVTGRLASVYSEVQKTRVDHALPLPSVLKHPFTILHGPPSSAAGNPDEIAKLFPHLFGQPSAALARSDAAQTQKKLKIGVVLSGGQAPGGHNVISGIFDYLQERAPGSTLYGFKGGPAGIMKCKYVELTSEYIYPYRNQGGFDMICSGRDKIETPEQFKQAEETAKKLDLDGLVVIGGDDSNTNACLLAENFRSKNLKTAKNSCPETIDGDLKCKEVPTSFGFDTACKIYAEMIGNVMIDARSTGKYYHFVRLMGRAASHITLECALQTHPNITIIGEEVAAKKMTLKDVTDYIVNIISKRAEDNYNYGVILIPEGLIDFIPEVQHLIAELNEILAHDTVDEGGLWKKKLTDQSLKLFEFLPKAMQEQLMLERDPHGNVQVAKIETEKMLIQMVETELEKRKQQGSYKGGFRGQSHFFGYEGRCGLPTNFDSTYCYALGYGAAALLQSGKTGLISSVGNLCAPVEEWTVGGTALTSLMDVERRHGKFKPVIKKAMVELEGAPFKKFASLRDEWALKNRYISPGPIQFTGRGSDAINHTLLLEFGAQA

SEQ ID NO: 25189 - protein, 550 aa, Brassica rapa subsp. pekinensis
LTMKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPKGKVSRGVNQGGLDYYHKLLDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTEEEAELVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSSENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 25190 - protein, 187 aa, Schizosaccharomyces pombe 972h-
MLVLVIGDFHIPDRAPKLSEKFRQLLIPGKISQIICLGNLTSTSVYEYLKHVCSDLKLVKGAFDISSKAPIAGKITLGSFKIGYTNGHLVVPQDSPEALSILAREMDADILLFGGTHKFAAYELDGCFFVNPGSATGAPNVSAVEDDEKIVPSFVLMDVQGAVLILYVYRIFDGEVRVEKMQYRKPE

SEQ ID NO: 25191 - protein, 323 aa, Clostridium thermocellum ATCC 27405
MFDVVAVGELLIDFLPAGTNENGMPLFSSNPGGAPANVLAMLSKLGAKTAFIGKVGKDGFGQFLKATLDNAGIDTSNLLMSSSEMTTLAFVHLNEKGDRSFSFYRKHCADVSLDAGELDKDLLRTCHFLHFGAVSLTDEPSRTATLEAARIAKEAGAIISYDPNYRPALWSNEHEARKYMLKAVEYADLVKVSEEELWLLAESEDFSKGAHKLLAMGPSVVFVTCGEKGSYVFTGSCKANHCGYDVKVVDTTGAGDAFVGAMLWQLRGMSLEEISQICEQKWGELLAFSNAAGTIVATKKGAIPAMPDLDTINTFMRQFLEEK

SEQ ID NO: 25192 - protein, 193 aa, Oryza sativa (japonica cultivar-group)
MPSSSVCPLPMAAKTNIELQHDFEEWGVESRPPGGFVNLINAPSNHMHHVAEGSPSQPINVENGDISRTKKRLLWTNDEDLRLISAWLNNSNDSIESNFKKNDKYWGDVAAAYNSTTPKSRVRQVKQVKDRFGKIKKKVGNFCCSWKEANSLYASGESHDDLMAKAVKMYENDFKDGTCSAQYVQIMVLHFSK

SEQ ID NO: 25193 - protein, 358 aa, Glycine max
MSHFKGKYHDELIANAAYIGTPGKGILAADESTGTIGKRLASISVENVESNRRALRELLFTAPGALKYLSGVILFEETLYQSTAAGKPFVEVLKEAGVLPGIKVDKGTVELAGTNGETTTQGLDGLGQRCAKYYEAGARFAKWRAVLKIGPNEPSELAIHENAYGLARYAVICQENGLVPIVEPEILVDGSHDIHKCAAVTERVLAACYKALNDHHVLLEGTLLKPNMVTPGSNSAKVSPQVVAEHTVRALQRTVPAAVPAIVFLSGGQSEEEASVNLNAINQVNGKKPWSLSFSFGRALQQSTLKAWSGKEENVKKAQEALLVRAKANSEATLGTYKGNSKLADGASESLHVEDYKY

SEQ ID NO: 25194 - protein, 157 aa, Zea mays
  misc_feature (24)..(24): Xaa can be any naturally occurring amino acid
  unsure (1)..(157): unsure at all Xaa locations
MAAAAAASASVAPSSPKAAGDNRXKTVVSVDASELEKHVLAVDDSSVDRAVIARILRGSRYKVTAVESATRALELLALGLLPDVSMIITDYWMPGMTGYELLKRVKESAALRGIPVVIMSSENVSTRITRCLEEGAEGFLLKPVRPADVSRLCSRIR

SEQ ID NO: 25195 - protein, 170 aa, Synechococcus sp. CC9605
MIDATPSHAVLREFFDNSSLTWGLMACGVAQLSKLFLELLLHRRWRPAVLIETGGMPSSHSALVTGTAACVGWTLGFDHPLFALAAMVAFVVMYDASGIRRAAGLTAERVNGLPDSLWPDAPEKPLKESLGHSRLQVLVGSLMGPAIALPGLEFVGSPLHLLSGLGAGLG

SEQ ID NO: 25196 - protein, 147 aa, Oryza sativa (japonica cultivar-group)
MSLAPSIPSIKVKVGGVAAVAVSPPRHRACRSSFAVIRSSKAEGAPRRPAGPPLSPPPKTPTLSTPPTLSQPPTPVKPAAPSSSPPPSQDPEPKQAAAPVAVAAPAAAGAVTLEYQRKVAKDLQDYFKQKKLDEADQGSLLWVLGQE

SEQ ID NO: 25197 - protein, 194 aa, Brassica napus
  misc_feature (180)..(180): Xaa can be any naturally occurring amino acid
  unsure (1)..(194): unsure at all Xaa locations
MAEETKNVHEQEVPKVVMEESSAATGEVTDRGMFDFLKKKKEETKPEETINSEFEQKVQVSEPVPEVKHEEAEKKPSLLEKLHRSDSSSSSSSEEEGEDGEKRKKKKKDKKKIATEGEVQTEEEKKGFMDKLKEKLPGHGKKPEDDSTAVAAPVVAPPVEEAHPAEKKGILEKIKEKLPXYHSKTVDEEKKDDH

SEQ ID NO: 25198 - protein, 376 aa, Burkholderia pseudomallei K96243
MAKRDYYEVLGVAKNASDDEIKKAYRKLAMKYHPDRNPDSKDAEEHFKEAKEAYEMLSDGQKRAAYDQYGHAGVDPNVGAAGAQGFGGFADAFGDIFGDIFGQAAGGGRARGGPQVYRGADLRYSMEITLEQAAHGYDTQIRVPSWAACGVCHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPSGDLYVEIHIKPHAVFERDGDDLHCQMPIPFTTAALGGEIEVPTLAGRASFTVPEGTQSGKTFRLRGKGIKGLRSSIAGDLYVHVQVETPVKLTDQQRDLLKQFEKSLAEGGPRHSPQSKSWFDRVKSFFE

SEQ ID NO: 25199 - protein, 161 aa, Neurospora crassa
MPLESLGLGGGNDLSDPNDPRVCIIHSLSMESPGREPVVIDLSTPGSLEDLKKKPFTIKEGAKFTMKAQFKVQHEILSGLHYVQTVKRGKIRIPGGKTSEMIGSYAPNTDKNPMYTKTFAEEEAPTGMLARGNYNAVSRFVDDDGKTHLEFEWSFDIAKDW

SEQ ID NO: 25200 - protein, 405 aa, Oryza sativa
MSLGYAEKLSYREDVGNVGMPEIFDSPELLHKKIEELAVMVRESKHLVVFTGAGISTSSGIPDFRGPKGVWTLQVRSGKGVPGASLPFHRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQKADLVLCLGTSLQITPACNMPLLSLKNGGRVAIVNLQATPKDKKASLVIHGLVDKVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRESYFQVVDISMVRGCICGRSVLMHSTIINIGVNSSEHV

SEQ ID NO: 25201 - protein, 548 aa, Brassica rapa subsp. pekinensis
MKLLHGLALVFLLAAASCKADEEITCEENNPFTCSNTDILSSKNFGKDFIFGVASSAYQIEGGRGRGVNIWDGFSHRYPEKSGSDLKNGDTTCESYTRWQKDVDVMGELNATGYRFSFAWSRIIPKGKVSRGVNQGGLDYYHKLIDALLEKNITPFVTLFHWDLPQTLQDEYEGFLDRQIIQDFKDYADLCFKEFGGKVKHWITINQLYTVPTRGYAVGTDAPGRCSPMVDTKHRCYGGNSSTEPYIVAHNQLLAHATVVDLYRTKYKFQKGKIGPVMITRWFLPFDESDPASIEAAERMNQFFHGWYMEPLTKGRYPDIMRQIVGSRLPNFTDQEAALVAGSYDFLGLNYYVTQYAQPKPNPYPSETHTAMMDAGVKLTYDNSRGEFLGPLFVEDKVNGNSYYYPKGIYYVMDYFKTKYGDPLIYVTENGFSTPSEENREQAIADYKRIDYLCSHLCFLRKVIKEKGVNVRGYFAWALGDNYEFCKGFTVRFGLSYVNWEDLDDRNLKESGKWYQRFINGTVKNAVKQDFLRSSLSSQSQKKRFADA

SEQ ID NO: 25202 - protein, 233 aa, Polaromonas sp. JS666
MRPPGLQLIKIVPMTASLESLFSHNRAWAAQMEAERPGFFTSLVKQQTPKYMWIGCSDSRVPANQITGLEPGEVFVHRNVANIVVHSDLNALSAIQFAVERLKVKDIMVVGHYGCSGVQAALEGARIGLADNWIRHIQDVRHRHRQLLDSLPDAVRANALCDINVIEQVVNVSVSTVMVDAWARSQDVTVHGWAFGVHDGLLQDLQMSVSDPEELDARYRQAVDRVWDLWNSR

SEQ ID NO: 25203 - protein, 110 aa, Schizosaccharomyces pombe 972h-
MTSIAKAFVEKAISNNPVTVFSKSFCPFCKAAKNTLTKYSAPYKAYELDKIENGSDIQAYLHEKTKQSTVPSIFFRNQFIGGNSDLNKLRSSGTLTKMIAELKENKSSIL

SEQ ID NO: 25204 - protein, 322 aa, Gibberella zeae PH-1
MTEYEPRKRVVDSPKVWTTLITNLSYLPGLLTLDHSLRVAKSQYPLVALYTDTFPPEGHAALRARGIPTQHIPYLLPTKGKDYSNDPRFYDCWSKLTPFSLTEYDRVVQLDSDMLVLRNMDELMDLELDAPSIAETGDKTISKRVFAAGHACVCNPLKKPHYPKDWVKENCAFTSQHSTPDIAQTEAADPSVGPLGFMNGGLQVVNPSQGLYAQIVAHMEADAVNMDFADQSLLSDLYRERWVPLPYIYNALKTMRWEGVHNTIWRDESVKNIHYILSPKPWDEINDKGEWTGKDESHKWWVDVNRMRKEAEKEKGIPDDGF

SEQ ID NO: 25205 - protein, 539 aa, Schizosaccharomyces pombe 972h-
MSSTEVPGEVSTSVSSYFDTILILDFGSQYSHLIARRLREIHVYAELLPCTQKIEALPFKPIGVILSGGPYSVYDDIAPHVDPAVFELGVPVLGICYGMQEIAWLNGRCVEPGIEREYGPATVSMEPEIKTEVFKSFFNSMPKEFEVWMSHGDRLSALPNGYETIGRTKNSPFAVIAHVTKPIIGLQFHPEVTHTPLGLQLIKNFAIEICHAKPNWSMENFVDKEILRIRKMIGPSDHVIGAVSGGVDSTVASKVLKEAIGDRFHAIMVDNGLLRLNEAEIVRETLNKHLGIQLTVVDASEEFIGKLKGVTDPEKKRKIIGNTFIHVFEREAERIVKETNGKVEYLLQGTLYPDVIESISFKGPSQTIKTHHNVGGLLKDMKLKLIEPLRELFKDEVRALGELLGIEHSLVWRHPFPGPGLGIRILGEVNAAQLEIARKADHIFITEIRNHGYYDKISQAFAALLPVKAVGVMGDKRTHEQVIALRAITTSDFMTADWYDGFSIKFLKLVSSRICNEVSGVNRVLYDISSKPPATVEME

SEQ ID NO: 25206 - protein, 214 aa, Oryza sativa (japonica cultivar-group)
MRDVVVAVGGGTKAASRQQGQGGVTLAAAAAGSGSGSAASPCAACKLLRRRCAAGCVFAPYFPPGEPHKFANVHKVFGASNVSKLLQEIPVQHRGDAVSSLVYEANARVRDPIYGCVGAISSLQQQVEALQAQLALAQAEMVRLRMSNDYIGRRLRARGCGGGGGGGGGSTTTTTGSPSSMSSPAKTAEPEPLCKPTPELDMVVDQPDFGFWSY

SEQ ID NO: 25207 - protein, 123 aa, Glycine max
MATAAAPAVVAWTRTGTAFKSGQAQMKSEMKVSYVRGLNSYGGLKAQNNKVVSMGLPVCTEQCFANVVMSLKGRTSRGGALTSTCNAVGEIFKIAAIMNALTLVGVAVGFVLLRIEASVEEAE

SEQ ID NO: 25208 - protein, 113 aa, Prochlorococcus marinus str. AS9601
MTETTIFQKIINEEIPCDKLYEDKFCIAFNDIQAQAPVHFLVIPKKPIISLLDCIEEDVNLLGHLLYVGSKIAKSKNLTNWRTVINTGAESGQTVFHLHIHFLSGRKMNWPPG

SEQ ID NO: 25209 - protein, 413 aa, Rickettsia heilongjiangii
IAELKIRGKIFKLPILKASIGEDVIDISRVSAEADCFTYDPGFMSTASCQSTITYIDGDKGILRHRGYDIKDLAEKSDFLEVAYLLIYGELPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPYTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERKLYPNVDFYSGIIYKAMGIPSQMFTVLFAIARTVGWMAQWKEMHEDPEQKISRPRQLYTG

SEQ ID NO: 25210 - protein, 583 aa, Schizosaccharomyces pombe 972h-
MSSPDRSIDIDLEKYPSTATKSVYGQSKDDKNVFDIHPTESEVIPGEVEYADTPSHQNFLQKFFSDFKPVKADREDGVALKRHLKGRHMQMIAIGGAIGTGLFVGSGSSLADGGPASVIIDYTLIGIMMFFTVYALGELAVSYPVAGGFYNYAVRFIDPAWGFAVGWNYFMNYFVTFPLELTTCAITFRYWTDINSCAWITIFLVFVICINLFGVRGYGEVEFILSTLKVVATTGFIILAIIINCGGVPTDPRGYIGGKIIKNKPFRHSFKGFCSVFTTAGFSFSGTEVVGLAAAEAEDPQKSLPRATKQVFWRIAIFYVVSLILIGLLVSPDDPRLMGNSSDGSTSPFVLAIKEANIRGLPSVFNAVIIISTVSVANSCTFTASRTLHAMAAKGDAPRFFAYTDRLGRPLLAMAVCLLFGFFAYINAAGDVSDTVFDWLLAISGISNFFSWGSINLCHIVFRLAMKKQGRSLDQLGFVSPMGIWGSAIGLAFNILCLMAEFYVSLFPIGSKPNANDFFQGYLAAPIVIAFFIGYKIYDRSHIPSLSKLDLDTGLRTYPPKDKESEKIRDAKGFFKWIWQSLC

SEQ ID NO: 25211 - protein, 125 aa, Gibberella zeae PH-1
MSSDQQIVFTKNAPAALGPYSQAIKTPHMIYCSGQIPLTPEGELVQGITEQTRQACKNVQAVVEEAGSSLSKVVKTTVFISDMSYFAEINTEYEKWFSHKPARSCVAVKTLPKNVDVEVEVIALP

SEQ ID NO: 25212 - protein, 107 aa, Neurospora crassa
MTVHNIATVAEFKEAIAKHPIVVLDAFATWCGPCKAIAPTVAKWSEEPQFKDTVYFAKFDVDALPDLAQELGIRAMPTFVIFKNGDKADEFVGANPPALLATITKQL

SEQ ID NO: 25213 - protein, 165 aa, Streptomyces coelicolor A3(2)
MSNSKVYFDIDIDGQDAGRIVFELFEDVTPKTARNFLELATGEHGFGYAGSPFHRVIPQFMLQGGDFTNGNGTGGKSIYGEKFADENFQLKHTEPYLLSMANAGPNTNGSQFFVTTVPTPWLDGKHVVFGKVVEGTDVVDKIEGYGSSPAGKTSKEIKVRASGKL

SEQ ID NO: 25214 - protein, 296 aa, Prochlorococcus marinus str. MIT 9211
MPIDGLKTAPQSGARLAIRLIQDAVEKGEIDPWDVDVIPVIDGFLDQLRQKIQSPRNISSSIAYRGGTFEKDLSDSSEAFLAASVLVGLKAEILESETFPPESDFDDMDDGSFADQEWIDPKLDLPRYPERHLYRRPVAPPPLRRSISLAELIEQLEAIAETIESDELNIRRKRREKRFSDKQIIQQVSSLAHREKLPETTAALGVFLNSCEEALNWVDFEFLVELWKGIASQELDSDRVGVFWALLFLCSQGKVELQQDNSLFGKLKLKRILAPGTIAQLPLKTFDVTAVAPAAA

SEQ ID NO: 25215 - protein, 332 aa, Streptomyces coelicolor A3(2)
MTRIGINGFGRIGRNVLRALLERDTKLEVVAVNDLTEPATLARLLAFDSTAGRLGRPVTVDGDTLVVDGHRIKVLAEREPARLPWAELGVDIVLEATGRFTSADAARAHLTAGARKVLVSAPSSGADVTLAYGVNTDAYDPAAHTIVSNASCTTNALAPLAAVLDELAGIEHGFMTTVHAYTQEQNLQDGPHRDARRARAAGVNIVPTTTGAAKAIGLVLPGLDGKLSGDSIRVPVPVGSIVELNTTVARDVTREDVLAAYRAAADGPLAGVLEYSDDPLVSSDITGNPASSIFDSALTRVEGRHIKVVAWYDNEWGFSNRVIDTLALLATR

SEQ ID NO: 25216 - protein, 244 aa, Oryza sativa (indica cultivar-group)
MAADSLDMSLDDLITNKYKRRSRPDPAPSARRFHSRAATRAAAAPYHAITFQAPPTAYTHPTPVETGTKLHISNLDYAVSNEDIKELFSEVGDVKRYSINYDKSGRSKGTAEVVFSRKSDALAAVKRYNNVQLDGKPMKLELIGINIEPPPPAMFGFAAPAGYFDFPPKSLVCQEDSEKNMSSAEIFSGPAGVEEDGLGAGVDLVGVVGVMWVVGEGGETVEVGRFLLKTWMLTWTSTMRKECK

SEQ ID NO: 25217 - protein, 446 aa, Kluyveromyces lactis NRRL Y-1140
MVCPHMNQVVSNQKLGDAVLKECETVRYLLRHADFKNRTMRTMRCMDCGEISCGSTFICLQCGFCGCWNNNHFLDHSQKLGHIFGVNSSNGLVFCFRCGDFMADLVAEIPASQWDTVMEKTELPASLHRDGLQGLVNMGSTCFMSSIIQTIIHNPYFVEDLLSHKHCNNCDIKSGTKCVSCALDEIACDFYGNGPGTGKSSSVSKGFVNLLSASWHINHHLVGSSQQDAHEYWQFLLNQLHTDHARVFGSSKAPDCQCITHRIFQGYLKNTLQCSQCGFSKTTIDPIMDLSLEIKNNPKLEDCLDHFQREETLTDFHYECQSCKQNQGVVKQLTLHKAPNVLVIQLKRFEHQLNGQSAKLNDRVQFPLHLNLKPHLFQIEDEYIPNIAYDLLNVVSHQGTVDQGHYTTVSKTEDGQWFKFNDSVVTSVTEEQVLEQQAYLLFYIIR

SEQ ID NO: 25218 - protein, 240 aa, Mycobacterium sp. MCS
MTNSHSTAGSAPAVLFDIDGTLVDSNYLHVHAWHRSFADEGLTVESWRVHRCIGMDGSTLLDNLVPDADDDTRKRLKDGHSRYYLDDRGLLRLLPGARALLERIKELGLQVVLATSAPEDELDVLREVLDSEDVYSAMTSGEDVDTAKPQPDIVHIALERAGVDAEHAVFVGDAVWDIEACRRAGLTSIGVLSGGVSRGELTEAGARAVFENAEDLRVHIDESPVAALLSRADTNSQAKA

SEQ ID NO: 25219 - protein, 288 aa, Schizosaccharomyces pombe 972h-
MNVTRLYFRVAGTKQFARYVHKYAAYSSTSFQKKKSHFPSPATLDHPDAGEDAFINLRNENYILNAVFDGVGGWANVGIDPSIFSWGLVREIKKVFNNSDEFQPSPLTLLSKAYAALKKSNTVEAGSSTACLTLFNCGNGKLHSLNLGDSGFLILRNGAIHYASPAQVLQFNMPYQLAIYPRNYRSAENIGPKMGQATVHDLKDNDLVILATDGIFDNIEEKSILDIAGVVDFSSLSNVQKCLDDLAMRICRQAVLNSLDTKWESPFAKTAKSFGFKFQGGYDKIIYM

SEQ ID NO: 25220 - protein, 181 aa, Arabidopsis thaliana
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 25221 - protein, 545 aa, Prochlorococcus marinus str. AS9601
MNQVSVININSPFLDQKPGTSGLRKSTLKFQEEHYLEVFIEAILQSLGDLKGSTLVVGGDGRYGNIEAIEKIVQICIAHKVQKVIVPRYGLLSTPATSHLIRKENAIGGIILSASHNPGGIDGDFGVKLNISNGGPAPEIITNKIFKSSQLLTSYKICKIQLPDFSKYGTYHYDETTLEIIDGLTDYSNLMEKIFDFDQISDFLKKDFSLIFDAMNAVTGPYAKNIFVEKMGLAPDCVMNGNPLKDFGGLHPDPNLTYASHLADLLLNKKSYSFGAACDGDGDRNMILGSGCFVNPSDSLAVITANTKCVPGYKDGITGVARSMPTSSAVDNVARALNIPCFETPTGWKFFGNLLDSNLITLCGEESFGTGSNHVREKDGLWAVLYWLQVLAEKKCSVSDLMQNHWKQFGRNYYSRHDYEAISSNIANQIFGNLTSLLENLKGNSFAGHLVKVADNFSYLDPVDNSISENQGLRLVLDDNSRVIVRLSGTGTKGATLRLYFEKFFDPQQNLSLNPQIALKPLIDDLDALLNISKLTQMENPTVIT

SEQ ID NO: 25222 - protein, 98 aa, Zea mays
  misc_feature (17)..(17): Xaa can be any naturally occurring amino acid
  unsure (1)..(98): unsure at all Xaa locations
MSGRGKGGKDLVKGGAXRHRKVLRDNIQGITKPDILSLAMRGGVKRISRLIYEETRDVLKIFLENVIRDGGTYTEHARRKTGTAMDGVYALRRQGPTL

SEQ ID NO: 25223 - protein, 662 aa, Arabidopsis thaliana
MTTISDLSDDLVGDILSRVPFTSLISVRSTCKKWNALSKNQIFGRKTAARNQFLEFMILDSRVCSLRLDLQGIRNEDKEDFVDPSMKLISIPSNDDQVEISQVYHCDGLLLCIAKENSNVFVWNPYLGQTKWIRPRNTFHRYDRFALGYDNNRNHKILRFLYDEESNESSRRTHIDVYDFSSDSWRVLDVNPDCDIPFYQTGVSLKGNTYFFGQEVTQATKVTEIETCLLCFDFTTERFGPCLPLLFYPPCPSFETVTLSWVRDEKLAVLYNHYVTAEIIEIRISTKIEPNAVSWSSFLTVDMSLVNGLPDHFSMYFEAKSFFIDEEKKVVVLFDSKEIKTCRYQMAYIVGDDGYFKSVNIGEKVGDRERNGSQMKTSLLCIAEDNSGLVVWNPYLCQTKWIRLRNTFHRYDVFALGHDNNRNHKILRFLYDAKKYRTGRGRDNDVYDFSSDSWRRVFDVNPHRGELFYYSGVSLKGNSYFFGQEVTIEEEEEEVISQPRDYLLCFDFTTERFGPRLSLPFNPPSPNFDYLTLSWARDEKLAVLYNHYNTREIIEIWISTKIEPNTVSWSTFLTVDTSLINGLPDRFSTFYGPRSFFIDEEKKVAVFFDNKGTETGCYQVAYIIGDNGYFKSVKIGVISNSQWQQGILVCSSYVPSLVQLQD

SEQ ID NO: 25224 - protein, 480 aa, Pseudomonas fluorescens Pf-5
MQLKDAQLFRQQAFIDGAWVDADNGQTIKVNNPATGEILGTVPKMGAAETRRAIEAADKALPAWRALTAKERATKLRRWYELLIENQDDLGRLMTLEQGKPLAEAKGEIAYAASFIEWFAEEAKRIYGDVIPGHQPDKRLIVIKQPIGVTAAITPWNFPAAMITRKAGPALAAGCTMVIKPASQTPFSALALVELAHRAGIPKGVLSVVTGSAGDIGGELTSNPIVRKLSFTGSTEIGRQLMAECAKDIKKVSLELGGNAPFIVFDDADLDKAVEGAIISKYRNNGQTCVCANRLYIQDSVYDAFAEKLKAAVAKLKIGNGLEEGTTTGPLIDEKAVAKVQEHIADALKKGATLLAGGKSMEGNFFEPTILVNVPKDAAVAKEETFGPLAPLFRFKDEAEVIAMSNDTEFGLASYFYARDLGRVFRVAEALEYGMVGVNTGLISNEVAPFGGIKASGLGREGSKYGIEDYLEIKYLCLGI

SEQ ID NO: 25225 - protein, 188 aa, Triticum aestivum
AGRPRTAKQKSQLAQKTVRHLLKKHSLIDQAQEADHFSIFETSPSALQLNIPLDDSPGTPDNYLKSFSLHKYSVSSSARKRPLSRLKTKHAEPSPPVLKPLKNTVLHEKYINQLTRREGAKKPRKKAAGTNATDPERPLSEQRAGSVKAAKNALISEATDFIGQFKKLQANSLAHVLENSEDDEDNSV

SEQ ID NO: 25226 - protein, 425 aa, Pseudomonas fluorescens Pf-5
MSKTNASLMKRREAAVPRGVGQIHPIFADSAKNATVTDVEGREFIDFAGGIAVLNTGHVHPKIIAAVTEQLNKLTHTCFQVLAYEPYVELCEKINAKVPGDFAKKTLLVTTGSEAVENAVKIARAATGRAGVIAFTGAYHGRTMMTLGLTGKVVPYSAGMGLMPGGIFRALYPNELHGVSIDDSIASIERIFKNDAEPRDIAAIIIEPVQGEGGFYVAPKEFMKRLRALCDQHGILLIADEVQTGAGRTGTFFAMEQMGVTADLTTFAKSIAGGFPLAGVCGKAEYMDAIAPGGLGGTYAGSPIACAAALAVMEVFEEEHLLDRCKAVGERLVTGLKAIQAKYPVIGEVRALGAMIAVELFENGDSHKPNAAAVAQVVAKARDKGLILLSCGTYGNVLRVLVPLTSPDAQLDKGLAIIEECFAEL

SEQ ID NO: 25227 - protein, 595 aa, Gibberella zeae PH-1
MAPHDVERGSISKMKEESLAPGSSFSMREPEYADILPPSYWGRFVDGFRRDQRSSLFTNDPLGQQEGLGRVHDGAHYYDLQSAMLETANSGLARELKGRHLQMIAIGGSIGRALADGGPASILLAFTIVGAMLFCTCQALGELAVIFPIAGSFSSWATRFIDPSWGFAMGWNYAMQWLIVLPLEIIAASLTLSYWDESLTRAIFVSAFLVLIIVINMFGVKGYGEAEFIFSIIKVIAVIGFILLGIVLNCGGTPDSGYIGGRFWHEPGAFNNGFKGMCNVFVTAAFSFAGTELIGLAAAETANPRKSLPTALKQVFWRITLFYIVALTLVGLLVPYNDPRLTKGTSDADAAASPFVIAIEEAGIQVLPSVMNAVILCAVLSVGNSAVFGSSRTLAALANLRQAPKILGYVDRKGRPLVAIAIASAFGLIAFLADLPQQGAVLDWLMSISGLSTIITWGSICVCHIRFRRAWAARGRSVSELPFQSQVGVVGSWIGITLNVLVLIAQFWVGAFPIGWQDLTSSQVAQNFFHKWVGAPCVLAFYIFHKLYFRTTFVRTRDMDVDTGRRDFNVPILVAQEKQERARWPRWKRYYKFMC

SEQ ID NO: 25228 - protein, 343 aa, Datura metel
MEVISTNTNGSSLLKNGVITMNGHHNGNSDHRNGGTTAHDNGRKLLGNSNSIKPGWFSEFSALWPGEAFSLKIEKLLFQGKSDYQDVMLFESATYGKVLTLDGAIQHTEDGGFPYTEMIVHLPLGSIPNPKKVLIIGGGIGFTLFEVLRYSTVEKIDIVEIDDVVVDVSRKFFPYLAANFNDPRVTLVLGDGAAFVKAAQAGYYDAIIVDSSDPIGPAKDLFERPFFEAVAKALRAGGVVCTQAESIWLHMHIIKPIIANCRQVFKGSVDYAWTTVPTYPTGVIGYMLCSTEGPDVDFKNPVDPIDKDETHANSELGPLKFYNADIHKAAFILPSFARSMIES

SEQ ID NO: 25229 - protein, 417 aa, Rickettsiella grylli
MSFIYFDHILQAEAIPITQLITHYGSPCYIYSKSRLYEQWCAFKSFIQNGHQICYAVKANSNLAILALLAHWGAGFDIVSGGEFDRVLRAGGHAENTVFSGVGKTCEEIKSALFAHIGCFNVESSGELFRIEALAKNIGAVAPIALRVNPNIDPKTHPYITTGLNDTKFGLNEKDALTLYRYAAQSNHLTIRGISCHLGSQITTIDPFLQALEHLLKLTEALKKEHILLKTINLGGGLGVTYQTENVPSVQEYSQKILALLKKRNSTLTLILEPGRALIAQAGILVTKVEYLKSNHRKHFAIVDAGMNDLIRPALYQAEHAILPIVQRSLPRKKKYDIVGPICESSDFFGKNRELVLRAGDYLAIMDSGAYGFSMSSNYNSRPRAAELMVDTDRVFLIRSRETLAQLLANETIPPIS

SEQ ID NO: 25230 - protein, 295 aa, Chlorobium tepidum TLS
MSNSQSKKIFGLIGKHVDYSWSPLIHNTGFEALGLPCVYTIFNIPSPEMIGDALKGSRALGIAGFSVTIPYKKTVVPFLDELSPEALSIGAVNTIVNDNGRLLGYNTDIDGFAAPLLPMAESIRNRPVCIFGNGGAALAAVEAFRLRFNPSSVLLVVRDTQKAEDMLEEYAYRDLVTIHAGREIDQPACSKLIRDCRVLVNATPVGTAGRNDHIHSILPTGHGLLHDGQIVYDMVYNPPETPLLAEARAAGATVIAGIEMLIAQAARAFSIWTGQELPVDLVRKTVLAAIEKSEG

SEQ ID NO: 25231 - protein, 173 aa, Oryza sativa (indica cultivar-group)
MAADSLDMSLDDLITNKYKRRSRPDPAPSARRFHSRAATRAAAAPYHAITFQAPPTAYTHPTPVETGTKLHISNLDYAVSNEDIKELFSEVGDVKRYSINYDKSGRSKGTAEVVFSRKSDALAAVKRYNNVQLDGKPMKLELIGINIEPPPPAMFGFAAPAGYFDFPPKSSRQ

SEQ ID NO: 25232 - protein, 331 aa, Oryza sativa (indica cultivar-group)
MSSSGGDGGGYDYSEDWVVNSRGMRLFTCAWVPKESSRGVVCLCHGYAVECSVTMRGTAERLARAGYAVYGIDYEGHGHSDGLQGYVPDLDALVRDCDSFFSTATASFPRRRFLLGESMGGAVALLLHRLRPDFWTGAILVAPMCKIAEEMRPHPMVVSVLKVMTSIIPTWRVVPTNDVIDLAYRMQGKRDEIRGNPLCYKGRPRLKTAYELLRVSILIESTILPHVSLPFLILHGAADRVTDPSVSDLLYRSASTTDKTFHLYTGMWHALTSGELPHNIDAVFRDIIDWLHHRTSPTSASHVQDHDLSTSFEAERKAKHDDTIHCGKQTS

SEQ ID NO: 25233 - protein, 277 aa, Triticum aestivum
MAAAATATATAVRLHAAATRRAAPRRPARLAVRADAARAATALTQDDLKRLAAVRAVEQVQSGMVLGLGTGSTAAFAVAEIGALLASGKLSGIVGVPTSKRTFEQATSLGIPLSTLDDHPVIDLAIDDDDEVDPDLNLVKGRGGALLREKMVEAASGKFFVVVVDETKLVTGLGGSGLAMPVEVVQFCWKHNQVRLQDLFNEEGCEAKLRLNEDGKPYVTDNSNYIVDLYFKTPIKDALGAGKEIAALEGVVEHGLFLNMATSVIIAGSDGVSVKTK

SEQ ID NO: 25234 - protein, 119 aa, Alternaria tenuissima
STGGKAPRKQLASKAARKSAPSTGGVKKPHRYKPGTVALREIRRYQKSTELLIRKLPFQRLVREIAQDFKSDLRFQSSAIGALQESVEAYLVSLFEDTNLCAIHAKRVTIQSKDIQLRP

SEQ ID NO: 25235 - protein, 207 aa, Bradyrhizobium japonicum USDA 110
MATSHGPLRVGVGGPVGSGKTALMDLLCKTMRERYDIAAITNDIYTKWDAEFLVRSGSLTPDRIAGVETGGCPHTAIREDASMNLAAVADMRAKFPGLDLVLIESGGDNLAATFSPELADLTIYVIDVAAGDKIPSKGGPGITRSDLLVINKIDLAPHVGASLEKMETDARRMRGARPFVMTNLKKSEGLDRIVGFIEAKGGLKRAG

SEQ ID NO: 25236 - protein, 452 aa, Pseudomonas syringae pv. syringae B728a
MAFDFDLFVIGAGSGGVRAARFAAGFGARVAVAESRYLGGTCVNVGCVPKKLLVYGAHFSEDFDHAKGFGWSLGEAEFDWATLIANKDREINRLNGIYRKLLVDSGVTLLEGHARLTGPQQVEINGQTYSAERILVATGGWPQVPDVPGREHAITSNEAFYLKTLPKRVVVVGGGYIAVEFASIFNGLGADTTLVYRRELFLRGFDGGVRTHLHEELLKRDMTIRFNSDIERIDKQADGSLLLSMKGGGTLETDCVFYATGRRPMLDNLGLDSVDVKLDEHGYIKVDEHYQSSEPSILAIGDVIGGVQLTPVALAEGMAVARRLFKPEQYRPVDYNHIPTAVFSLPNIGTVGLTEEDAIKAGHDVQIFESRFRPMKLTLTDDQERTLMKLVVDAKTDRVLGCHMVGPDAGEIVQSLAIAIKAGATKQVFDDTIGVHPTAAEEFVTMRTPVKR

SEQ ID NO: 25237 - protein, 551 aa, Herbaspirillum seropedicae
MEIPSSQAGVVKEVKVKVGDKVAEGSLLLLVEAAGQAAAAPAPAAPPAPAAAAAPAPAAAPAAAPTAAPTAASFGGSADVQCDVMVLGGGPGGYSAAFRAADLGLNTVIVEREATLGGVCLNVGCIPSKALLHVAAVIDETAAMASHGVTFGKPQIDIDKLRAYKDKVIGTMTGGLAGMAKARKVQVVNGDGQFAGPNHIEVTAADGSKKVVQFKHAIIAAGSSVVNLPFVPQDPRIVDSTGALELRQVPKRMLVIGGGIIGLEMATVYSTLGARIDVVEMMDGLMQGADRDMVKVWQKFNEKRFDNVMVKTKTVAVEALPEGIKVTFEAAEAGATAPEPQLYDLVLVAVGRSPNGKKLSADKAGVIVSDRGFIAVDKQMRTNVPHIFAIGDLVGQPMLAHKAVHEGHVAAEAIAGEKSFFDASVIPSVAYTDPEVAWVGVTEDEAKAKGIKIEKGHFPWAASGRAVANGRSEGFTKLLFDAETHRIIGGGIVGTHAGDMIGEVALAIEMGADAVDIGKTIHPHPTLGESLGMAAEVAEGHCTDLPPQRKK

SEQ ID NO: 25238 - protein, 334 aa, Haemophilus somnus 2336
MTIKIGINGFGRIGRIVFRAAQTRDDIEVVGINDLIDVEYMAYMLKYDSTHGRFDGTVEVKDGNLVVNGKAIRVTSERDPANLKWNELGVDVAVEATGLFLDDATARKHITAGAKKVVLTGPSKDATPMFVNGVNFDAYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCSLTSVFDAAAGIALTDTFVKLVSWYDNETGYSNKVLDLVAHVHNYKG

SEQ ID NO: 25239 - protein, 309 aa, Arabidopsis thaliana
MDILTTILNLLLPPLTIIFLFLFYPFYLLIKLVLCLRKNLHFENVARKVVLITGASSGIGEHVAYEYAKKGAYLALVARRRDRLEIVAETSRQLGSGNVIIIPGDVSNVEDCKKFIDETIRHFGKLDHLINNAGVFQTVLFEDFTQIQDANPIMDINFWGTTYITYFAIPHLRKSKGKIVAITSGSANIPLPLASIYAASKAALLRFFETLRIELSPDIKITIVLPGVVSTDMTTPHCIEKYGSDFILSESVSKCAKAIFRGIGRGETYIEEPSWMKWLFIMKNVCPEIVDYGLNYLFVSYLKPYFKRD

SEQ ID NO: 25240 - protein, 524 aa, Kluyveromyces lactis NRRL Y-1140
MSPVEVSNVFDTILVLDFGSQYSHLITRRLREFNVYAEMLPCTQKIADLHWKPKGVILSGGPYSVYEKDAPHVDKAIFDLGVPILGICYGLQEIAWINNTEVGRGEKREYGPATLRVEDKSCPLFANVDHSTVWMSHHDKVHNLPAGFKITATSENSPFCGIANEDKQIYGIQFHPEVTHSTQGKTLLRNFAVDICKASQSWNMENFIDTEINRIRELVGPDAEVIGAVSGGVDSTVAAKLMDRAIGDRFHAIMVDNGVLRLNEAATVKKTLGEGLGINLTVVDASDEFLDKLKGVTDPEKKRKIIGNTFIHVFEREAAKIQPKNGKEIEFLLQGTLYPDVIESISFKGPSQTIKTHHNVGGLLENMKLKLIEPLRELFKDEVRELGELLGISHELVWRHPFPGPGIAIRVLGEVTREQVAIARKADYIYIEEIRKAGLYNNISQAFACLLPVKSVGVMGDQRTYEQVIALRAIETTDFMTADWYPFEHSFLKKVASRIVNEVDGVARVTYDITSKPPATVEWE

SEQ ID NO: 25241 - protein, 135 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEE

SEQ ID NO: 25242 - protein, 183 aa, Capsicum chinense
GAYGIVCSALNSETNENVAIKKVANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDFGLARVTSETDFMTEYVVTRWYRPPELLLNSSDYTAAIDVWSVGCMF

SEQ ID NO: 25243 - protein, 180 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQALSEEHCQYFLYQILRGLKYIHSANVLHRDLKPSNLLLNANCDLKICDLGLARVTSETDSMTEYVVTRWYRPPELLLNSSDYTAAIDVWSVG

SEQ ID NO: 25244 - protein, 183 aa, Capsicum chinense
GAYGIVCSALNSETNEHVAIKKIANAFDNKIDAKRTLREIKLLRHMDHENIVAIRDIIPPPQREAFNDVYIAYELMDTDLHQIIRSNQGLSEEHCQYFLYQILRGLKYIHSANVLHRDLKPSNLLLNANCDLKICDFGLARVTSETDFMTEYVVTRWYRPPELLLNSSDYTAAIDVWSVGCIF

SEQ ID NO: 25245 - protein, 600 aa, Rhodobacter sphaeroides 2.4.1
MLDQSESLALASLVAELERALVAQDAEAVADCFLETGFWRDLAAFTWNIKTCEGKGEIRAMAGAQLGAIGPQALALDPAETVSSADGVTEGWLTFETATGRGMGHIRMKDGKVWTLLTALHELKGHEEPRRLRRPMGAEHGHDPHRKTWKEKREEEARRLGYEEQPYVLIVGGGQGGIALGARLRQLGVPTIILEKNERPGDSWRRRYKSLCLHDPVWYDHLPYIPFPDNWPVFAPKDKIGDWLEMYTKVMELNYWSSSTARSARYEEAAGEWTVVVDRNGEEVVLRPKQLVLATGMSGKANVPSFPGQDIFRGEQQHSSQHPGPDAYKGKKVVVIGSNNSAHDICAALWEGGADVTMVQRSSTHIVKSDSLMEVCLSGLYSEQAVAQGIDHEKADMIFASVPYRIMHEFHIPQYEEIQRRDADFYDALRKAGFLLDFGDDGSGLFMKYLRRGSGYYIDVGACDLVIDGSIKLKSGSDVSHLTEEAVVLKDGTELPADLVVYATGYGSMNGWAADLISPEVADKVGKCWGLGSDTTKDPGPWEGEQRNMWKPTMQEALWFHGGNLHQSRHYSRYLALQLKARQAGIETPVWGLQPPSHLR

SEQ ID NO: 25246 - protein, 348 aa, Crocosphaera watsonii WH 8501
MKTILAIETSCDETAVAIVNEQKIYSSIVASQIDLHKRYGGVVPEEASRQHLLTINPCVEEALQVAKLTWNDIDGIAATVAPGLIGALMVGETAGKTLAMIHQKPFLGIHHLEGHIYATYLSQPDWKPPFLCLLVSGGHTSLIHVKDCGIYEQLGNTHDDAAGEAFDKVARLLNLGYPGGPVIDKLATRGNPKRFSLPEGKISLPQGGYHPYDFSFSGLKTAVLRLVEKLKQENSESLPIADLAASFQETVARSLTKKTITCALDHNLTHIAVGGGVAANSGLRDHLQEAAKKHNLTVHFPPLKLCTDNAAMIGCAACDHLKRGHISSWNLGVQSRLPITDVMTLYLG

SEQ ID NO: 25247 - protein, 427 aa, Herbaspirillum seropedicae
MTKTNASLFARAQQSTPGGVNSPVRAFRSVGGTPRFIERAEGPWFWDAEGKRYIDYIGSWGPAIVGHAHPEVIQAVQQAAARGLSFGAPTEAEIEMAEEIIKLVPSIEQIRLVSSGTEATMSALRLARGATGRDKIIKFEGCYHGHADSLLVKAGSGLLTFGNPTSAGVPEDFAKHTLVLDYNDAAQLEEAFKTAGNEIACVIVEPVAGNMNLVRASDEFLRTMRRLCTEYGAILIFDEVMSGFRVARGGAQELNGIVPDLTALGKVIGGGLPVAAFGGRAEVMKHLAPLGGVYQAGTLSGNPVTVAAGMATLKIIQQPDFYTNLSTQTRKLADGLAAAAQAAGVTFAADAIGGMFGLYFDAKVPTSYAEVMQGDKERFNRFFHKMLDAGVYFAPSAFEAGFVSAQHSDAIIEETVAAAARAFSELG

SEQ ID NO: 25248 - protein, 683 aa, Kluyveromyces lactis NRRL Y-1140
MGSSLNGFITKNTGGSKHSGGSIFQREPVAKSHSSTKSNLSLAIQTQINSEEHIPIPIPGSNSSKDADALLLGSNKNSVDNDDDDDDDYSSCDEKNEESAKDYKPGGYHPAYKGETYKEGRYVLVRKLGWGHFSTVWLAKDTETGSHVAMKIVRSDKVYTESALDEIKLLQGVNPLQNQSFSEHKGSAHILRLLDNFIHSSVNGEHVVMVFEVLGENLLALIKKYEHKGIPIVYVKQIAKQLLLGLDYMHRKCGVIHTDIKPENVLMEIGDVEAIVRIVEEMDQVKREQRKLQRRASRAHLENISRHNSFNTAFDNPSISASSSSTTIRSRRPRRATIVTGSQPLPSPLASSSFLELKSHMFGNTTASISRQQSFCGKSGQPTLQNNNCNTTNTLLTEQTLTNNTNATSAATTTLTSPVGQNSNASISRLHNLLSTENKDVNSSSEQLAHSFSSMEIVDNKVPGDESTKEAAFNTSINENRPDVIQVKIADLGNACWYDEHYTNAIQTREYRSPEVILDCSWGASADIWSFACLIFELLTGDFLFEPQNGHSYTKDDDHIAQIIELLGNIPESLMTTGRAVRTFFTSRGELRNISRLKYWPLKSVLIEKYNMAPKEAEEISDFLLPMLSIDPRKRADAGGMLNHPWLSDTLGMEDITIPDRKLYQSGADIPGWYKEVQGHPKH

SEQ ID NO: 25249 - protein, 727 aa, Pseudomonas syringae pv. syringae B728a
MNTKSTTPAEDNSAPLDNPGSTPSRIREGLPFPLGASWDGLGVNFALFSANATKVELCLFDSTGEIELERIELPEYTDEIYHGYLPDAHPGQIYGYRVYGPYDPKNGHRFNHNKLLIDPYAKQLVGELKWSEALFGYTIGHPDGDLSFDERDSAPFVPKSKVIDEAYTWGRDQRVGTPWDKTIFYETHVRGITMRHPEVAEELRGTFAGLGSAPVVEHIRKLGVTSVELLPIHAFVNDQHLLQKGMTNYWGYNSIAFFAPDPRYLASGKIAEFKEMVAHLHHAGLEVILDVVYNHTAEGNELGPTLSMRGIDNASYYRLMPDDKRYYINDSGTGNTLDLSHPCVLQMVTDSLRYWASEMHVDGFRFDLATILGRYHDGFDERHSFLVACRQDPVLRQVKLVAEPWDCGPGGYQVGGFPPGWMEWNDKFRDTVRAFWKGDEAQLADFAARMTASGNMFNQRGRRPQASVNFITAHDGFTLHDLVSYNDKHNEANDENNQDGSNNNLSWNHGVEGPTEDPEINSLRLRQMRNFFATLLLAQGTPMIVAGDEFARTQHGNNNAYCQDSEIGWINWDLDEDGEALLKFVTRVIKLRQTYPILRRSRFLVGDYNEEIGVKDVTWLAPDGNEMSVEQWHDANGRCLGMLMDGRAQETGIRRAGADATLLLVVNAHHDGVNFTLPEVPEGTHYECLIDTNQDDARSKEHFAFGSQYTVTPRSLLLFELKREDQQ

SEQ ID NO: 25250 - protein, 589 aa, Candida albicans
MTRTTRIDTQEATKHKDLPPVPSPLSLSSNPNPECLMESKSLGRKNFKKLSLDASPVKSTSGSLRSSDMMSIKEPTSLRQKRQRPPPILHLPTASSSATSTPTSNITGSSSASSIQFAQKSPGSGVIVSQTLSRPSSAGGIPSSGYSSLNVNQSNRNVDPDNVVSTDMILNQISNLDLTSMNHHRQHYQNSHHHLPTTNRKRQTVISSISPTKSSAASSPLEPQIQSLPASSQSPIATTSALKLNNKDLLTLKQLGSGNSGSVSKILHIPTQKTMAKKIIHIDSKSVIQTQIIRELRILHECHSPYIIEFYGACLNNNNTIVICMEYCNCGSLDKILPLCENKQFPTFVLKKLSFAILSGLTYLYTTHKIIHRDIKPNNVLMTHKGEFKLCDFGVSRELTNSLAMADTFVGTSMYMSPERIQGLDYGVKSDVWSTGLMLIELASGVPVWSEDDNNNDDDEDDEDDAYVRQGSIAAERNGQNSPSRSRKNKQKGNGYNSYNGPEGILDLLQRIVNEDAPTLTNKINPVTKLPYDKYLCQFIDLCLIKDDSVRKTPWQLLEDKEHFFKGVEEGVYDKEHKSWAKKIRKCKV

SEQ ID NO: 25251 - protein, 285 aa, Amborella trichopoda
GVSRSVLEMNGEVVERAEPHIGSLHRGTEKLIEYKTYLQALPYFDRSDYVSTMAQEHAHSSAVERLLNCEVPLRAQYIRVSFREITRISNHSLASTTHAMDVGASTPSLWASEEREKLLEFYERVPGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 25252 - protein, 286 aa, Schizosaccharomyces pombe 972h-
MDPVPSTQTQKWPGKHADLDPEPSLLRYCDGRVHVGSGKLAEKKTLLTGGDSGIGKAAAVMFAREGSDLVISCLPEERDDAEVTRDLIEREGRNCWIWEGKLDKSDNCRDLVDFALKKLGWIDVLVNNIAYQQVAQSIEDIDDEQWDLTFKTNIFSFFWVTKAAISHMKSGSSIVNCSSINAYVGRPDLLDYTSTKGAITAFTRGLSNQYAQHGIRVNAVAPGPIYTPLVSSTFPKEKIELSDQVPLGRMGQPVEVASCYLFLACSDGGYMTGQTLHPNGGTVINN

SEQ ID NO: 25253 - protein, 461 aa, Pseudomonas putida KT2440
MSGNNSNDLAQGLKQRHVTMLSIAGVIGAGLFVGSGHAIAAAGPAVLLAYAAAGTLVVLVMRMLGEMAVASPDTGSFSTYADRAIGRWAGFTIGWLYWWFWVLVIPLEANAAAAILHAWFPAVDLWAFSLIITLALTLTNLCSVKNYGEFEFWFALLKVLAIIGFIAVGCAALFGFVPSSQVSGTSHLFDTQGFMPNGLGAVLAAMLTTMFSFMGTEIVTIAAAESKDPGKQISRATNSVIWRICLFYLVSIFLVVALVPWNDPALAETGSYQTVLSRIGVPNAKLIVDIVVLIAVTSCLNSALYTSSRMLFSLSKRGDAPAIAQRTTKAATPHVAVLLSTAAAFLCVFANFVAPAQVFEFLLASSGAIALLVYLVIAVSQLRMRAQREARGEKITFKMWLFPGLTWATIAFIVAILVVMALREDHRAEIIATALLSIGVVAAGLLVHRKREAAGRAALDS

SEQ ID NO: 25254 - protein, 551 aa, Bradyrhizobium japonicum USDA 110
MYAYDEIDRTLVNERVSEFRDQVQRRLSGELTEDEFKMLRLQNGVYLQLHAYMFRVAIPYGTLASNQLRALAHVARKYDRGYGHFTTRQNIQFNWIKLSDLPDALADLAEVGIHAMQTSGNNMRNVTSDQWAGVAPGEIEDPRIWSELIRQHTTLHPEFSFLPRKFKIAITASDHDRAAIKVHDIGLRLIKNEKGETGFEVLVGGGLGRTPFIGKTIKHFVHGRDLLSYIEAILRVYNQYGRRDNIYKARIKILVHELGIEKFSREVEEEWQHIRNSSLQIDDEVIEDIRSRFIYPAYEKLPHMPDELRQAAADPEFEAWRKNSVAPHKNPGYSIVTISLKPIGAPPGDATAEQMDALADLADRYSFGEIRVGHEQNLALPHVAKRDLPALWKALDKLGLATPNVNLITDIIACPGLDYCSLANARSIPIAQELTRRFANHELANLIGRLHINISGCINACGHHHVGHIGILGVEKNGEEVYQITIGGRADEGAALGNLIGPGVKFDEVADVVEDIVEAYLALRARPEELFIDTVKRLGVEPFKERVYATR

SEQ ID NO: 25255 - protein, 137 aa, Zea mays
  misc_feature (40)..(40): Xaa can be any naturally occurring amino acid
  misc_feature (78)..(79): Xaa can be any naturally occurring amino acid
  misc_feature (107)..(107): Xaa can be any naturally occurring amino acid
  unsure (1)..(137): unsure at all Xaa locations
SFSLRVALGPCGDQSVTSGIGNANTAGRPYSYTLDYHTYXAVSDITNVRVIRLPTMDYLDNLHAQDYMTAHGEAIVLXXNADKAYLAKPFKMDIIDHETKRALVATXEGLSEADAGHPHDKKGIAMPDSVDSKYKSM

SEQ ID NO: 25256 - protein, 447 aa, Chlorobium tepidum TLS
MSDSDHRNSLTIIDNRTGKSYELPIENGTIRTMDLRKIKESEDDFGLLGYDPAFLNTCSCKSTITFIDGDKGILRYRGYPIEQLAEKSSFLETAYLLIKGELPDKERLAVWTYNIRHHTMTHANLTKFMDGFRYDAHPMGILVGTLGALSTFYPDAKNVGEEESRKLQVRRLIGKMPTLAAMSFRHSLGFPYVLPDNDLSYAGNFLSMMFRMTEKNYKPNPVLEHALDVLFILHADHEQNCSTNAVRSVSSSMVDPYSAIAAGCAALYGPLHGGANEAVIHMLKQIGSVDKIPEFIKLVKSGEGRLMGFGHRVYKNYDPRARIIKKIAFDVFEETGRNPLLDIAIELERIALEDDYFIQRKLYPNVDFYSGLIYQAMGFPTEMFPVLFAIGRTPGWLAQWIEHVKDPEQKIARPRQIYLGEKCRDYVPIDERPRKGDDEQKFGICRL

SEQ ID NO: 25257 - protein, 944 aa, Oryza sativa (japonica cultivar-group)
MAAPPKAWKAEYAKSGRSSCKSCRSPIGKDQLRLGKMMWNHASCILRIDTLRWDDQEKIRNYVGSAPATASSAAAISDKCTIEVAKSARTSCRRCGEKIKKGTVRVSSKLEGQGWYHASCFLEMSPAATVENFSGWEILSHEDKRAVLDLVKKDAPSSGQTSSKGSKRKNNQNDIHDCKAPKIIRSISEGTAEDKGKAVVSHDSNANSSDLQEKLKEQSDTLWKLKDELKKHVSTAELRNMLEANGQDTSGPERHLLDRCADGMLFGALGTCPVCSSFLYYHGGQYHCSGYVSEWSKCTYSTTEPVRSKKKWKIPDEMDNGYLTKWFKSQKAKKPERVLPPMSPEKSLCQSTQQNRSFLSEGLDKLRVSIVGQSKDVVDGWKQKLKDAGANFNATVTKDSSCLVLCSELESENAEVKKARRLKIPILREGYLGECIRKNRVLPFDLYKVEAALESSKGGTMTVKVKGRSAVHESSGLQDTGHILEDGKSIYNTTLNMSDLTREDNGSDCYVFRKWGRVGNEKIGGTKLEEMSKIHAIQEFRRLFLEKTGNPWEAWEQKTNFQKQPGKFYPLDIDYGVRQGPKRKDIDKMKSSLPPQLLELMNMLFNIETYRAAMLEFKINMSEMPLGKLSKENIQKGFEALTEIQNLLGNTNNQELAVRESLIVAASNRFFTLIPSIHPHIIQDEDDLMVKMYFLLPIVTLFRDPIDCNFGAMVQVKMLEALQDIEIASKLVGFDSDNDESLDDKYKKLRCAITPLPHDCEDYKLVEKYLLNTHAPTHKAYSTIQTIVSVFFCIGSRLTNYVGILSQGLRIAPPEAPVTGYMFGKGLYFADLVSKSAQYCYVDRKNPVGLMLLSEVALGDMYELKKATSMDKPPRGKHSTKGLGKTVPLESEFAKWRDDVVVPCGKPVPASIKTSELMYNEYIVYNTSQVKMQYLLKVRFHHKR

SEQ ID NO: 25258 - protein, 193 aa, Ashbya gossypii ATCC 10895
MDSLFNSTKTNPRGIPEAPFVERVEDFIKDPSEFELCFNKFQERLSKYKFMQESKLSTIAQLKAKIPDIENALAMCRLLKAKQTSEEPVLETNYQLNETLYTRAAIDASDDLHVGLWLGADVMLEYCVDEAIELLMQKLEDARRNLAISNEDVDFLRENITTMEVNCARLYNWDVEKRRALKQAQEGTENLKI

SEQ ID NO: 25259 - protein, 248 aa, Eschscholzia californica
  misc_feature (87)..(88): Xaa can be any naturally occurring amino acid
  unsure (1)..(248): unsure at all Xaa locations
STPSLWASEEPEKLLEFHERVPGARMHASFIRPGGVAQDLPLGSCRDIDSSTQQFASRIVESEEMSTGNRIWKQRLVDIGTVTAQQXXVCWDSRRAAPYDVHDQSDPDVPVGTRGDRYDRYCIRIEEMRQSVRIIVQCPNQMPSGMIKADDRKLCPPSRCRMKLSMESSIHHFEPYTEGFSVPAPSTYTAVEAPKGEFGVFLVSNGSNRPYRRKIRAPGSAHSQGLDSMSKHHMPADVVTIIGTQDIV

SEQ ID NO: 25260 - protein, 326 aa, Ashbya gossypii ATCC 10895
MAFQPGSRGGRGGARGGARGGARGGRGGFGGRGGSRGGRGGFDSRGGARGGFGGRGGSRGGPRGGPRGGARGGRGGARGGAKGGAKVVIEPHKHAGVFIARGKEDLLVTKNVAPGESVYGEKRISVEEPASEEGVPPTKVEYRVWNPFRSKLAAGIMGGLDELFIAPGKKVLYLGAASGTSVSHVADVVGPEGLVYAVEFSHRPGRELISMAKKRPNVIPIIEDARHPQKYRMLIGMVDAVFADVAQPDQARIIALNSHMFLKDQGGVVISIKANCIDSTVDAETVFAREVQKLREEKIKPLEQLTLEPYERDHCIVIGRYMRSGL

SEQ ID NO: 25261 - protein, 188 aa, Laurus nobilis
RAEPHIGSLHRGSEKLIEYKTTLQALPYSDRSDYVSTMAQEHAHSSAVERLLNCEVPLRAQYIRVLFREITRISNHSLASTTHAMDVGASTPFLWASEEREKLLEFHERVPGARMHASFIRPGGVAQDLPLGSCRDIDSSTQQFASRIDESEEMSTGNRIWKQRLVDIGTVTAQQAKDWGFSGVMLRG

SEQ ID NO: 25262 - protein, 363 aa, Piper betle
AAHGVSRSVLEMNGEVVERAEPHIGSLHRGTEKLIEYKTFLQALPYSDRSDYVSMMAQEHAHSSAVETLLNCEVPLRAQYIRVLFREITRISNHSLASTTHAMDVGASTPFLWAFEEREKLLEFHERVSGARMHASFIRPGGVAQDLPLGSCRDIDSSTQQFASRIDESEEMSTSNRIWKQRLVDIGTVTAQQAKDWGFSGVMLRGRGVCWDLRRAAPYDVHDQSDPDVPVGTRGDRYDRYCIRIEEMRQSVRIIVQCPNQMPSGMIKADDRKLCPPSRCRMKLSMESSIHHFEPYTEGFSVPAPSTYTAVEAPKGEFGVFLVSNGSNRPYRRKIRAPGSAHLQGLDSMSKHHMPADVVTIIG

SEQ ID NO: 25263 - protein, 210 aa, Pseudomonas putida KT2440
MKPFSPNDFAELVMVERKASVERNTLETQVKCSINLDGSGKARFDIGVPFLEHMLDQIARHGLIDLDIECKGDTHIDDHHTVEDVGITLGMAFAQAIGDKKGIFRYGHAYVPLDEALSRVVIDFSGRPGLQMHVPYTRASVGGFDVDLFQEFFQGFVNHALVTLHIDNLRGHNTHHQIETVFKAFGRALRMAITLDERMAGQMPSTKGCL

SEQ ID NO: 25264 - protein, 364 aa, Calycanthus floridus
AAHGVSRSVLEMNGEVVERAEPHIGSLHRGTEKLIEYKTYLQALPYSDRSDYVSTMAQEHAHSSAVERLLNCEVPLRAQYIRVLFREITRISNHSLASTTHAMDVGASTPSLWASEEREKLLEFHERVSGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMESSIHHFEPYTEGFSVPAPSTYTAVEAPKGEFGVFLVSNGSNRPYRRKIRAPGSAHSQGLDSMSKHHMPADVVTIIGT

SEQ ID NO: 25265 - protein, 1541 aa, Ustilago maydis 521
MTDSSSHAVDRHHSNLGLHNVAIPDSSLDPASSPDFPLAASGSTKQALPKKGFRVRVNSFGAAVMLNSKATSSSDPAPLAQQPKSSKFKMRARSATVNNLQMPTSHSVQADNFNPASSSCAPLSPTPHHHSPPPHSPQTRDPTLLSPAASKQSELSVTAESGNGFNRRKFFGRSNSIRSLLGGNSATSSNTTKAGSSHVSEPNPGTITTTTTTPTMGSGLLRRMSSKSFLNLNQPKTGAKAANNSSSDDLSSTTSVESHASRRFSDSLKGMRSRRGNSISKDTTKSRSLSSRSSSEARTARLTHKEILPPNSSRRSTDSTHSSLSVSSAEPHPPSSEADHSGNMAQPAREAQDSFTNAPRRLTGWLYNMVSSDNTPSSVEVGAPLSPVREADAIDFSPSSPTTHRQNPRILSHQTPAQSLAASSQVDASQPVSTTSSASTRSKAGALFQSLSNASPNRAVRMTNAATGDNNGSGSVPGTTSHTISSNHGGASSNSTSNATTGGANTGSWVPGGVNFDRAFKFFMDHDPSSKDDEGIWLLGVWHGPRQAGKVNSSEASVLPPDLSTSTSPCAPEMTASTTSNARNIDRPRASSPSSSLSASSPRQSPSELVHASLASLPPLHDRASIPTTRNESRVGSSISTAATASTSNSIRTKSSTTSFSVVNQASIPAAVDRQFAFQPDFASRIWCTYRNHFAPISRDGTISDQAASAAENMGVAQESVLQDTSASSTCSAVPSSSEATRSSSPPASTGRGWLGRKTAESNAAQDAALQANSPLGLGAALGAGYANASSTLGERMGITNLWSRATAAAQAAGFSRAGLTTDSGWGCMLRTGQSLLANALLNVHLGRSWLREAPPMRQMDFLEQLASLSLDSSVEMQSLQEWREKRARHAAYIKILSWFLDDPSPACPFGVHRMAREGKRLGKEVGEWFGPSTAAGAIKQLVTEFPDAGIAVELAHDGVFYLDEVRLAAGARSALQSGKGRQGDAAVTWRRPVVILIGIRLGLDSVNPIYYESVKETFSFPHSVGIAGGRPSSSYYFMGHQGNSLFYLDPHNVRPAVALRYPPSTFPTAVPHQLDVAHRFALEDKDDELEWWSHAYTEAQTSTFHCEKVRRMPIKSLDPSMLLGFLVKDEEDLMDLCTRIKGLPKTIFSFAESAPKWVDDDDFDPSMESISEPSVDEESEVDGEDKQDVQATHEGEPMQRTRASANAEDTSPASSKGTDARSSDKMFRESQQRTAAWLGQGQRLNSSREASHASSVSGGGIAFPSLDLLTPQSEGHTLQRPSRSDVRQVSTSSATTTRPARRALETVPAAGSKVGRELTVSQSTASPYTEQTPPWRSPGKLGTNESSSTVHLSDSEVGSGWEEVSDGGTIAPSGYAGASVLRTSSPFRVSLATKSPTTGVQGTADGGQVVDVAASDLIEGDLVSLDMNPPEEAQGGATHLLSHTSKSSATTDTVTASSASDSAATAQDESYFGLTSAHKPLALPRRRSQSKGSPIELATAVPTDDAPPVPVVPAAFLAELGQSKNKSNAAPDLNDSDDDF

SEQ ID NO: 25266 - protein, 155 aa, Asarum sp. Qiu 96018
YVSMMAQEHAHSSAVERLLNCFVPLRAQYIRVLFREITRISNHSLASTTHAMDVGASTPSLWASEEREKLLEFHERVSGARMHASFIRPGGVAQDLPLGLCRDIDSSTQQFASRIDESEEMSTGNRIWKQRLVDIGTVTAQQAKDWGFSGVMLRG

SEQ ID NO: 25267 - protein, 556 aa, Neisseria meningitidis MC58
MEKIWLDSYEKGVSAEIDITQYNSVSDVFRQSVEKFADQPAFQNMGKTLTYAETGKLATDFASYLQNVLKLPRGERVAIMLPNVLQYPVALFGILQAGLVAVNTNPLYTPRELEHQLKDSGATAIIVLENFANTLELVLPRTQIKHVIVASVGEMFGLLKGSLINFVIRKIKKMVPEYRIRETVSFQTALKEGAKHVFQPVALNREDTALLQYTGGTTGVAKGAVLSHGNICANMLQAKEWIKNQLREGKETVIAALPLYHIFALTVNLMIFANAGSKIILITNPRDMKGFIGELKKQRVNVFIGVNTLFNAMVNRPDFAEVDFSELRLTLGGGMATQKAVAEKWKKITGTPIVEAYGLTEASPGVCCNPLNIESYSGSIGLPVSSTEVELRDANGKEVPVGQPGELWVKGPQVMQGYWNRPEETAKAIDARGFLETGDIAVMDEKGWLKLVDRKKDLVVVSGFNVYPNEIEEVIAHHGKVMEVACIGVPDEKTGEALKVFVVKKDPSLTKEELIAFCRTELTAYKVPKNIEFRDELPKSNVGKILRRELRQSTGK

SEQ ID NO: 25268 - protein, 315 aa, Arabidopsis thaliana
MGRKRKHSETVTAAPVKDSAPERPQRTLLGWKDKKEDAENSKPAYASVFRNKEKVLVTCSRRINFRYRHLMLNMVSLLPHCKKDSKVEAKSSRGATLNELIELKGSSSCLFFECRKHKDLYMWMVKSPGGPSVKFLVNAVHTMEELKLTGNHLKGSRPLLTFSSNFENDAHWKLLKEMLTQIFGIPEGHRKSKPYHDHVFVFSIVDDHIWFRNYQISVPHNESDKIARGDLDKMTLIEVGPRFCLNPIKIFGGSFGGTTLYENPFYVSPNQIRALEKRNKAGKFAKKIKAKTRRKMHELSNPLEPDEFTDMWNDE

SEQ ID NO: 25269 - protein, 202 aa, Triticum aestivum
MEMEGNQIQTSPMGSAPSRSSPRQWSWGSALAGAVTTAAAAGVLVCRPRDPSFELISMNLSSFHFRPPAALDIGLTLTVHATNPNVVPVRYGASNVSILYGGTLLGTARLDAGQQPATSCRLLHLPARLDAMELAHHAGAILADTARRHMELDAVVEIAGEATVLLWSRRFSVRIDSHIIVDPVFLEVVEQDNRSEMQLYLT

SEQ ID NO: 25270 - protein, 216 aa, Crocosphaera watsonii WH 8501
MQTQNTPHTTSSAIISPFSDRTSTVTRTTKETDVQVSLNLDGQGNCTVETGVPFLDHMLHQISSHGLIDLEVKATGDIEIDDHHTNEDVGITLGQALGKALGDRKGIVRFGHFLAPLDEALIQVALDFSGRPHLSYGLQIPTERVGTYDTQLVREFFVAIVNHSQMTLHIKQLDGINSHHIIEATFKAFARSMRMALEIDPRRAHSIPSSKGVLMT

SEQ ID NO: 25271 - protein, 547 aa, Magnaporthe grisea 70-15
MSALKTTTNEKTSTGDKLRNFFKINNNRRRLPFGRSKTGHEAPQAKSTRADDSDGAQYTTHDDESQDANEPHSTPADSEAARRIRRVKSEPSQLGLIFGYLSGGRPATSGRGKEKTLLANKNASAVGLVGTSSSTPTPGPSSTGGGECVIPSAGGEIVVVPTPNAATPPHGGPKQKLVAYHRTYSSNSIKKGPVRVGPEDFEKLKLIGKGDVGKVYLVREKKRDKLFALKMLDKDEMIRRNKIKRTVTEQEILQVMNHPFIVSLHHSFQSQKYLYLCMEYCSGGEFFRALQSRPGKCISEEAARFYIAEVISALEYLHMNGLIYRDLKPENILLHESGHIMLSDFDLSKISGQDGMPTMIVGRNGTTTMLDTRSCLEGYRTNSFVGTEEYIAPEVIKGHGHSVAVDWWTVGILSFEMIYGVTPFKGKNRNATFANVMREDVHFPDDPELSPMGKSFIRKCLIKDENRRLGAIAGAAELKRHPWFRTTQWALLRHLTPPIIPDQGPDGNFRTLKDSQSVDIGGATRKVADDDPFSAFSSVTLHYGDDK

SEQ ID NO: 25272 - protein, 169 aa, Zea mays
  misc_feature (40)..(40): Xaa can be any naturally occurring amino acid
  misc_feature (47)..(47): Xaa can be any naturally occurring amino acid
  misc_feature (58)..(58): Xaa can be any naturally occurring amino acid
  misc_feature (72)..(72): Xaa can be any naturally occurring amino acid
  misc_feature (97)..(97): Xaa can be any naturally occurring amino acid
  misc_feature (111)..(111): Xaa can be any naturally occurring amino acid
  unsure (1)..(169): unsure at all Xaa locations
KKKKKKKTPSNPQAPLVQVGASLCLASRHGPSLAAVSVKXPVAIKGXRRQLPSSGRKXRRRQARRPRSIPQXPRACRAVVAQVRRSKSGLLLTLDDXIGNTHRTGWDLYGXSDAAVALHTRYRASYFETFAAPFTKRGLLLKFLLLGGGSLLAYGSAMATPDLLPIKKG

SEQ ID NO: 25273 - protein, 322 aa, Phyllostachys pubescens
MASTLSFPVIDMGLLGGDERPAAMELLRDACENWGFFEILNHGISKELMDEVEKMTKGHYKMVREQRFLEFASKTLKDGCDAQGVKAENLDWESTFFVRHLPESNITEIPDLDDDYRRVMKRFAAELEKLAEGLLDLLCENLGLEKGYLARAFRGSKGAPTFGTKVSSYPPCPRPDLVKGLRAHTDAGGIILLFQDDHVSGLQLLKDGEWVDVPPMRHSIVVNLGDQLEVITNGRYKSVLHRVVAQTDGNRMSIASFYNPGSDAVIFPAPALVEEEAGGTYPKFVFEDYMNLYVRHKFEDKEPRFEAFKSMERESSKRIAIA

SEQ ID NO: 25274 - protein, 257 aa, Triticum aestivum
MAANFWASSHSKQLLDPEDVDVVPAADRERGITTEEFRLVKIHMSSHIWRLAQQVKVRQRVIATAITYFRRVYTRKSMSEYDPRLVAPACLYLASKVEESTVQARLLVFYIKKMCGSDDKYRFEIKDILEMEMKLLEALDYYLVVYHPYRPLLHLLQDAGVTDLTQFAWGLVNDTYKMDLILVQPPYMIALACIYIASVLKDKDTTSWFEELHVDMNIVKNISMEILDFYETYKVDPQRGLSDEKISPIMNKLPAKA

SEQ ID NO: 25275 - protein, 375 aa, Rhodopirellula baltica SH 1
MSFTRPPHAHLVPVRPMNSSIVLLPGDGIGPEIVEQARLVLVKVAERFGHTFDFSSHQIGGIAIDETGDPLPQPTIDACRNAAAILLGAVGGPKWDDPSAKTRPEAGLLKIRKELGLFANLRPIKLFDELADASPLRADIVKGTDILFFRELTGGIYFGESGTSGSGEEETAFQSMTYSVGEVKRIVRMAAQAARGRSNRLTSVDKANVLEPSRLWRRVAAEVMANEFPDVQYDVVLVDSMAMHLINRPSEFDVVVTGNMFGDILTDEASMLPGSLGMLPSASLGDGGPGLYEPIHGSAPDIAGKSVANPLATILAAAMMLRHSLGLTDEAEAIEKAVAGVITDGLRTPDLARGDQSKSVSTEEMGAAVVAKLAS

SEQ ID NO: 25276 - protein, 423 aa, Thermus sp. Z-1
MTENAEKFLWGVATSAYQIEGATQEDGRGPSIWDAFAQRPGAIRDGSTGEPACDHYRRYEEDIALMQSLGVGAYRFSVAWPRILPEGRGRINPKGLAFYDRLVDRLLASGITPFLTLYHWDLPLAQEERGGWRSRETAFAFAEYAEAVARALADRLPFFATLNEPWCSAFLGHWTGEHAPGLRNLEAALRAAHHLLLGHGLAVEALRAAGAKRVGIVLNFAPRYGEDPEAVDVADRYHNRFFLDPILGKGYPESPFRDPPPVPILSRDLELVARPLDFLGVNYYAPVRVAPGTGTLPVRYLPPEGPATAMGWEVYPEGLYHLLKRLGREVPWPLYVTENGAAYPDLWTGEAVVEDPERVAYLEAHVEGRLRAREEGVDLRGYFVWSLMDNFEWAFGYTRRFGLYYVDFPSQRRIPKRSALWYQ

SEQ ID NO: 25277 - protein, 476 aa, Cyanidioschyzon merolae
MTAKVESKVREEEKGSNPSTAAADDSGAVIPTLKPRPKPAVEPLEREGVEFDPQRGLVFEKTRSSKWMSEKELNELPLLQRINWLSTSIIFTPLIGTLIGIWFVPLQRKTLVLAIVTYFCCGLGITGGYHRLWSHRSYEAHWLVQVILACFGAAAFEGSARYWCRLHRAHHRYVDSDRDPYAVEKGFWYAHLWWMVFKLPRQRQGRVDITDLNANPILRFQHRYYLQIAILFSFVIPLTISTLGWGDFWGGLVYACLGRMLFVQQSTFCVNSLAHWWGEQTFSRRHTSYDSVITALVTLGEGYHNFHHEFPHDYRNGVVWYHWDPTKWVIRLLSWAGLAWHLVRFPRNELVKARLQVRQEILDEAKKRVDWGKPIESLPVWTWKDVQRLAKEENRLLVVIEGIVHDCTRFKVQHPGGQRILEFWNVRDATQAFNGDVYNHTKAARNLLAHLRVAQLKEIYEPECDESTTEMSTKSS

SEQ ID NO: 25278 - protein, 194 aa, Philodendron hederaceum var. oxycardium
NGEVVERAEPHIGSLHRGTEKLIEYKTYLQALPYSDRSDYVSTMAQEHAHSSAVERLLNCEVPLRAQYIRVLFREITRISNHSLASTTHAMDVGASTPFLWASEEREKLLEFYERVPGARMHASFIRPGGVAQDLPLGLCRDIDSSTQQFASRIDELEEMSTGNRIWKQRLVDIGTVTAQQAKDWGFSGVMLRG

SEQ ID NO: 25279 - protein, 255 aa, Mycobacterium sp. MCS
MTQKNPFDLTGRTALVTGGNQGLGRAFAFGLAQAGATVAISGRSAERNAKVVEEAAAEGFALHPITADITRRDDVDRMTAEAISALGHLDILVNNAGTCYHAESWDVTEEQWDSVFDLNVKALWACSLAAGAHMRERGSGSIVNIGSMSGLIVNRPQMQPAYNASKAAVHHLTKSLAAEWGPLGIRVNALAPGYCKTEMAPVDKPEFKQHWIDDTPMLRYAMPEEIAPSVVFLASDAASFITGSVLVADGGYTAW

SEQ ID NO: 25280 - protein, 244 aa, Corynebacterium glutamicum
DHQQAIGTVQKLAFALPKEYFEKVDVAVTVPFTDIRSVQTLVEGDKLEVTFGAQDVSQHESGAYTGEVSASMLAKLNCSWVVVGHSERREYHNESDELVAAKAKAALSNGISPIVCVGEPLEIREAGTHVEYVVEQTRKSLAGLDAAELANTVIAYEPVWAIGTGKVASAADAQEVCKAIRGLIVELAGDEVAEGLRILYGGSVKAETVAEIVGQPDVDGGLVGGASLDGEAFAKLAANAASVA

SEQ ID NO: 25281 - protein, 341 aa, Mycobacterium sp. MCS
MTETVDGTMRASVMTGVGTLRIEERPVPSPGPHEVLVEVAAVGVCGSDVHYYRHGRIGDFVVEEPMILGHELSGRIAAVGEGVDPGRVGERVAVEPQHPCRRCRQCKSGRYNLCPEMKFYATPPIDGAFCRYVVIDDDFAHPVPESMSDDAAALLEPLSVAIATMRKAGVVPGSSILIAGAGPIGVICAQAARAFGAARIVVTDLVPSRREMALKFGATEVLDPAAVDVSAIEPVDAFVDATGVPAAVVSGIKAVGPAGRVVLVGMGADEYALPVSHIANLEITVTGVFRYTDTWSAAIHLVNSGAVDLDAMVTGRYDLEHVADALDSDTDPASLKSIVNP

SEQ ID NO: 25282 - protein, 288 aa, Eichhornia crassipes
AAHGVSRSVLEMNGEVVERAEPHIGSLHRGTEKLIEYKTYLQALPYSDRSDYVSTMAQEHAHSSAVERLLNCEVPLRAQYIRVLFREITRISNHSLASTTHAMDVGASTPFLWAFEEREKLLEFYERVPGARMHASFIRPGGVAQDLPLGLCRDIDSSTQQFASRIDELEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRGRMKLSMES

SEQ ID NO: 25283 - protein, 444 aa, Kluyveromyces lactis NRRL Y-1140
MSTDKTQVKLRFFTREEDETLHVNDAPIYAPVSLKRYGLSEIVNHLLELPKSMPFDFLIDGELLRTSLQDYLIKKGLSSETFLNVEYTRAVLPPSYLSSFDNEDWVSSLDVGSNYIYSGSYDGIVRTYNLSGKVEKQYSGHSGPIRAVHYISSTRLVSAGNDRTLRLWKTKNDDLKSIDEEEIEDGKTLAILEGHKAPVVSIDVSKDRILSASCDNTVSLWSTNYKEMTVIDPMEDLGGNVSTAAKKRRKLTLKDGSIRRRAPLALFESHSAPVEAVIFDKSDDTVGYSVSQDHTIKTWDLITAKCVDTKTTSYSLLSVAQLPKLNLLACGSSARHITLHDPRVNSSSKITQQQLVGHKNFVVALDTCPENEYMICSASHDGTVKVWDVRSNTAMYTITREDKNVVKGVNDKVFAVKWAKGVGIISGGQDKKIQINKGDNIFSN

SEQ ID NO: 25284 - protein, 287 aa, Liriodendron tulipifera
AHGVSRSVLEMNGEVVERAEPHIGSLHRGTEKLIEYKSFLQALPYSDRSDYVSTMAQEHAHSSAVERLLNCEVPLRAQYIRVLFREITRISNHSLASTTHAMDVGASTPFLWASEEREKLLEFHERVPGARMHASFIRPGGVAQDLPLGSCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 25285 - protein, 214 aa, Mycobacterium sp. MCS
MRVGPEDAGLTALAGEVLAREADAVSALAGTVEGGVVAVARRLLDVTGKVVTTGSGTSGIMAERLAHLLSVCGTPAVYLPAMDALHGGMGAVTAHDLVLAISKTGRSAELTRLTERLVDRGVDVVAITEDAQSPFALAATQVQALPRTPGDADPGGMIALASTLVVGAWGDALAVVSMALRGHTLHDVVHSHPAGGVGARGHRPGDESAPVVRT

SEQ ID NO: 25286 - protein, 488 aa, Oryza sativa
DSFPLSPRLASRGHHHHHHHHPPPLLPDPRSDPAAMASTAARRLRELQGQAGNKTCVDCAQRNPQWASVSYGVFMCLECSGKHRGLGVHISFVRSVTMDSWTEAQLRKMEAGGNDRLNAFLAARGVPKETPHVAKYNSNAAAAYRDRIVAVAEGRPWTDPPVVKETPGSGAPAPTRKPPLPAGGGGGGGGGWDDWDDDFRPDMRRNQSVGSFGESGAESGRQPPRSKSTQDMYTRQQLEASAANKDSFFARRMAENESKPEGIPPSQGGKYVGFGSSPAPSANRNGAAAQGDVMQVVSQGIGRLSLVAASAAQSAASVVQVGTKEFQSKMREGGYDQKVNETVNVVANKTAEIGSRTWGIMKGVMALASQKVEEYAKEGGNGWGDDWQRREQGSEPYHRFERETNGNGWNSSSHDGSSKNYNSNSWDDWDEPVKKDEPAKERQSSDSWAGWDDGKDDNFDSYNHSTPSKGSNQNGTTGGSYWTEGGFR

SEQ ID NO: 25287 - protein, 532 aa, Mesoplasma florum L1
MNVKKPVILAILDGWGIEEAGVGNAVANADQKFVKEMMGMYPWVKAHASGEWVGLPEGQMGNSEVGHIHLGAGRINMESLAKLNHEVKVDGFLTNEVLVDTFKYVKEHNSALHLMGLFSDGGVHSHMNHMISMYKAAVKFGLTNIKFDLITDGRDTAPKVAEQYINQLLQVIKDNNNIGEIASISGRYFAMDRDKRFERSAAAYITMTERKVDQPKFTDPIEYVKAAYENGLDDEMIVPAYNASVVDSELKANDAMIFTNFRPDRAIQMASIMTNNNYPAWNDEAFKDVEFIGDKIRFVSTMKYADSVTSQFIAYPPTPLTNTLGEYISSLGLKQLRIAETEKIAHVTFFFDGGNDYFKNGLAKPEEISLPHASIDLISSPKVATYDLKPEMSAVEITDKLLEEVKKDEFDLIVLNFANCDMVGHTGNNDATVKGVKVLDEQLKRIHDEFVLKHNGVMVITADHGNAEIMIDETGGPNKKHTTSLVPIIVTDKTIELSDFDPAIAKVAPTILDIMGLEIPKEMTQPSMIIKK

SEQ ID NO: 25288 - protein, 176 aa, Triticum aestivum
  misc_feature (5)..(5): Xaa can be any naturally occurring amino acid
  misc_feature (11)..(11): Xaa can be any naturally occurring amino acid
  misc_feature (25)..(25): Xaa can be any naturally occurring amino acid
  unsure (1)..(176): unsure at all Xaa locations
KGEEXEQEDEXLRRWKEQLLGPDAXHTTNLLALALGAETVEPEVTILNLTILAPGRPDLVLPIPFVPDDKGHAFALKDGTAYSFRFSFTVSNNIVSGLKYSHTVWKTRVKVENQKVMLGTFSPQQEPYTYKAEEDSTPSGIFARGSYSARLKFVDDDGKVYLDMKYSFEIRKDWPA

SEQ ID NO: 25289 - protein, 511 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYDNGIYDEFVLPSVITKEDGSPVATIQDEDAVIFYNFRPDRAIQISNTFANEDFRSFDRGEKHPKHLHFVCLTHFSETVDGYVAFKPINLDNTLGEVLSQNNLKQLRIAETEKYPHVTFFMSGGREAEFPGETRILIDSPKVATYDLKPEMSAYEVTDALLAEIEGDKQDAILLNFANPDMVGHSGMLEPTVKAIETVDECLGKIVDAILAKGGTAIITADHGNADEVITLEGNPMTAHTTNPVPVIVTKQGLELREDGILGDLAPTMLTLFLDVAQPKEMTGKTLIK

SEQ ID NO: 25290 - protein, 220 aa, Spinacia oleracea
SISSSFVRHVRISSEFEQEEDVMGDDDAGRQPNFSPDLKIFVGNLPFNVDSAELAGLFGAAGTVEMVEVIYDKLTGRSRGFGFVTMSSVEEVEAAAQQFNNYELDGRTLRVTEDSHKDMTLPRVESECDSFGSSNRVHVGNLSWKVDDDALKTLFSETGDVVEAKVIYDRDTGRSRGFGFVTYNSANEVNTAIESLDGVDLNGRSIRVTAAEARQRRGPK

SEQ ID NO: 25291 - protein, 313 aa, marine gamma proteobacterium HTCC2143
MTNVPTIDLNCIDNDALQALDLACRDHGFFFLKGHGLDALVEAVKTQAECFFALPRDEKQKVVRKEDNPMGYYDRELTKQKRDLKEVFDFYARSNGQENRMPWPQQPTEFKETLRAYFLANAELSNRVMHILCNALGVDETSFDRFFMPRHTSSARLNYYPSEDPLAADDQQSVTPLGDMALHHHTDQGAITLLFQDDIGGLQAFSKDAGWIDIPPMEDALVVNIGDIAQVWSNGAYQAALHRVLPIAAGKSRYSLPFFYQPSFDTVVAPHQDLGAPNYRSFNCGDFIQGRIDDNYEDLGADDIQVERFRINA

SEQ ID NO: 25292 - protein, 592 aa, Magnaporthe grisea 70-15
MTTVVERTPEGVIYRAAKPFPVPDLDILSLLFDSKHSAATPESVIHVSADDPSLQLNVSRARTLTHATSAALRRHFSIGAGGPGRDIVSVVSLGHYLLPVLCYGIIGAGGVLSAAAAASTPSELARQLSSSESKILCCVEALKDVAVKAVEEAGWGRGGGGRVLIMGEGKEWTLKVVQGDGSLGRNLINENDLLPWQAITDRKTLEDSFVIMIYSSGTTGLPKGVKLSHRNLVAQTVIPGDLLRQSWGGSQPKWDYRTLAHLPMAHIAGIQGYLINPFYVNGTVYWMPRFDWPKFLQYNKQYKITIFFTAPPIYLMITKSPDVKDHFASLVRAISGAAPLGKELQHAASRKLGTGQNVFISQTWGLSETCGSATLMPPGIDDDTGSVSALMPNMEARIVDDEDRDVEPGQPGEVLLRGPVVCNGYYKNEAADRESFTKAADGGRWFRTGDVAHVRDGLIYIIDRKKELIKYKGLQVAPAELEALLLTHPAVLDAAVIGVPAVEGDETSEVPRAYVVADRKKIDAEAIKDFVKRNAANHKQLRGGVVFVDAIPKSPAGKILRRDLRAMATRGQTLDEIDVAMIRGLLRQPTSG

SEQ ID NO: 25293 - protein, 174 aa, Triticum aestivum
RSFQASAPDPHKYGLSAKGNLYFTLFKLKYRKHQYFVTSYWPGGLYGTPGLSGSRTGVYIASAWISMMKLGTKGYRENAKLLRDTTVFMAKELRALGFEVFGEPNICIISFRHKKYSVNKVQKFMKNRGWGLALLQKPLSIHFSFTPLNCLKRDEMLKDLKECVEFLEKNSSSQ

SEQ ID NO: 25294 - protein, 769 aa, Oryza sativa (indica cultivar-group)
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGQPLLGAKVVAAMLMFATVAGILMALFLNTAGGAWDNAKKYIETGALGGKGSESHKAAVTGDTGKQIRKYGFRK

SEQ ID NO: 25295 - protein, 286 aa, Pseudomonas syringae pv. phaseolicola 1448A
MSDYQETLYEGYGQRFRMEKMLHEVRTEHQHLVIFQNPRMGRVMALDGVIQTTEADEFIYHEMLTHVPILAHGAAKRVLIIGGGDGGMLREVAKHLTVEHITMVEIDATVVEMCKEFLPNHSSGAFDDSRLNLVIDDGMRFVATTEEKFDVIISDSTDPIGPGEVLFSENFYQACHRCLNEGGILVTQNGTPFMQLSGVQTTAGRMNGLFADWHFYQAAIPTYIGGAMTFAWGATDKSYRKLPLETLRQRFTGSGIVTRYYNPEVHISAFALPQYVLQAVSKASND

SEQ ID NO: 25296 - protein, 300 aa, Ashbya gossypii ATCC 10895
MTENRKTVKLFLLRHGESELNHAKIFCGWIDAHLTDKGKDQARSSASLIASFCREHGIEPPLVGYTSRLLRTIETMQVIMKELRRAAVFQTVVDTADALAVVDKVTAAGQTPVLQVWTLNERHYGSWQGQRKSSVLEQFGKSDYMLIRRDYNGRPPAVDLGREMIQEDNEQGPLTGYDFKEPNRRLKYGPELEKAIELPRNESLADVIKRLAPFLNEVVLKLLHELGESAIIVAHGSTVRSVLKILANISEEDIKDIDIPTGNPLVIELNASDMSFVRHFYLDPESARKEAENVRNEGCN

SEQ ID NO: 25297 - protein, 120 aa, Triticum aestivum
ATYHYYRPAQNNWDLGAPAVSAYCATWDASKPLSWRSKYGWTAFCGPAGAHGQAACGKCLRVTNPATGAQITARIVDQCANGGLDLDWDTVFTKIDTNGIGYQQGHLNVNYQFVDCRDNN

SEQ ID NO: 25298 - protein, 128 aa, Pseudomonas syringae pv. phaseolicola 1448A
MTITRYGAGSTAGGGQPRPFARAVEADGWLHVSGQVPAQDGEIIVGGIVEQTHQTMRNLIAILDEAGYALEDVVRVGVWLEDPRDFWSFNKVFGEYFSPEHAPARACVQASMMVDCKVEIDCIAYRRK

SEQ ID NO: 25299 - protein, 569 aa, Ashbya gossypii ATCC 10895
MSDAVERHTFKVFTQDFMVDKRFQLIKEIGYGAYGIVCSARFMESVEDTTVAIKKVTNVFSKALLCKRSLRELKLLRHFRGHKNITCLYDMDIVLLPDGSFNGLDLYEELMEWDMHQIIKSGQPLTDAHYQSFVYQILCGLKYIHSADVLHRDLKPGNLLVNADCQLKICDFGLARGYSENPIENDQFLTEYVATRWYRAPEIMLSYQGYTRAIDVWSCGCVLAELLGGRPIFKGKDYVDQLNRILQVLGTPPEETLKRIGSKNVQDYIHQLGYIPKVPFERLYPNANPDAADLLERMLALDPKTRITVDEALEHPYLSIWHDPSDEPVCCKKFDFSFESVNEMEELKRMVIEEVKDFRRFVRQPNIRDTSLQEQEEQQPQQPQQPQQPQPEQPQHQRQHQQAQAQAQAQAHEQQQQHHRTQYQRSGAVQRQPQTVEHGQHLQHRSGHHSEHLQRAHGQQEQYLPKKDDSRAFQSRPVGTSISDSRSSYEEHDYVQQMMFAHSPTLAHDSFIGIHSENLPEHNTDFPPRPQENMLASPMGFSDGTHSNAEFGDFLDLEKELEFGLDRKI

SEQ ID NO: 25300 - protein, 356 aa, Phanerochaete chrysosporium
LVIDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNAPAFYVAIQAVLSLYASGRTTGIVLDSGDGVSHTVPIYEGFALPHAILRLDLAGRDLTDLLVKNLMERGYPFNTTAEREIVRDIKEKLCYVALDFEQELQTAAHSSAIEKSYELPDGQVITIGNERFRAPEALFQPAFLGLEAAGIHETTYNSIYKCDLDIRRDLYGNIVLSGGTTMFPGIADRMQKELTALAPSSMKVKIVAPPERKYSVWIGGSILASLSTFQNLWCSKQEYD

SEQ ID NO: 25301 - protein, 275 aa, Mesoplasma florum L1
MLLSFLFHWFSYCYIIKNVQKNKRRNIMRQKVIFGNWKMNGTNAELVTFLKKVDKAAKKSDVVAGLGLPFTLLSKGIEKAKNVKVAAQNVHFAEKGAFTGEVSISMLQEVGVQYVIIGHSERREMFAETDETVNKKATALLAAGITPIICCGETLETKEAKKTVTFVNAQIKKAYKGISAEDALKTIIAYEPIWAIGTGKTATSEDAEKVCEAIRKNLTKIYDEKTAQQITIQYGGSVNPSNIAELMSQPNIDGALVGGASLKADDFIALINYKK

SEQ ID NO: 25302 - protein, 282 aa, Mahonia bealei
RSVLEMNGEVVERAEPHIGSLHRGTEKLIEYKTYLQALPYSDRSDYVSTMAQEHAHSSAVERLLNCEVPLRAQYIRVSFREITRISNHSLASTTHAMDVGASTPSLWASEEREKLLEFHERVPGARMHASFIRPGGVAQDLPLGLCRDIDSSTQQFASRIDESEEMSTGNRIWKQRLVDIGTVTAQQAKDWGFSGVMLRGRGVCWDSRRAAPYDVHDQSDPDVPVGTRGDRYDRYCIRIEEMRQSVRIIVQCPNQMPSGMIKADDRKLCPPSRCRMKLSMES

SEQ ID NO: 25303 - protein, 287 aa, Saccharum hybrid cultivar H65-7052
IERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPADMPLEDGWGAAPASNNHK

SEQ ID NO: 25304 - protein, 320 aa, Triticum aestivum
LRQALHLKSPAKPDAVLAFLAGLGLSGADVAAVVARDPQILCAKVETTLSPIVAGLTGLGLSNAEIARLVSLAPAHFRCRSVVSKLEYYLPLFGPIDNLLRPLKHVLRSDLERVVKPNVKLLAECGLSACEIARLFIGAPRMFTAKPGRVLAMVACAEGIGVPRGSGMFRQALHAVSYISEDKIAAKVDYLKKTFRWSDAEVGIAVSKGPFILARSKDMLKRRSDFLISEVGLQPAYIAHCPAMLTYSLEGRLRPRYYVVKFLKENGLLEHGRGYYTTLVKTEKVFMEKFICPHKEAAPHLAEDYAAACKGEVPARFRFT

SEQ ID NO: 25305 - protein, 142 aa, Prochlorococcus marinus str. AS9601
MNNEINPIEEDFNAALSRYKAGQDLIPIVQDFQKIIHQIPNHFAAWTCLSWLQLLLKNNEEALSAARQAVRLNQQDPQARMNLSLALLATNNKGVRDHIELIKKMSMMMPDVKSELKESVEDGLSRYPDWPELTKVKKWLEF

SEQ ID NO: 25306 - protein, 518 aa, Saccharum hybrid cultivar H65-7052
MAGGGMAALGVKTERAAQYKGRMTLAVAMTCLVAAVGGAIFGYDIGISGGVTSMDPFLEKFFPVVFHRKNSGGKNNYCKYDNQGLAAFTSSLYLAGLVASLVASPVTRNYGRKASIVCGGVSFLIGAALNVAAVNLAMLILGRIMLGVGIGFGNQAVPLYLSEMAPAHLRGGLNIMFQLATTLGIFTANLINYGTQNIKPWGWRLSLGLAAAPALLMTLAGLFLPETPNSLIERGRVEEGRRVLERIRGTADVDAEFTDMVEASELANTIEHPFRNILEPRNRPQLVMAVCMPAFQILTGINSILFYAPVLFQSMGFGGNASLYSSVLTGAVLFSSTLISIGTVDRLGRRKLLISGGIQMIVCQVIVAVILGAKFGADKQLSRSYSIAVVVVICLFVLAFGWSWGPLGWTVPSEIFPLETRSAGQSITVAVNLLFTFAIAQAFLSLLCAFKFGIFLFFAGWITVMTVFVCVFLPETKGVPIEEMVLLWRKHWFWKKVMPVDMPLEDGWGAAPASNNHK

SEQ ID NO: 25307 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 25308 - protein, 436 aa, Thermus nonproteolyticus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARALADRVPFFATLNEPWCSAFLGHWTGEHAPGLRNLEAALRAAHHLLLGHGLAVEALRAAGARRVGIVLNFAPAYGEDPEAVDVADRYHNRYFLDPILGRGYPESPFQDPPPAPILSRDLEAIARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQTGGSAH

SEQ ID NO: 25309 - protein, 416 aa, Gibberella zeae PH-1
MGDLQGRKVFKVFNQDFVVDERYTVTKELGQGAYGIVCAAVNNQTNEGVAIKKVTNVFSKKILAKRALREIKLLQHFRGHRNITCLYDMDIPRPDNFNETYLYEELMECDLAAIIRSGQPLTDAHFQSFIYQILCGLKYIHSANVLHRDLKPGNLLVNADCELKICDFGLARGFSVDPEENAGYMTEYVATRWYRAPEIMLSFQSYTKAIDVWSVGCILAELLGGRPFFKGRDYVDQLNQILHILGTPNEETLSRIGSPRAQEYVRNLPFMPKKPFPSLFPQANPDALDLLDKMLAFDPSSRISVEQALEHPYLQIWHDASDEPDCPTTFNFDFEVVEDVGQMRGMILDEVQRFRQNVRTVPGQSGGGLQGQGVPVPLPQGNGQWTAEDPRPQEYAGHGNTGLEQDLQGGLDASRR

SEQ ID NO: 25310 - protein, 461 aa, Mycobacterium sp. MCS
MSHPGATPTDRHKVVIIGSGFGGLSAAKTLKRADVDIKLIARTTHHLFQPLLYQVATGIISEGEIAPATRVVLRKQKNVQVLLGDVTHVDLQNRLVHSELLGHDYATPYDSLVIAAGAGQSYFGNDHFAEWAPGMKSIDDALELRGRILGAFEQAERSSDPKRREKLLTFVVVGAGPTGVEMAGQIAELADYTLKGTFRHIDPTSARVILLDAAPAVLPPMGEKLGKKAAARLEKMGVEIQLNAMVTDVDRNGITVKDPDGKLRRIESACKVWSAGVSASPLGRDLANQCDVEVDRAGRVKVLPDLSIPGHPNVFVVGDMAAVEGVPGQAQGAIQGARYAAKLIKNEVKGANPAFRQPFEYFDKGSMATVSRFSAVAKVGPLEFGGFIAWLAWLALHLVYLVGFKTKIVTLISWTVTFLSTKRGQLTITEQQAYARTRIEELEEIAAAVTDTEREREQAAS

SEQ ID NO: 25311 - protein, 405 aa, Oryza sativa
  misc_feature (374)..(374): Xaa can be any naturally occurring amino acid
  unsure (1)..(405): unsure at all Xaa locations
MAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQWEALALLLIGISVNQLKSLPEGSSTLGLPVAAGAYLYTLFFVTVPALASVYNEKALKSQFDTSIYLQNLFLYGYGAIFNFLGLVITAIIQGPSSFNILEGHSKATIFLICNNAAQGILSSFFFKYADTARGKYSSTIATIFTGVASAVLFGHTLTINFVLAISIVIISMHQYLSNQIKDEVPSSKIEMGDAHEHRSKESVVVNVSDSIATEAKHRXTLPTDTIQLGSTPRRSSIHLTNTVLIREVES

SEQ ID NO: 25312 - protein, 480 aa, Oryza sativa
MPSHQPVAGMQAIDPDYVKQPSSMASTSEPNRNPKYDPKKPHITDLPITRSNWYKHVNWLNVIFIIGMPLAGCIAAFWTPLQWKTAVWAVVYYFWTGLGITAGYHRLWAHKSYNASLPLRIFLAAVGAGAVEDSIRWRSRDHRAHHRYTDTNKDPYSVRKGLLYSHLGWMVMKQNPKRIGRTDITDLNEDPVVVWQHKNYIKSVVFMGLVSPTLVSGLFWGDWMGGYIYAGILRIFFVQQATFCVNSLAHWLGEQPFDDRNSPRDHVITALVTLGEGYHNFHHEFPSDYRNAIEWHQYDPTKWSIWLWSKLGLASNLKQFRSNEIEKGRVQQLQKKIDQKRAKLDWGVPLDQLPVIEWDDYVEQAKNGRGLIAVAGVVHDVTDFINEHPGGKTLIKSGIGKDATAMFNGGVYFHSNAGHNLLSTMRVGVIRGGCEVEIWKRAQRENKDVGLVKDNQGNPIIRAGNQITKVAQPIESASAA

SEQ ID NO: 25313 - protein, 230 aa, Mycobacterium sp. MCS
MPPHFLSADSTGQPHRHADRPKRVRTPGEPLRIGVGGPVGSGKTALVAALCRQLRDELSLAVLTNDIYTTEDADFLRRHAVLPDDRIAAVQTGGCPHTAIRDDITANLDAIDDLVAGHDHLDLILVESGGDNLTATFSSGLVDVQIFVVDVAGGDKVPRKGGPGVTFSDLLVINKTDLAPMVGADLDVMRRDSTKVRGERPFVLISLTADPTAGPVLDWVRAQLRVPVQG

SEQ ID NO: 25314 - protein, 561 aa, Schizosaccharomyces pombe
VNELLEAVKKEFEDICQKTKTVEAQKDDFEYKAMISAQINEMALMKQTVMDLEMQQSKVKDRYEEEITSLKAQLEARRKEIASGVVPQSSKTKHGRNSVSFGKYGNAGPFNSDNSSKPLILNNGSSGGTPKNLRSPAIDSDGTVLAPIQTSNVDLGSQYYSSPHVRPAVGATMAGSAMRTFPSNLPLGHPPPPSDSANSSVTPIAAPLVVNGKVSGNPPYPAEIIPTSNVPNREEKDWTVTSNVPNKEPPISVQLLHTLEHTSVICYVRFSADGKFLATGCNRAAMVFNVETGKLITLLQEESSKREGDLYVRSVAFSPDGKYLATGVEDQQIRIWDIAQKRVYRLLTGHEQEIYSLDFSKDGKTLVSGSGDRTVCLWDVEAGEQKLILHTDDGVTTVMFSPDGQFIAAGSLDKVIRIWTSSGTLVEQLHGHEESVYSVAFSPDGKYLVSGSLDNTIKLWELQCVSNVAPSMYKEGGICKQTFTGHKDFILSVTVSPDGKWIISGSKDRTIQFWSPDSPHSQLTLQGHNNSVISVAVSPNGHCFATGSGDLRARIWSYEDL

SEQ ID NO: 25315 - protein, 556 aa, Streptococcus thermophilus LMG 18311
MKTDIEIAQSVELKPITEVVEKVGIGFDDLELYGKYKAKLSFDKINEVKDDKPGKLILVTAINPTPAGEGKSTISIGLADALNKIGKKTMIALREPSLGPVMGIKGGAAGGGYAQVLPMEDINLHFTGDMHAITTANNALSALLDNHIHQGNALGIDQRRIIWKRVVDLNDRALRHVTVGLGGPLNGIPREDGFDITVASEIMAILCLATDINDLKERLANIVVAYRYDRTPVYVRDLEIEGALTLILKDAIKPNLVQTIYGTPALVHGGPFANIAHGCNSVLATSTALRLADYTVTEAGFGADLGAEKFLDIKTPNLPTTPDAVVIVATLRALKMHGGVAKTDLSEENVQAVRDGFSNLKRHVENIRKFGIPVVVAINEFVADTEAEIAALKELCSEIKVPVELASVWANGADGGIDLANTVVDVVENGNADYKRLYSDDDSLEEKITKIVTEIYGGKSVVFEKKAKNQLKQFAEFGWDKLPVCMAKTQYSFSDNQFLLGAPEGFDITIREFVPKTGAGFIVALTGDVMTMPGLPKAPAALKMDVTEDGTAVGLF

SEQ ID NO: 25316 - protein, 165 aa, Triticum aestivum
  misc_feature (23)..(23): Xaa can be any naturally occurring amino acid
  unsure (1)..(165): unsure at all Xaa locations
IEYIPLLASQLGVGFLITAGGTXHAMLEDKVFSIREAAANNLSRLAEEFGPEWAMQHIIPQVLEKISNPHYLYRMTILQAISLLAPVMGAEITCQKLLPVVINSSKDRVPNIKFNVAKVLQSLVPILDQSTVKPCLVELSEDPDVDVRYYANQALQACDQIMMSS

SEQ ID NO: 25317 - protein, 341 aa, Oryza sativa (japonica cultivar-group)
MGGDLYALDFDGVLCDSCGESSLSAVKVTPRASSSFRPVSWMGPSVRALMMAALVRQAAKVRWPWVFEQVDAAMEEWIVEQMYTLRPVVETGYENLLLVRLLIEIRIPSARRSSLYQMFMPRLYCKVADGLSIQEILENWLKLKPTIMSEWNEDRDSLVDLFGSIRDDWIENDLSGWIGANRFYPGTADALKFSSSEVYIVTTKQGRFAEALLKELAGIEFPSERIYGLGTGLSKGKSSPATAANATASRPDTSDEGCELGGGGAVAGASSVDEEVRPLGFTSFVEDRLATLKNVIKEPALDQWNLYLVNWGYNTPKEREDAEGISRIQVIDLPGFSQKLK

SEQ ID NO: 25318 - protein, 150 aa, Lactobacillus delbrueckii subsp. lactis
  misc_feature (137)..(137): Xaa can be any naturally occurring amino acid
  unsure (1)..(150): unsure at all Xaa locations
NREIYNFKPLREELIKAGHTFSTKADTEVILHGYEEWGMDGILKRVRGMFAFIIWDDNTQTMYGARDFFGIKPMYYQDVDGHLLVGSELKSFLPFPHFKKELNTEAVKPYLMNQYNDLKETFFKGVYRFQPGHWFEXKDGKMKTHQYWDA

SEQ ID NO: 25319 - protein, 192 aa, Candida albicans SC5314
MEQSQNYNNPNLPVKSQTAREGRENQRYNSETGARIVAGCMCLNETKDKIIMISSSKHKNRWIVPKGGNELDESELETAVRETWEEAGVEGIIIKKLPVVLDSRGSQAPVIKGEFDPDVATPKSEFHFFELQVDQLSTSWPEMKKRQRRWCTYSEAKHELLKSKRPELVDALNMSSILKDTIDDENPKQDNY

SEQ ID NO: 25320 - protein, 191 aa, Oryza sativa (japonica cultivar-group)
MSKRQGPPKHQNRYAWKPNLGQKINETEPGGRFRPLSEITGVCQRCKDQIDWKRRYGKYKPIVEPAKCQKCGKRNVRQAYHNVCTACSKDLGICAKCCTCVKALVGRDLSEQESERKELEEAIRGARERERRTLLRLMNKGGGESGPSVPKIADRSREGDIFPAASLDEYAEQARQQDDSDEEEARDFVED

SEQ ID NO: 25321 - protein, 214 aa, Mesorhizobium loti MAFF303099
MPHLPDHLLAGYRNFMNGRYLTESGRYRELAREGQAPETMIVACCDSRAAPEAIFDAGPGELFVLRNVGNLVPPYEPDGEFHSTSAALEFAVQSLKVKNIVVMGHGRCGGIRAALDPNAAPLSPGDFIGKWMSLIAPAAETVSSSTFMTAAERQTALERISIRYSIANLRTFPCVSILEGKGRLSLHGAWFDISTGELWVMNKETGDFERPVLE

SEQ ID NO: 25322 - protein, 125 aa, Dehalococcoides ethenogenes 195
MTKKYFSAPGAQGPYSLAVRAGDYLYISGQIGHTDIEGKPLAGVEAQTKRCLEKMAELLKEAGASFDDVVKTTVFLKSQEDFAKMNSVYTTFFSAPKPARSTVIAGMVFPEIVVEIEAVAYLPGV

SEQ ID NO: 25323 - protein, 182 aa, Pseudomonas syringae pv. phaseolicola 1448A
MFKYIGDIVKGTGTQLRSLVMVFGHGFRKRDTLQYPEEQVYLPPRYRGRIVLTRDPDGEERCVACNLCAVACPVGCISLQKAETEDGRWYPDFFRINFSRCIFCGLCEEACPTTAIQLTPDFEMADFKRQDLVYEKEDLLISGPGKNPDYNFYRVAGMAIGGKPKGSAQNEAEPINVKSLLP

SEQ ID NO: 25324 - protein, 561 aa, Yarrowia lipolytica CLIB122
MPKLQLFAREPKKITVSDGVTDNSVVASLAPETGAVKNCIYAPNGSLFAYAVADGVHVVDPETCQETLRLDEPNVLEIGFSPLGSFIITWEIPKKDPASGNFKPNLKVFNSKTGDHVQSFVQKSQTGWNLQYTFDEKYCARMVKDEIQFFESDVLTKVWAKLRVENCADFSVSPGKNYSVAVFVPEKKGLPAKVQIYHVPNFNQAVAQKTFFKAEEVGLKWNALGTSLLVLAQTASDATGRSYYGETTLYLLGITGAFDSRITLDKEGPIHDVAWSPNSREFAVVYGYMPSKTTFFDARGNEIHTLAECSRNTIRFSPHGRLVLLGGFGNIQGAVDILDRQSKFAKVATLHAANASHVAWSPDSQYVLTATTAPRLRVDNGFRIWHVKGNLMYAQDFPELFAADWRPLPSSEFPSGHTISECPEAHESAKTAKEGAKAPVAAKPAGAYRPPHARGQPERAARGSLAASPDPSSGPKVRGAGGRVIPGAAPKKHEEKNGAVPVATVDDKKIRALLKKLRAIEDLKAKQTNGEKLEDTQIQKISTEGNVRDELKKYGWDGVSK

SEQ ID NO: 25325 - protein, 85 aa, Glycine max
  misc_feature (52)..(52): Xaa can be any naturally occurring amino acid
  unsure (1)..(85): unsure at all Xaa locations
MTGIRTVSDPGDSTSDRLSNATGASYIAVCYVKFDEATGARDVTVIYTEPPXKLVRKLDWSNDVLFTGGWAKSGLYYETVTKIFK

SEQ ID NO: 25326 - protein, 342 aa, Herbaspirillum seropedicae
MSVTDDKTTPASFSAGAARRAIELARQTLQIEADAILALKNRLGDDASEPLAQAVHLLLQCNGRAVVSGIGKSGHIGRKIAATLASTGTPSLFMHPAEAAHGDLGMVTPNDVFIAISNSGETGELMAIMPIVKRMGAVIIAMTGNDNSSLARMANVHLNVGVDKEACTLNLAPTASTTATLAMGDALAVSLLDARGFLEEDFARSHPGGALGRRLLTHVRDVMRSGDAIPAVSPDVSLSQALMEITRKGMAMTAVVDADFRPIGVFTDGDLRRLLERGQDFSQFRIAEIMHANPRTVNQDQLAVDAVQLMEEFRINQLLVTDAQGVLTGALHIHDLTRAKVI

SEQ ID NO: 25327 - protein, 1060 aa, Photobacterium sp. SKA34
MFKAVDTLHSSFIEKPLAQLWALISPLYAVDESEWLTQLLPLAEPTDEERTYSAEQASELIARVRADKNAVQMIDALLLEYSLETKEGILLMCLAEALMRIPDSATADALIRDKLSVADWKSHLKNSDSLFVNASTWGLMLTGKVVTLDAKQDGTPTNVINRLVNKMSEPMIRQAMHQAMKIMGHQFVLGRDISEAMKNGKPKREQGFTYSFDMLGEAALTAQDAEKYYNDYLTAIKAVGKINSAISTQSARQSSDPTVSIKLSALHPRYEVANEARVLEEMYHSVLDLLIFARQHNGGITIDAEEADRLELSLKLFEKLYRAKEVKGWGRFGLVVQAYSKRALPVLAWIAALSKQQGDVIPLRLVKGAYWDSELKLSQQAGFNGYPVFTRKEATDSSYLACARFLLSEPLKGLIYPQFATHNAHTISAIVAMAKHPCFEFQRLHGMGDALYNHVMDMHKTQVRIYAPVGSHKDLLPYLVRRLLENGANSSFVHRLVDANCPIAELTQHPVDVLKQRKTLHNSLIPLPIDIFGSERKNSSSINIDIESQWQPFHQAIRAFDKVKWKASPILNGKPTAILAAERVCVTAPYDREEVVGELIYATSSQVDTAIASAHDAFTDWSQRSASERANYLLLLADKLELHQAELVALCHREAGKTIHDAIDEIREAVDFCRYYAEQAQTNFDKPKRITSFDGVDQEMAYQGRGVFVCISPWNFPLAIFLGQVCAALVAGNTVVAKPAEQTSLIACRAIELLLLTGIPQGVIQLVTGLGREIGHQLTSDERIAGVAFTGSTPTAQLINRTLMARDCEPVPFIAETGGQNAMIVDSTALPEQVVRDVLRSAFASAGQRCSALRVLFIQQDIAERVITLIKGAMAELKIGDPQLHATDVGPVIDLAAKQKLLTHIESLKNQARLICQTPLPDSCASGDFVPPTAIEIQHINLLEQEHFGPILHIVRFKASEIDQVVNQINQTGFGLTMGIHSRNERTYSEIASRAKVGNCYINRDQVGAVVGVQPFGGRGLSGTGPKAGGPHYLYRFMHSTIASINVTIQREIEGVNDEK

SEQ ID NO: 25328 - protein, 306 aa, Mesoplasma florum L1
MKNIVSIGEVLMDVYSENNTIKSEVGGASFNVACSIGALKQNNSYFMGSLGNDEFVSPIKDFVKKFNVKEDFIQESDKPTTIAKVTLDENKERFFQFIRNSDAEYSLSKESNEKLSKIDFIHFGSATGFLEGNLKESYNELFEFAIKNNIKFSFDPNFRDKLWVTDQEIKNFKNHCQKFMDKASLIKFSEDELLLLTEIGNQEEAVRTIMQRNPNALVCITRGCEDTIFGWKNQINYVPTILAEHLVDTTGAGDAFISNLISEYVSIDVDANFSTEEITKIIKKSNMFANQTVQYLGALSFLEHLN

SEQ ID NO: 25329 - protein, 265 aa, Brassica napus
YAIGNEEFMVMRVRSQSLKRFSVLPLRQARDYHSRVECTLEIDAPGLEHMSLGDDQFDRIVVKNLPSLLVVELDIKFFVKVGVLFNTWDVSKSNEIRDFLNGISSVGHMIISGMTVHAFEHYSKAGIIPKFNNLSRLQAVFHGKLLQFLPAFLECCPNLKHLILVLYPEEMDEGLELTDVPRCVSTTLECVEIQEKLQWEEGKMKATSYFLGNSAVLKKLILSPTAYDPRDVLESEIWEKVYKLPKRSTGCEIIIRAMKEEVVII

SEQ ID NO: 25330 - protein, 573 aa, Mesoplasma florum L1
MSKQFKGIGASEGIAVAKALVLAEDHIEIKKTKVSDIEAEVSKLENAVNKSIEDLENLKATTLEKLGPEKAAIFDAHKEIASDPAIKDEIINVIKSESICAEFAAEQVTNNFYEMFASMDDPYFKERSADIKDVASRIIKHILGIAIVDLSTISEEVIIVAEDLTPSQTAQLNKQFVKGFATNIGGRTSHAAIMARSLEIPAVLGLRTITSDVKNGEVFALNGTTGIVELDLTDTIKSEYEKLAKEFSDLKAELQKFKDLPSKTADGQEKLIEANIGSPTDVESVIEHGGEGIGLFRSEFLYMDNDHFPTEEEQYIAYKQVMDAMKGKLVVIRTLDIGGDKKLSYFEFPHEMNPFLGYRAVRFTLDRKDIFKDQLRALLRASAHGELGIMFPMIATVDEFKRAKAIVEECKEELRKENIAFDENVQVGMMVEIPAAAVNADKFSKYADFFSIGTNDLIQYSMAADRMSENVSYLYQPLNPAILKLIDLTIKGAHKNNKWVGMCGEMAGDIQALPLLLGMGLDAFSMSATSMLRARALMSKITMAEAEELANKALSSDDTPEVIELVDAFLATK

SEQ ID NO: 25331 - protein, 425 aa, Schizosaccharomyces pombe 972h-
MAGDELKGKKRKYRDSHSGDEKSVKILPLSESSLPPLVTTISGFYPPENTRFQLLKKSNQSNRDASLIGRTERVQFEAKNQSTATVEANYCLAVADKTGRVKKIVPAKYLNTFERNILALQEKDKFLKKKHGTVSGTVMEQRANLGLAFGTRKSQKAIMEESANRVKAETLGDVKDQLVSNVQKATEALPTQEDIAAAQAQDRPIPPVNVGAESIEDAYKLEDIIPKEEFSAIYIKPLLENPDERNWAKLLPYRHSLFINERFQRLLSIEEVDQKRARILYYISLLQAFLFSRRSVGNRETLRKKLADPPEILIDGLIKRFTQTTGIGSVQVSSREVDKIICYILVLCLIVDNYSTDVLTLANDLNVKTMKANELFRTVGCRIMAYTETQRMALGLNKTDAKNHKRAVLKIPLEFPKPRRGRARN

SEQ ID NO: 25332 - protein, 305 aa, Neisseria meningitidis MC58
MNLTKTQRQLHNFLTLAQEAGSLSKLAKLCGYRTPVALYKLKQRLEKQAEDPDARGIRPSLMAKLEKHTGKPKGWLDRKHRERTVPETAAESTGTAETQIAETASAAGCRSVTVNRNTCETQITVSINLDGSGKSRLDTGVPFLEHMIDQIARHGMIDIDISCKGDLHIDDHHTAEDIGITLGQAIRQALGDKKGIRRYGHSYVPLDEALSRVVIDLSGRPGLVYNIEFTRALIGRFDVDLFEEFFHGIVNHSMMTLHIDNLSGKNAHHQAETVFKAFGRALRMAVEHDPRMAGQTPSTKGTLTA

SEQ ID NO: 25333 - protein, 2223 aa, Schizosaccharomyces pombe
MPRTHGPKPSENDPKEPTCSPSPAFYSVNGEMKDYKLMALELEDKSVLQGYSFGADHSVSGELVFQTGMVGYPESLTDPSYRGQILVFTFPTVGNYGVPDRRILDEISGLPKYFESNQIHVAAIIISSYSQNYSHFLAHSSLGEWLKEQGIPGIFGIDTRALTKKIRDQGSMLGRLLIQKDESPINPSSITGLGKDWSTAFEDIPWKNPNTENLTSQVSIKEPKLYEPHPTTAIKKADGKIIRILVIDVGMKYNQIRCFLNRGVELLVVPWDYDFTKETYDGLFISNGPGDPSLMDLVVDRVKRVLESKTVPVFRYFFGHQIMARAAGASTTKMKFGNRGHNIPCTCMISGRCYITSQNHGYAVDASSLSNGWKELFVNANDGSNEGIYNTEYPFFSVQFHPESTPGPRDTEFLFDVFIDVVKRSADAKSLQPFKLPGGTIEENRSRHPLVDAKRVLILGSGGLSIGQAGEFDYSGSQAIKALREEGIYTILINPNIATIQTSKGLADKVYFLPVNADFVRKVIKQERPDSIYVTFGGQTALNVGIELKDEFEQLGVKVLGTPIDTIITTEDRELFARAMDEINEKCAKSASASSIEEAIKVSKDISFPVIVRAAYALGGLGSGFADNEAELIDLCTLAFATSPQVLIERSMKGWKEIEYEVVRDAFDNCITVCNMENFDPLGIHTGDSIVVAPSQTLTDEDYNMLRTTAVNVIRHLGVVGECNIQYALNPFTKEYCIIEVNARLSRSSALASKATGYPLAFTAAKLGLNIPLNEVKNSVTKVTCACFEPSLDYVVVKIPRWDLKKFTRVSTQLSSAMKSVGEVMSIGRTFEEAIQKAIRAIDYSNTGFNVKDALMSIDTELQTPSDQRLFAIANAMASGYSVDRIWELTRIDKWFLEKLMGLIRTSQLISKHDISSLPISLLKTAKQLGFADVQIAAFMNSTELAVRRIRTEAGIRPFVKQIDTVAAEFPAFTNYLYTTYNAVEHDIHFNDKGVMVLGSGVYRIGSSVEFDWLQFAQVRTLRDRGVKTIMVNYNPETVSTDYDEADRLYFENIGLETVLDIYEQESSSGIIIAMGGQTANNIALPLHRENVKILGTSPEMIDGAENRFKFSRMLDDIGVDQPKWKELTSFDEADKFCDTVGYPVLVRPSYVLSGAAMNTVYSQSDLHSYLQQAVAINKDHPVVISKYIENAKEIELDAVAREGKMVMHVISEHVENAGVHSGDATLVLPPQDLAPTTIERIVDAAAKIGEALNITGPYNIQFIAKDNEIKVIECNVRASRSFPFVSKVIGVDMISMATDVIMGNPIQPYPDVDLPRDYVAVKVPQFSFSRLSGADPVLGVEMASTGEVACFGHNKFEAYLKAMISTGFRLPKKNILISIGSYKEKADVLPYVKKLYENNYNIFATAGTSDYFMESGVPCKYLADLPAEEANNEYSLSAHLANNMIDMYINLPSNNRYRRPANYISSGYKSRRLAIDYSVPLVTNVKCAKLMIEAICRNLDFSLSTVDFQSSFQTANLPGLINISAFLPEFTSEAVSDYTKECIASGFTMARFLPFSTSSTLADKDSLSAVKKLALDHAHCDYNFSVIASSTNEVTISELTSESGCLFFHFEKDDSGIDHVTAVASHFNVWPDTQTVMTDAKSTTLASLLLLASLHNRRIHITNVSSKDDLNLIVLAKQRSLPVTFDVSVYSLFLNQNDYPGATFLPTADDQVEIWNKLSYIDCFSIGSIPSRLAKFVGNTAFTGFGVREAIPLLLTAVNEGRLTLKDVVDRFYSNPKAIFRLHDQDDSGVQLEVDRSVSWSSKDWTPFNGKKLYGSIQSVQFDGHDVFFDGELNFEHTYGRDYSSASLADKSKATRKVSALMSPGLPHAAPSLAEAFGQAPENKAHPDISLNMTPNFKPSHELVQLINSSPFYRKHIISVHQVTRSDLHVLFAIAHQMRIIVERQGVIDLCYEKLLCTMFFEPSTRTSSSFDAAMQRLGEKVVAVTASASSVNKGESLADTIRTLGCYGDAIVLRHPSIESARIAANFSPVPIINGGNGSKEHPTQAFLDLYTIREELGSVNGLTITFIGDLKYGRTVHSLARLLAFWHVELHLVSPEQLALPDDVKDDIRANGLNFIEHRELTKEVVAQSDVLYCTRVQKERFASVDEYEKLKDSFIVDNSVLASAKSHCIVMHPLPRNREISEEVDFDQRRAAYFRQMRYGLYIRMALLACVMGATEVAN

SEQ ID NO: 25334 - protein, 552 aa, Oryza sativa (japonica cultivar-group)
MWAPASSPTILAAFGLVGLVLAWQAGLQLHRLWWRPRRLEKALRARGLRGSRYRFLTGDLAEEGRRRKEAWARPLPLRCHDIAPRVEPFLHGAVGVGAAHGKPRITWFGPTPEVHVADPELARVVLSNKFGHFEKVSFPELSKLIPQGLSAHEGEKWAKHRRILNPVFQLEKLKSILFLYLIIEMSSENVQLMLPVFSACCEELISRWMGSIGSDGSYEVDCWPEFKSLTGDVISRTAFGSSYLEGRRIFELQGELFERVIKSIQKMFIPGYMYLPTENNRKMHQMNKEIESILRGMIGKRMQAMKEGESTKDDLLGILLESNTRHMEVNGQSNQGLTIKDIMEECKLFYFAGADTTSVLLTWTMLLLSMHPEWQDRAREEILGLFGKNKPDYDGLSRLKIVTMILYEVLRLYPPFIELTRKTYKEMEIGGITYPAGVIINLPVMFIHHDPEIWGSDVHEFKPERFSEGISKASKDPGAFLPFGWGPRICIGQNFALLEAKMALCLILQRLEFELATSYTHVPHTIISLHPMHGAQIKVKSYMTISDYSVFY

SEQ ID NO: 25335 - protein, 615 aa, Bacillus cereus ATCC 10987
MCGITGWVDYKRSLEGERDVVTKMAETLAKRGPDDNKVWIKGNVAFGHKRLIVVDPEGGKQPMTCLKGETNYAICYNGELYNTEDIRKELLRRGYTFKGHSDTEVLLASYMEWKEECVDHLNGIYAFAVWDEQKEQVFIARDRLGVKPLFYKYDSGRLLFGSELKAILAHPDVKAEVTLEGLSEIFGLGPSRTPGHGIYAGIKELRPGHAMTFSKNGLCIWRYWNVESKKHEDSFEETVEKTRFLLQDAITRQLVSDVPLCTFLSGGVDSSAITAIAAKEYERSGKGQLHTYSIDYEDNDKYFKANAFQPNSDAPFIHLMTETFQTIHHRCVISNEQLAQYLTEAVLVRDLPGMADIDSSLLWFCREIKQDFVVGLSGECADEIFGGYPWFYREDDLQSSAFPWMRSTEAREQLLKKEWRNKLNLQQYVQRRYEESIQEVPILEGESPIEAKRRQLFYLNMVWFMTTLLDRKDRMSMGASLEVRVPFADHRLVEYAWNIPWEMKMYKNREKGLLRKALEGLLPNDILYRKKSPYPKTHNPHYTKAVTVWLQDLLTDKGSILHELFDKEQLSGLIESGGSAFQTPWFGQLMTGPQLLAHLAQIHVWFKEYGVNIKE

SEQ ID NO: 25336 - protein, 688 aa, Chlorobium tepidum TLS
MTVRVRPISLNLRNNPIMTRTRSIDEEAVATIRLLAVDMVEKAKSGHPGLPLGAAPMAYTLFTKIMRFNPANPEWPNRDRFVLSAGHGSALLYSMLHLCGYGLGMDELKQFRQLGSRTPGHPEYGHTPGVETTTGPLGQGIATAVGMAAAERFLATKLNTAERALIDHFTYVICGDGDLMEGISSEASSLAGHLRLGRLICLYDSNHISIEGSTGLAFTEDVARRYEAYGWHVLSHIDGNDLAAIEQAVRNAQEIDDRPSLIIVNTTIGYGSPHKQGTASAHGEPLGPEETKLVKQAFGFDENESFVVSDRVYDHFHAIAERGAALEAEWQTQWQSFRQEEPGLASALTDLLAGRFPESWLPEMPKFTTGEKLATRQASKSVLAKIAEKAPLLAGGSADLAPSNGTLIGAAFEAGSYGGSTFHFGVREHAMGALVNGMALSKMMIPYGATFLVFADYMKPALRIAAMMQSPSIFIFTHDSIGLGEDGPTHQPIEQLAMLRAMPGFDVYRPADANETAAAWLLALKRRKPAALVLTRQGLPVLDDADGRLRNGVTKGGYVLAEWADTDDDDDRRIIIVATGSEVHPALEAKTLIEQEGFAARVVSMPSRELFAEQPAEYRAAVLPPTVRARAVVEAAATFGWHDIAGDGGIVIGIDRFGMSAPSSQVMEHFGFTAENIAARALELLNRK

SEQ ID NO: 25337 - protein, 308 aa, Pseudomonas syringae pv. phaseolicola 1448A
MTSKLDQLKKFTTVVADTGDFGAIKSLEPEDATTNPSLLLKAASDVNNAQMLADAFSGAKGDIGLACDRFAVAIGQEILKVVPGRVSTEVDARLSFDTNALIERSERLIGLYDAAGIKRDRVLIKLAATWEGIRAAEKLEKDGIQTNLTLLFSFAQAIACAEAGVFLISPFVGRIYDWYKKSSGTDYVGAEDPGVQSVTRIYNYYKANDFKTVVMGASFRNLNQIEQLAGCDRLTISTDLLKKLAEDTGTLERKLAPGNAGEARQSLTESQFRWASNEDAMATEKLAEGIRQFARDQEKLEALLSAKA

SEQ ID NO: 25338 - protein, 379 aa, Petunia x hybrida
  misc_feature (283)..(283): Xaa can be any naturally occurring amino acid
  unsure (1)..(379): unsure at all Xaa locations
MKELPQDVVIYIFVMLPVKSLLRFKCTCKTFCHIIKSSTFINLHLNHTTNFNDELVLLKRSFETDEYNFYKSILSFLFAKEDYDFKPISPDVEIPHLTTTAACVCHRLIGPCNGLIVLTDSLTTIVFNPATLKYRLIPPCPFGIPRGFRRSISGIGFGFDSDANDYKVVRLSEVYKEPCDKEMKVDIYDFSVDSWRELLGQDVPFVFWFPCAEILYKRNFHWFAFADVVVILCFEMNTEKFHNMGMPDACHFADGKCYGLVILFKCMTLICYPDPMPSSPTEXWTDIWIMKEYGEKESWIKRCSIRLLPESPLAVWKDEILLLHSKTGHLIAYDFNSNEVQELDLHGYPESLRIIIYRESLTAIPRNNDCIELQNFRCN

SEQ ID NO: 25339 - protein, 422 aa, Pseudomonas syringae pv. phaseolicola 1448A
MTGFLWNVSDNARVTFFFMSIFTRAKQPMCYNGLLDLSVWQVIAVTLAMTHVTIVGVTVYLHRYSAHRSLELNAGLKHFFRFWLWLTTAQNTREWTAIHRKHHAKCETVDDPHSPVVKGLSTVLRKGAELYREEAQNQDTLRIYGKNCPEDWIERNLYSRYKLLGIALMAVIDVALFGALGITVWAVQMMWIPFWAAGVVNGLGHAVGYRNFECRDAATNLVPWGIVIGGEELHNNHHTYPNSAKLSVKPWEFDMGWAWIKLFSFLGLAKVQRVAPIAHRVEGKGHMDMDTAMAILNNRFQIMGQYRKLVIAPLVAQELAKADESVRHQFSRAKRLLSRETSLLDDKHHLRIQTMLEHSHALKVIYEKRLALQQIWVKTSSNGHDMLSAIKEWIHEAEASGIHSLREFADQLKTYSLRPAHA

SEQ ID NO: 25340 - protein, 253 aa, Ustilago maydis 521
MSKSTAAASTASGGIANGVGPSRRTWDKDDFTRKAMSREKRQAELDAVNSERRSQGLPPLKRLKSNAPEPELAMQQRRAPLGLERNQGKTVMVDLTADSAKGQTGPGFYCETCRKLLKDNLAYLDHINGRYHLMRIGQSTQQDRATLQEVEQMLDELRSKHAADAERGGGGKATASASYDFDQRIQQIAEQEQKAREEKREKRRLRKQQSKTSISTTHAHPIPTTAAAEQDNSAETAMMAAMGFGGFGSTKKR

SEQ ID NO: 25341 - protein, 460 aa, Ashbya gossypii ATCC 10895
MASLPSIVIAVAEKQLLFSNHKSFCKGIMSTLEELESQQLPGDQEIDQDILKLPTAELQTRTKLLDNEIRIFRSELQRLSHENNVMLEKIKDNKEKIKNNKQLPYLVANVVEIMDMDELDDTNESTTQGGNLNLDNAAKGYAAVVKTSSRQTVFLPMVGLVDPKQLKPNDLVGVNKDSYLILDTLPSEFDSRVKAMEVDDKPTETYSDVGGLDKQIEELVEAIVLPMKQADKFKDMGIRAPKGALMYGPPGTGKTLLARACAAQTNATFLKLAAPQLVQMFIGEGAKLVRDAFALAKEKAPTIIFIDELDAIGTKRFDSEKSGDREVQRTMLELLNQLDGFGSDDRVKVLAATNRVDVLDPALLRSGRLDRKIEFPLPTEDARAQILQIHSRKMTSDDSINWQELARSTDEFNGAQLKAVSVEAGMIALRNGQSVIKHEDFVEAIGEVQARKTKSVSFYA

SEQ ID NO: 25342 - protein, 119 aa, Arabidopsis thaliana
  misc_feature (72)..(72): Xaa can be any naturally occurring amino acid
  unsure (1)..(119): unsure at all Xaa locations
MFSSMPSAVVEETSPAQASGVTPYTGGKSFAANPVTRKTNKDITTIASNGGRGSCMKVRPPIGKKKLETISXSPDLSDVQLAEEGDHTLRNKGIPCGEFRLEHPFEYPEHGNHSGYHQG

SEQ ID NO: 25343 - protein, 309 aa, Leptospira interrogans serovar Lai str. 56601
MKFFSLCKGSFAFITRFAMSWINSYNLKDDTFAGSGGSKIFYRTYQPKEGRKGNRVIVVQHGIGEHSGRYEFLVEALSGTGTAFYLIDSQGHGRSEGKRGAIDSFSDFLFDLDQLISIAKEKEKVPKVTLLGHSMGAAISTFYAEEGTNQGNLNALMISALPIRVKTDLVMKVKKGIAPLMSDLLPNLTLPTGLNIHFLSHDKSVVEAYRKDPLVHGMASAYLGNMLLNSEEPILANAGKIKIPIYIFHGKEDQIADYTGSEAFFEVVGSTDKSMKIYEGLYHETMNERIEDRTKVLTDLKKWFESHSN

SEQ ID NO: 25344 - protein, 514 aa, Kluyveromyces lactis NRRL Y-1140
MLGRTQVTTLRRFIRLYSQLPLKVPVQLPNGITYEQPTGLFINGEFVPSRQHKTFEVLNPSNEEEITHIYEAREDDVDIAVAAAKKAFNNGWSTAEPEDRAKCLLKLADLIDQHAETLASIESLDNGKSLFCSRGDVALVAKYLRSCAGWADKIYGKVIDTGADHFSYTKREPLGVCGQIIPWNFPLLMWSWKVGPALATGNTVVLKPAEATPLSALYACQLVQEAGVPKGVVNIIPGFGKIVGERICTHPDIKKVAFTGSTATGRHIMKTCADSIKKVTLELGGKSPNIVFGDADLDKAVKNIAFGIFYNSGEVCCAGSRIYVQDTVYEEVLEKFKQYAESLKVGNPFEENVFQGAQTSQMQIDKILSYVDVGTSEGARVITGGERIGNKGYFIKPTIFADVKEDMQIVKEEIFGPVVTVSKFTTVDEVVAKANDSEYGLAAGIHTKDVNKAIDVSNRVKAGTVWINTYNNFHQNVPFGGFGQSGIGREMGAEALDNYTQTKAVRMAIDHPNY

SEQ ID NO: 25345 - protein, 411 aa, Oryza sativa (japonica cultivar-group)
MAVAAEGEEMTPEHEEEVIIVGAGQSGLAAAACLSVRGVASCLVLERDDCVASLWRHRAYDRLRLHLPKRHCALPRAPHAAAAPDYLPRDDFAAYLDAYASRFGVRTRLRREVRSARHDAARARWLVEAVDLATGKAERYAARHLVAAAGENDERVVPEVPGMDTFPGKVVHSADYRSAGAFKGRSVLVVGCGNSGFEIAYDLAAGGAAAVSIAVRGEVHLVSREVWSVGMALQRYLPTWAVDKVVLLMCAVVFGGDTARYGLRRPAVGPFSMKMTTPAYPVFDVGTFAKIRSGEIRVVPAGIKSVRGGDVEFADGRRHAFDAIVFATGYRSTTKQWLKSDDGLIGDDGMAGRSYPDHWKGENGLYCAGMVRRGIYGSGEDAELIADDISKQMKRWSSEPVYNGHISNGSP

SEQ ID NO: 25346 - protein, 406 aa, Mycobacterium smegmatis str. MC2 155
MSTRDFLVPDLGEGLQDATITSWNVDVGDTVELNQTLCTVETNKAEVEIPSPYAGKVEALGGAAGDTLAVGSLLVRIATSSDEPVEAQPMNGEVPQRKSVLVGYGADDSMDASRRRTHGPRARAKPPVRKLAAELNVDLGALDPGSGPDGIITRDDVLAAAGRSPAAQSAGTPQPSQTRDVRGVQAEMARRMALSRREIPDAHARVDVDCTALLRLRDRIRSAETELPITPFVLTLRLLTVALRRHVVLNATWMETTGGPQIHQHSAVHLGIGVAAPRGLLVPVVRDAQGMTTRQLAVTVARLVESARAGTLSPAELTGSTFTVSNFGALGVDDGVPVINYPEAAILGMGSLRERPVVVDGAVVARPTMSLTCVFDHRIADGAQAAAFLGELRGLIEEPDLALLDL

SEQ ID NO: 25347 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 25348 - protein, 474 aa, Burkholderia sp. 383
MRTSQQSYIDGQWLDPADSRSIDVIDPSTARPYAQLRIGGTADVDRAVGAAKQAFDTYSRWPVDERVALLRRVLEIYQHRYEEVAQTISQGMGAPIAFARAAQAAVGTAHLEQTIRALQSFRFSTQTDSLLVSHEPIGVCALITPWNWPINQIVCKVAPALAAGCTMVLKPSEIAPFSAILFAEILDEAGVPPGVFNLVHGYGHEVGDALSRHPDVDMVSFTGSTRAGVEVAKAAADTVKRVHQELGSKSPNLILPDADIEDAVTRGVRSCFSNSGQSCNAPTRMLVHVDHLALAEQAARREAERTVVGDPRSTETGIGPVVSRTQFDRIQHFIRLGIEEGAMLVAGGPGRPDGLGDGFYVRPTVFSNVTPDMTIAREEIFGPVLAIMTYRTEDEAVALANDSVYGLAAYVQTKDPERARKVAARLRVGNVHINYPPWNPAAPFGGYKRSGNGREYAEFGLVEYLETKGTTGYA

SEQ ID NO: 25349 - protein, 404 aa, Arabidopsis thaliana
MAAFLQTNIRLEIIPGRYSSLTDHKFRAPYRIRCAAASPVKKRYNITLLPGDGIGPEVISVAKNVLQKAGFLQGLEFDFQEMPFGGAALDLVGVPLPEETSTAAKQSDAILLGAIGGYKWDKNEKHLRPEMGLLNIRRDLNVFANLRPATVLPQLVDASTLKKEVAQGVDMMIVRELTGGIYFGEPRGITINENGEEVGFNTEIYAAHEIDRIARVAFETARKRRGKLCSVDKANVLDASILWRKRVTALASEYPDVELSHMYVDNAAMQLVRDPKQFDTIVTNNIFGDILSDEASMITGSIGMLPSASLGESGPGLFEPIHGSAPDIAGQDKANPLATILSAAMLLKYGLGEEKAAKMIEDAVVDALNKGFRTGDIYSPGNKLVGCKEMGEEVLKSVDSKVPV

SEQ ID NO: 25350 - protein, 388 aa, Petunia x hybrida
MANGILKKLPEDLLFLILLTFPVISLMRFKCISKAWSILIQSTTFINCHANRKTNTKDEFILFKRAIKDEEEEFINILSFFSGHNDVLNPLFPDIDVSYMTSKCDCAFNPLIGPCDGLIALTDSIITIILNPATRNFRVLPPSPFGCPKGYHRSVEGVGFGLDTISNYYKVVRISEVYCEEADGYPGPKDSKIDVCDLSTDSWRELDHVQLPSIYWVPCSGMLYKEMVHWFATTDIMVILCFDMSTEMFHTMKMPDTCSRITHELYYGLVILCESFTLIGYSNPISSIDPVKDKMHIWVMIEYGVSESWIMRYTIKPLSIESPLAVWKNHILLLQSRSGLLISYDLHSGDAKELSLHGFPDSLSVKVYKECLTSIPEGGEYSTKVQKF

SEQ ID NO: 25351 - protein, 247 aa, Arabidopsis thaliana
MGESKGCGNVGRMISKNKSANSYNLSLQLSPVVSFWDCIVRTMRYSYIPEWLEIYSQAIMDHTVCKQVQPVVRKAKKKHGKDEFDRIKQAEKKKRRLEKALATSAAIRAELEKKKQKRLEEQQRLDEEGAAIAEAVALHVLLGEDSDDSSRVKFGEEKGFTMDLFRDERTNYVPRQSCASYAVQGIGFVSNGYGLGDSNWSPFTRRGAWDNNMGISADLIAAQAVSALQISENADGNAFVFNGMFRG

SEQ ID NO: 25352 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNI

SEQ ID NO: 25353 - protein, 248 aa, Herbaspirillum seropedicae
MYKIVFMRHGESTWNLANRFTGWVDVDLTEKGVAEARQAGKLLKEAGFTFDLAYTSVLKRAIRTLWTTLDEMDQMYIPIKNDWRLNERHYGALQGLNKAETAAQYGDEQVLVWRRSYDTPPNPLTPGEERDAFGDPRYAGLSREQVPLTECLKDTVARVLPAWNDAIAPAIRAGKQIIISAHGNSLRALIKYLDGISDNDIVGLNIPNGQPLVYELDADLKPIKSYYLGDQSAIEAALKAVANQGKSK

SEQ ID NO: 25354 - protein, 1483 aa, Ashbya gossypii ATCC 10895
MRARSEGPGRNLSPRTGVPRSPAVVSSQGILRSPSLKSGASPMSTLGLGWKHGQQSPTGHVAQYLSPLSADSSSAPSRKTSITGLSTLRGGSPSRKPRSNSVSSNFKMAEDAENNTPTLVLPPSLASLNSQSTLSTVYTGNPAAAANPEASSSSSKSGNSATSSLRSGYKPMKRQYVLNEQLYLSRMKNSHLDDYYTRGIAPTMNDDEEDDTDLDTPDVNIDNDDQAFGSNVFTFHDRETSRSVDNELVMLSTKHLLGKMNWLRELDPGNPDIEAPLEFLARAENVSINSATPQDNRQDIEGMLGKLSRNPLVQERLEWQTMLWNVLRGDIVNSEKTKLAEQRTTDELTTQFSDELWLELKSWLYGRSVEDQRTWLQYLRASTDSIFERIIEFRLEDDIEIPDAVVKVESLLNEYYKVIPYWKNCQQMYKEKPITNSDDFKLRIETLNTYVVMYAAFKTEITALHQWIGNDDPEAEGAAGGIEDIKCAEKPIAEQVLKEKDIETIFQNKIFYRHGPWVFKAKLAAIEYGDYFNLMNLPSLNGYLTTLITFPMKLIKEIILIRLNYARKLQKPTMMMIDQMIDDFKSYIKLAVQIIYTINLYCSNKELQLGNVIDDTFDKTVNDAISYFFKLLNLKLVDSTKKSFKNFKEPEALFSHWEDLKNVGCHIDGANEVVPTGFVSLTLRLLNKLHAYILKEQNSVTEKVSKAECEKWIMVTLENIGLFKRKMNRFSNVLTKALQNSANYRINDIRLLLQNLKDTGHFLIYTGGYLEDSGTYLFASKELLGYSGTDILRIVKGMEVGSDLIPEVSITNSLSVYTAIEQGVCSDPIFVQEERPDGLSYYHVQSECNKRHIGKSRGKIIHSYDSFYGSETEGSELYELERKLKSLGYLVAVCPDEPILWEGEMYNLSYEKQLNAEDFPVNITPGMLTLMAQGSTYSMEYQCDKFQHFAGNSVVFTEKRCSIVPAEQTLQKINKAYFRITYHTLAHHHKLVSTIQRKFRGFESLNTVFIFCRDFAKNFLRSNVASYETKSVIIMQMLKVSIGWLTFLIDDCDPNDPKTFRWCVLAMEFAMQMTSGWNILGISGEQFKTLKDKISGCMALLISHFDIMGVRSREAENTVMPQVRAIMDFETDDEETVQQLNTKMRLKAINELEQNTVNTRRQVGKVLDATDKDNQYLLTLASSLSNVSIKWQKRSFIGGGSFGSVYSAVNLDTGDILAVKEIKFNDRKTIKQVFPSIRDEMTVLEMLNHPNVVQYYGVEVHRDRVNIFMEYCEGGSLASLLAHGRIEDEMVTQVYSLQMLEGLAYLHESGVDHRDIKPENILLDFNGIIKYVDFGAAKVLASNGSKKLNLEQHMEGEKMIGTPMYMSPEAISGTGYGKFGSDDIWSLGCVILEMVTGRRPWANLDNQWAIIYQVAAGQIPMFPSKNEMSQAGIKFLSRCLIQDPNQRSTAVELLMDPWIIEIRTIAFGDDTVEPVSKERPLNS

SEQ ID NO: 25355 - protein, 546 aa, Pseudomonas putida KT2440
MSELIRVPDIGSGEGEIIELFVKVGDRIEADQSLLTLESDKASMEIPAPKAGVIKELKVKLGDRLKEGDELLVLEAEGAAAAAPEAPAAAAAPAAAPAPAAEAAPAAPAAAPAAASVQDIHVPDIGSSGKAKIIEVLVKVGDTVEADQSLITLESDKASMEIPSPAAGVVEEVLCKLEDEVGTGDLIFKLKVAGAAPAAAPAPAAAPAPAKAEAAPAAAPAAAAPAAAPAPAATAPAAGSNAKVHAGPAVRQLAREFGVELGAVAATGPHGRILKEDVQVYVKAMMQKAKEAPAAAGATGGAGIPPIPAVDFSKFGEVEEVALTRLMQVGAANLHRSWLNVPHVTQFDSADITELEAFRVAQKAVAEKAGVKLTVLPLLLKACAFLLKELPDFNSSLAPSGKAIIRKKYVHIGFAVDTPDGLLVPVIKNVDQKSLLQLAAEAAALAEKARTKKLSADEMQGACFTISSLGHIGGTGFTPIVNAPEVAILGVSKATMQPVWDGKAFQPKLMLPLSLSYDHRVINGAAAARFTKRLGDVLGDIRTMLL

SEQ ID NO: 25356 - protein, 881 aa, Pseudomonas putida KT2440
MQDLDPIETQEWLDALESVLDKEGEDRAHYLMTRMGELATRSGSQLPYAITTPYRNTIPVTHEARMPGDLFMERRIRSMVRWNALAMVMRTNLKDSDLGGHISSFASSATLYDIGFNYFFQAPTEEHGGDLIFFQGHASPGVYARAFMEGRISEDQMNNFRQEVDGNGLSSYPHPWLMPDFWQFPTVSMGLGPIQAIYQARFMKYLEARGFIPAGKQKVWCFMGDGECDEPESLGAIALAGREKLDNLIFVINCNLQRLDGPVRGNGKIIQELEGVFRGGGWNVNKVVWGRFWDPLLAKDTNGALQRRMDEVIDGEYQNYKAKDGAYVREHFFNTPELKAMVEDLSDEEIWKLNRGGHDPYKVYAAYHQAVNHKEQPTVILAKTIKGYGTGAGEAKNTAHNTKKVDVDSLRHFRDRFDIPVKDADLENLPFFKPEEGSAEAKYLAERRAALGGFVPQRRAKSFSVPTPPLETLKAILDGSGDREISTTMAFVRILAQLVKDKDIGQRIVPIIPDEARTFGMEGMFRQLGIYSSVGQLYEPVDKDQVMFYREDKKGQILEEGINEAGAMSSFIAAGTSYSCHNQPMLPFYIFYSMFGFQRIGDLAWAAGDSRTRGFLIGGTAGRTTLNGEGLQHEDGHSHMMAGTIPNCRTYDPTYGYELAVIIQDGMKKMTEEQQDIFYYITVMNESYQQPAMPAGVEEGIIKGMYLLEEDTREAAHHVQLMGSGTILREVREAAKILREEFNVGADVWSVTSFNELRRDGLAVERANRLKPGQKPQQTYVEQCLNGRKGPVIASTDYMKLFAEQIRQWVPSKEFKVLGTDGYGRSDSRKKLRHFFEVDRHFVVLAALEALADRGEIEPKVVADAIVKFGIDPDKRNPLDC

SEQ ID NO: 25357 - protein, 128 aa, Mesoplasma florum L1
MASKATKTTQSKYAIINNQLRNDLPDFTSGDTIKVDVKIKEGEKFRIQTFEGLVIKTQGSGITYSVVVRKLSNGVFVERTFPLHSPIIDKVTIVKRGRVRRARIYYIRKLSGKAARIKEILPTKADKK

SEQ ID NO: 25358 - protein, 482 aa, Brucella suis 1330
MTTFAELGLSPKVIAAVEAAGYTAPTPIQAGAIPPALERKDVLGIAQTGTGKTASFVLPMLTLLEKGRARARMPRTLILEPTRELAAQVEENFVKYGINHRLNVALLIGGVSFEEQERKLERGADVLIATPGRMLDHFERGKLLLTGVEILVIDEADRMLDMGFIPDIERICKLIPFTRQTLFFSATMPPEITKLTEQFLHSPVRIEVAKASSTAKTVTQRLVKSGKKDWDKRAVLRDLIQSEGDSLKNAIIFCNRKKDVSELFRSLTRHEFDAGALHGDMDQRARMAMLSSFKDGKLRLLVASDVAARGLDIPDVSHVFNFDVPIHAEDYVHRIGRTGRAGRSGKAFTIVTSSDTKYLAAIESMIGEKIEWHDGDLSTLAVSEEADEQPRKGRNARGKGKEKPKEKASKPVAAETVDPAGQPQPVIENQHRREAIRSSNEERRGKPQTEQHKRRRDRDDDGPAPVGFGNDIPAFMLIPTGV

SEQ ID NO: 25359 - protein, 753 aa, Archaeoglobus fulgidus DSM 4304
MPVLWLADVDKNDIPLVGGKGANLGELLRAEIPVPDGFVVDARTFREFIQKTGIAEKIYSLLRELDVEDTEKLDAVSREIREIIEKTEMPEDIEREIREAYRKLCEEEGKEVYVAVRSSATAEDLPDASFAGQQETYLNVVGEDEVVEKVKKCWGSLFTPRAIYYRVQKGFRHEDVSIAVVVQKMVNSEKSGVMFTSHPVSGEKKCIIEAVFGLGEAIVSGLVTPDTYVYDRVKRKIEEVKIGEKKFMLTRKDGKTVKVELPPEKANERVLSDEEIEKLVTLGELIEDHYGKPQDVEWAIEGGKIYIVQSRPITTIRKEKKEAEEEVSEEAEGKILLKGLGASPGIASGKVKVIFSEKEISKVEEGDILVTTMTTPDMVPAMKRAAAIVTDEGGMTCHAAIVSRELGVPAVVGTKVATKVLKDGMVVTVDGEKGIVYEGRIEKKEEPKPVVASAPIITATEVKVNISIPDVAERVARETNADGVGLFRIEHMVLGLEKHPMKFIRDGEIDRYIDLLYQEMKKVVKAFYPKPVWIRTIDAPTDEFRAMEGGEDEPIEANPMLGFRGIRRDLAEEEHFRAEMRAIKKLVDEGYTNVGVMLPLITSPEEVKRAKEIAISEGLPLDKIEFGVMVETPAAALILEDIIKEGIDFVSLGTNDLTQYTLAVDRNNENVAYLYNETHPAVLKLIERTIKVCKEHGVKSSICGQAGSYPHVVEKLVEFGIDSVSANPDAVQRIREVVARAEKRIILEKLRKI

SEQ ID NO: 25360 - protein, 413 aa, Herbaspirillum seropedicae
MAQIEVKVPQLSESVAEATLLQWHKKVGEPVSRDENLIDIETDKVVLELPSPDAGVITQIIKADGATVVAGEVIAILDTDASAQVAPTEVKAAPAPQATNEPTPVAAPELASKGDVAMPAAAKLLADNNLSTSQVTGTGKDGRVTKGDVLGALSAPAAAPAAAAKPALAQVAAPVKAGLESRPEQRVPMSRLRARVAERLVQSQSTNAILTTFNEINMQPVIDLRNKYKDKFEKEHGVKLGFMSFFVKAVVHALKKYPIVNASVDGNDIVYHGYFDIGVAVGSPRGLVVPILRDADQMSIADIEKKIGEFGQKAKDGKLSIEELSGGTFTVSNGGTFGSMLSTPIINPPQSAILGIHATKERAVVENGQVVVRPINYFALSYDHRIIDGREAVLSLVAIKEALEDPARLLLDL

SEQ ID NO: 25361 - protein, 227 aa, Neisseria meningitidis MC58
MELVFIRHGQSEWNAKNLFTGWRDVKLSEQGLAEAAAAGKKLKENGYEFDIAFTSVLTRAIKTCNIVLEESDQLFVPQIKTWRLNERHYGQLQGLDKKQTAEQYGDEQVRIWRRSYDTLPPLLDKDDEFSAHKDRRYAHLPADVVPDGENLKVTLERVLPFWEDQIAPAILSGKRVLVAAHGNSLRALAKHIEGISDEDIMGLEIPTGQPLVYKLDDNLKVIEKFYL

SEQ ID NO: 25362 - protein, 216 aa, Oryza sativa (japonica cultivar-group)
MAGGEKVDYVFKVVLIGDSAVGKSQILARFARNEFSIDSKATIGVEFQTRTLLIDHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENAFQTVLSEIFKIHSKKNMAADPKANGAAPSLAGKKVVVPGPAQEIPKSKCCSSM

SEQ ID NO: 25363 - protein, 425 aa, Triticum aestivum
  misc_feature (109)..(109): Xaa can be any naturally occurring amino acid
  misc_feature (163)..(163): Xaa can be any naturally occurring amino acid
  misc_feature (275)..(275): Xaa can be any naturally occurring amino acid
  misc_feature (306)..(306): Xaa can be any naturally occurring amino acid
  misc_feature (344)..(344): Xaa can be any naturally occurring amino acid
  misc_feature (379)..(379): Xaa can be any naturally occurring amino acid
  misc_feature (393)..(393): Xaa can be any naturally occurring amino acid
  unsure (1)..(425): unsure at all Xaa locations
MAAASFTAAKFLAPAAARSGGDRARPFPAPSASSMRPLRHRPARRLGSVLAVSSDVLKAAPAAAAYPAVTREEALELYEDMILGRNFEDMCAQMYYRGKMFGFVHLYNXQEAVSTGFIKQLNQPDCVVSTYRDHVHALSKGVPARAVMAELFGKATGCCQGQXGGSMHMFSEPHNLLGGFAFIGEGIPVATGAGFAAKYRHEVLKQSSPDGLDVTLAFFGDGTCNNGQFFECLNMAQLWKLPIIFVVENNLWAIGMSHLRSTSDPEIWKKGPAFXGCLGVHVDGMDVLKVREVAKEAIDRARRGEXGPTLVECETYRFRGHSLADPDELRRPDEKSHYAARDPXTSLKKYIIEQNLASEAELKSIEKKIDDVVEEAVEXADASPLPPRSQLLXENVFADSKGFGISPDGKYRCEDPKFTQGTAQV

SEQ ID NO: 25364 - protein, 138 aa, Deinococcus radiodurans
MERTFAMIKPDGVRRGLTPEILARIHNKGYRVVGLKQMMMPRETAEQHYGEHRERPFFGELVDFITGGPVVAIALEGENAIAGWRAMMGATNPANAAPGTIRADFATSTGENVTHGSDSPESAERELALFFGDGELLS

SEQ ID NO: 25365 - protein, 465 aa, Burkholderia sp. 383
MNAVDVNLDADLQAIGKRHLLMHFTHADAYRDHALTVFDRGEGCWLVDRNGKRYFDGLAGLYCVQVGYSHGAEIGDAIREQMVRLPFATNWGVGHEPAIKLAHKLAALAPEGLNRVFFTSSGSESNESAIKLVRQYHQSRGEPQRRKFIARRVAYHGTSFGALALNGMTNFRKHFEPLMSGVRHVGNTKRYGRPVGETEAQFTRHLLDEIESLIVQEGPDTVAALVVEPLQNAGGSLTPPAGYAAGLRDICDRHGVLLVADEVICGFGRLGEYFGSARYGLKPDIITFAKGIASGYVPLGGVIASDTVVDTVLNGPQQMFLHGATYGGHPVACTAALANLAIMEREGVLENVRSNEAVFRQTLDGLLELPCVGDVRGDGYHYSLELVTDKAARRWAAGVSAQAFVSTLLAPAIFDAGLLCRAGVDHEGTPIVQFSPPLVMSRDEIVWFVAKIRDILVDTYARATR

SEQ ID NO: 25366 - protein, 126 aa, Streptococcus thermophilus LMG 18311
MAKTIHTDKAPAAIGPYVQGKIVGNLLFASGQVPLSPETGEIIGETIQEQTEQVLKNVGAILAEAGTDFDHVVKTTCFLSDINDFVPFNEVYATAFKADFPARSAVEVARLPKDVKIEVEVIAEID

SEQ ID NO: 25367 - protein, 360 aa, Rhodobacter sphaeroides 2.4.1
MDIRTHRIAAIPGDGIGIEVVAAGLEVLEALADRDGGFRFDVESFDWGTDRYRRTGAFMPEDGADRLRGFDAILFGAVGAPDVADHLTLWGLRLAICQPLDQYANVRPTRMLPGIRSPLRHVGESELDWVIVRENSEGEYAGQGGRSHPGLPLEVATDVSIFTRAGVERIMRFAFRLAQSRPRKLLTVVTKSNAQRHGMVLWDQIAGEVAREFPDVRWDKMLVDAMTVRMVQKPASLDTIVATNLHADILSDLAAALAGSIGVAPTANLNPERDTPSMFEPIHGSAFDITGRGIANPVATFWTAAMMLEHLGEAEAAGRLMTAVGRVTADEDLHTPDLGGRATTRQVTDALIAALRGRNA

SEQ ID NO: 25368 - protein, 357 aa, Rhodobacter sphaeroides 2.4.1
MADNHLKIAVIAGDGIGKEVVPEGLRVLEAVAGRHRIDLRFEEFDFASCDYYARHGQMMPEDWQERIGGHDALFFGAVGWPATVPDHVSLWGSLIQFRRQFDQYVNLRPARLMPGVPSPLAGRGPGDIDMWIVRENTEGEYSAIGGRMYPGTEREIVLQETVMSRHGIDRVLRYAFELANRRERRRLTSATKSNGISITMPYWDERVEAMAQDYPDVAWDKYHIDILAAHFVLNPDRFDVVVASNLFGDILSDLGPACTGTIGIAPSGNINPERAFPSLFEPVHGSAPDIAGQGIANPVGQIWAGAMMLDHLGHGEAAAEIMAAIERVLADPRLRTRDLAGAADTVTCGKAIVEALG

SEQ ID NO: 25369 - protein, 176 aa, Brassica napus
  misc_feature (52)..(52): Xaa can be any naturally occurring amino acid
  misc_feature (66)..(66): Xaa can be any naturally occurring amino acid
  unsure (1)..(176): unsure at all Xaa locations
MATSFSATLPLHGSQENRLLLPPIRLAPPPSSSFLGSTRSLTIPSSRRLYHXHAARRSPVVGVQEXVKEKKVTNSLLITKEEGLVLYEDMILGRSFEDMCAQMYYRGKMFGLVHLYNGQEAVSTGFIKLLTQSDSVVSTYRDHVHALSKGVSARAVMSELFGKVTGCCRGQGGSMH

SEQ ID NO: 25370 - protein, 308 aa, Triticum aestivum
  misc_feature (285)..(285): Xaa can be any naturally occurring amino acid
  unsure (1)..(308): unsure at all Xaa locations
MRPPARGGRGGRGFGGRSDGGGRGGRGFGGRSDGGGRGGRGGRGGRTPRGRGGRGGGGRGGAGMKGGSKVVVVPHKHDGVFIAKAKEDALCTKNMVAGESVYGEKRVSVQNEDGTKVEYRVWNPFRSKLAAAVLGGVDNIWIAPGARVLYLGAASGTTVSHVSDIVGPTGLVYAVEFSHRSGRDLVNMAKKRTNVIPIIEDARHPAKYRMLVGMVDVIFSDVAQPDQARILALNASYFLKNGGHFVISIKANCIDSTQAPEAVFAAEVEKLKLEQFKPSEQVTLXEPFERDHACVVGGYRMPKKPKAT

SEQ ID NO: 25371 - protein, 426 aa, Erwinia carotovora subsp. atroseptica SCRI1043
MNKSESLYAAAQQLIPGGVNSPVRAFNGVGGTPLFIERADGAYLYDVDEQAYIDYVGSWGPMVLGHNHPSIRDAVIAAAERGLSFGAPTEMEVQMARLVTSLVPSMDMVRMVNSGTEATMSAIRLARGYTGRDKIIKFEGCYHGHADCLLVKAGSGALTLGQPNSPGVPADFARHTLTCVYNDLSSVRTTFEQYPDEIAAIIVEPVAGNMNCVPPLPDFLPGLRALCDEFGALFIIDEVMTGFRVALAGAQSHYGVVPDLTCLGKIIGGGMPVGAFGGKREVMQALAPTGPVYQAGTLSGNPIAMAAGFACLTEVAKPGVHEKLTALTNQLADGLLAAAKAENIPLVVNQAGGMFGLFFTDAESVTCYQDVMKCDVERFKRFFHMMLEEGIYLAPSAFEAGFMSLAHTPQDIERTIEAAQICFSRL

SEQ ID NO: 25372 - protein, 1112 aa, Zymomonas mobilis
MPKRTDLQSIMIIGAGPIVIGQACEFDYSGTQACKALREEGYRVILVNSNPATIMTDPDMADATYIEPITPEVVARIIEKERPDALLPTMGGQTALNTALALASDGTLEKFNCEMIGADATAIDKAEDRLKFRQAMDKIGLESPRSSVAHSLEEALDGLDYVGLPAIIRPSFTMGGTGGGVAYNKEEFIDIVSGGLSASPTQEVLIEESVIGWKEYEMEVVRDRHDNCIIICSIENIDPMGVHTGDSITVAPALTMTDKEYQIMRNASIAVLREIGVETGNGGSNVQFALNPENGRLVVIEMNPRVSRSSALASKATGFPIAKVATKLAIGYTLDEITNDITGATPASFEPTIDYVVTKIPRFAFEKFKNAKPLLTTAMKSVGEVMAIGRSFPESLQKALRGLENGLSGLDPVEALVGANPSVIEAELARPTPDRLLVAAQALREGLPAEKICEITHYDPWFIARLAEIIAAENEVISNGLPLEAAAFRRLKAMGFSDKRLADLALQSAHLRGLGKAQAKGSGIVHDALQAMTGGVTEAEVRTLRHSLNIRPVFKRIDSCAAEFEAKTPYMYSTYEAPFFGEPVCDSLPSNRKKVVILGGGPNRIGQGLEFDYCCCHACFALEAAGYETIMVNCNPETVSTDYDTSDRLYFEPLTGEDVLEILHTEQKNGTLVGVIVQFGGQTPLKLAAEIEKAGIPILGTSPDAIDLAEDRERFSALVSELGLLQPANGIARSRDEAISVADKIGYPILIRPSYVLGGRAMEIIDGPSQLDDYIHTAVKVSGESPVLIDQYLRDATEVDVDAVADGDDVVVAGILQHIEEAGIHSGDSACSIPPYSLPASIIEEIKSQTDKLARALKVQGLMNIQFAVKGDKVYLIEVNPRASRTVPFVAKADGRPVAQVAARVMAGEKLRNLPEISWPEGYTAVKEAVFPWARFPGVDPVLSPEMKSTGEVMGIDIDFPMAFAKAQLAAGNALPRAGTFFISVKDSDKAQIVEPIKALTDLGIKLVATDGTARYLQSKGVPVERVNKVREGRPHIVDLIKDGAISLVVNTTEGWQSLQDSASIRSSVVLAPVPYFTTAAAAIVAAEAIVAIKARELEVRSLQSYHSMKHA

SEQ ID NO: 25373 - protein, 513 aa, Picea abies
MAGGMAVSRPKQGRAELYEGHITAYVILACIVAATGGSLFGYDLGVSGGVTSMDDFLKKFFRHVYERKQHHLRETDYCKYDNQLLTLFTSSLYLSGLVATFGASYITRSKGRRVSIIIGGLSFLLGAILNAAAKNLGMLIVGRILLGAGVGFSNQSVPLYLSEMAPAKVRGGTNNLFQLKTCLGIFVTNVINYFTNKLHPWGWRLSLGLAVIPALLMSIGGYFLPETPNSLVEQGRLQEGRQILEKIRGTKNVQAEFDDLVEASDVARAVKHPFRNLLQRRNRPQLVMGTCIPAFQQLTGNNSFLFYAPVIFQSLGMGNDASLYSAIMTGAVITFGALVSMFTVDRVGRRFLFMEGGTQMIVCHVIISILLKSNFGKGEKIPTGYGVGIVLLICIFYLLAYGWLWGPLSWLVCSEIFPMESLVVCVNLFFTAVIAQSFLALLCHLKYGIFLLFGGLVFIMSVVIYFFLPETKNVPIEEMRFQWAKHWYWKRFMDEYMDNDDENEKGNMTKAAA

SEQ ID NO: 25374 - protein, 516 aa, Arabidopsis thaliana
MAYASRIINHSKKLKDVSTLLRRENAATIRYYSNTNRAPLNREVTGVHYFFNYEIKSKQCNGKANIWKRIFMVQSHSLTLCGGYLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDIEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 25375 - protein, 521 aa, Rhizobium leguminosarum bv. viciae 3841
METVFPLTTFADLGLSQKVLSAVTDAGYTIPTPIQAGAIPFALERRDICGIAQTGTGKTASFVLPMLSLLEKGRARARMPRTLILEPTRELAAQVAENFEKYGKNHRLNVALLIGGVSFEDQDRKLERGADVLICTPGRLLDHFERGKLLMSGVEILVIDEADRMLDMGFIPDIERIAKMIPFTRQTLFFSATMPSEIQKLADRFLQNPERIEVAKPASAAATVTQRFVASHGKDYEKRAVLRELVRAQTELKNAIIFCNRKKDVADLFRSLERHGFSVGALHGDMDQRSRTMTLQSFRDGNLQLLVASDVAARGLDIPDVSHVFNFDVPIHSEDYVHRIGRTGRAGRSGAAFTLVTKRDTKFVDAIEKLIGQKVEWLSGDLTSLPPPAEDSRDSERPRRNSRERGARDGAGRDRAPRENGDKDRGRGRGNRAAASHKSDIDIQDNGVDVIEAAPVKADIVKNERKAEQKPQNNARNNRPYPANDDSRDRRRHRDHDDGPTPVGFGDDIPAFMLIAGSAKV

SEQ ID NO: 25376 - protein, 545 aa, Oryza sativa (japonica cultivar-group)
MEGTGEMREVGRETLHGGVVQSVSETDEYKEKTIDSEKDGQFRVQPRWRKFLAHVGPGALVAIGFLDPSNLETDMQAGADFKYELLWVILVGMVFALLIQTLAANLGVKTGRHLAELCREEYPHYVNIFLWIIAELAVISDDIPEVLGTAFAFNILLKIPVWAGVILTVFSTLLLLGVQRFGARKLEFIIAAFMFTMAACFFGELSYLRPSAGEVVKGMFVPSLQGKGAAANAIALFGAIITPYNLFLHSALVLSRKTPRSDKSIRAACRYFLIECSLAFIVAFLINVSVVVVAGSICNANNLSPADANTCGDLTLQSTPLLLRNVLGRSSSVVYAVALLASGQSTTISCTFAGQVIMQGFLDMKMKNWVRNLITRVIAIAPSLIVSIVSGPSGAGKLIILSSMILSFELPFALIPLLKFCNSSKKVGPLKESIYTVVIAWILSFALIVVNTYFLVWTYVDWLVHNNLPKYANGLISVVVFALMAAYLVAVVYLTFRKDTVATYVPVPERAQAQVEAGGTPVVDASAADEDQPAPYRKDLADASM

SEQ ID NO: 25377 - protein, 258 aa, Zea mays
DTVFGHGFLTKDGMKMGKSLGNTLEPKDLVERFGADAVRYFFLREVEFGNDGDYSEERFINIVNAHLANTIGNLLNRTLGLLKKNCKSVLAFDSIAAADGGLFRNKIENLVDKAKHQYENLLLSSACETVLEIGDLGNLYIDEQAPWSCFKQGGESAEKAAKDLVLILETMRIIAITLSPITPSLSLRIYTQLGFTEDQFRVLRWEDTKWGGLKAGQVMSEPKPVFARIETEVEEEAQASSKAAKGGKKARRKGLVEA

SEQ ID NO: 25378 - protein, 195 aa, Glycine max
MKALTLASLLASFSFTELTSYLACFILLLLLLEQISYIVKKGSIPGPSLVLPFLGNAIPLVRNPTKFWDLQSSFAKSTPLGFSANYIIGNFIVFIRDSELSHKIFSNVRPDAFRLVGHPFGKKLFGEHNLIYMTGQDHKNLRRRIAPNFTPKALSTYTSLQQIIILNHLKSWVSQAQAQGSYSIPLRILARDMNL

SEQ ID NO: 25379 - protein, 405 aa, Oryza sativa (japonica cultivar-group)
MAGNSCAETFPALSDDHLISALTYSTADHHDLVDAAPAVASQPNEDVWDGPCTATGAACEPCSLTLHFLRNTCGLSEDEAAAAAARVRLRSTKKAHAIVALFRGIGFSAADIARLVTSNPSLLSYRADATLMPKIEFFRRELGLTDAEIRRLVLANPYRVLRYSLKRCIRPNYLILRDLLGSDKNVTAAVLQSTDLIHGDVRGILLPKIKILQDYGATNDVIVKLVTTHPRALMHRASRFEESLAAMKELGVRPSSGMFPYSFGLFARLHPRKWKGRMDNFLSLGWTKEQVIEAFVRHPYCMSVSNDKVKLIWQFLAKKLRWTTDYVARSPMVLSFSYDKRILPRCTVLNLLASRGIFNRDIKTSHLVLGEKKFKEKYVTPYQDEIPEVLEAYSSVAESRVPVYK

SEQ ID NO: 25380 - protein, 456 aa, Mesorhizobium loti MAFF303099
MLDKKTNIATDDPKAWLAQHGINEVECLVPDMNGVLRGKALPTAKFLKALEDRALYLPSSAFLVSIDGRYSGSIDEGFAYSDPDMRMVPDVSTLCLAPGAGAGKAYVFADAFHMDGRPWMASPRHVLRAVLDLYRQRGWRAVVAPEVEFYLTAPNPDPDRPLTAPVGANGRAEGVQHPYDMVALEEFEPVIRRVYDYAAAAGLPLDTLIHESGTAQLEINLLHGDALPLADQVLLFKRLTRQAAQQCGMHATFMAKPIAAQAGSSMHLHMSVVDEAGNALFASDDDADTEMFGHFIGGLQTYVPEIMPLFAPNVNSFRRIRPNHSAPANIEWSHDNRSCGLRVPAGGRSARRVENRLPGADSNPYLAIAGSLLAGYLGVQQKLARSAEASGNAYKIKSTLPKTMEEALDRFTACEPVRKLLGEDFSQTYLRVKSVELDLFQSVVTSWERDHLLLKV

SEQ ID NO: 25381 - protein, 219 aa, Candida albicans SC5314
MSSDKSNLLKKYKIVFLGDQSVGKTSLITRFMYDTFDETYAATIGIDFLSKTMYLEEGKTIRLQLWDTAGQERFRSLIPSYIRDSHVAVICYDITNKKSFDNLDKWIKDVKLERGDDVIIVLVGNKSDLASDKRQVSLDDVENLQIKIGAKFFIETSTKANHNVKLLFKKIAQSLPDFNQDSNDKSNDNNNNNNNNQSETIDITIDNTAPNPQGTSTCC

SEQ ID NO: 25382 - protein, 281 aa, Nocardioides sp. JS614
MEFTSPEGEQKYAALVRAASRAVVGLDFDGTLSPIVDDPAQARIHPEAREVLVELAAEVAAIAVITGRPARQALDLGGLEEVGDAVAAAGKDLFVFGQYGNERWSANRRRIISPRPPAGLATFLRDLPRALRTAGAADAYVEEKGLAYAVHTRRLPDPDAAFERLLPVLRELAGRNDLVLEPGRRVIEVRAPGMDKGQAVDRLVEEVGAGAFLFAGDDLGDVEAFEAVGALAKNGLPTLLVCSASFEQSALVELSDVVVDGPEGVLELLRRLTADARAARV

SEQ ID NO: 25383 - protein, 577 aa, Arabidopsis thaliana
MSFWLSLIFCFFTFASSSPPDDPVNCEFGNTMCTVTNSYGAFPDRSICKAAKVEYPRTEAELVSIVAAATRAGQKMRVVTRYSHSFPKLVCTDGKDGTLISTKFLNHVVTTNPEAKTLTVESGVTLRQLIEEAAKFDLALPYAPYWWGLTVGGMMGTGAHGSSLWGKGSAVHDYVTEIRLVSPGLVSDGYVKVQVLSETIDPEEFRAAKVSLGVLGVISQVTFELQPMFKRSLNYVMRNDSDFGDQAVSFGERHEFADFLWLPSQGKVVYRMDGRVPLNTSGDGLFEFFPFRSQLSLVLAIDRSLEESEESLEDANMKCVRAKLVSSSMFLMSYGVTNNGLIFTGYPVIGMQNHMMSSGSCLDSRQDGLITACPWDPRIKGQFFHQTTFSVSLTNVKSFINDIKALVKIEPKSLCVLEGSNGILIRYVTSSLAFLGKEEKALDFDLTYYRSKNDPLAPRLYEDYIEEIEQMAIFKYNALPHWGKNRNLAFDGAIRKYKNANAFLKVKEKFDSLGLFSTEWTDQILGLKGNVTIVKQGCALEGLCICSEDSHCAPTKGYLCRPGKVYREARVCTRVSS

SEQ ID NO: 25384 - protein, 335 aa, Arabidopsis halleri subsp. gemmifera
MPSKKEYHKTLNKMKTNLFLFLIFSLLLSFSSAEQCGRQAGGALCPNGLCCSEFGWCGNTEPYCKQPGSQSQCTPGGTPPGPTGDLSGIISSSQFDDMLKHRSDAACPARGFYTYDAFITAAKSFPGFGTTGDTATRKKEVAAFFGQTSHETTGGWASAPDGPFSWGYCFRQEQNPGSDYCEPSATWPCASGKRYYGRGPMQLTWNYNYGLCGRAIGVDLLNNPDLVANDAVIAFKAAIWFWMTAQPPKPSCHAVIAGQWQPSAADLAAGRLPGYGVITNIINGGLECGRGQDGRVADRIGFYQRYCNIFGVNPGGNLDCYNQRSFGNGLLNAAI

SEQ ID NO: 25385 - protein, 532 aa, Debaryomyces hansenii CBS767
MNLNKIPHNGRVAVIGGGISGLSFSYFLNKLRPDIKINIFESQNQPGGWIKSEYLQLKNEKQKVLLEKGPRTLRGVSDGSLLIIDVLRNLNQSSKIEVMAHDSIANRKYLLSRENILVQVPNSIKSFGKFLSSGIVNGILKGMLLEPFAKGRISPNEDESVESFITRRFGSSKLSDNILSGVLHGIYAGDISKLSVRSVLPSLVSLETENGSIIKGMIKKIRETPPTKELSASLASYQDKISSNSNLLELASTLKKYPMVRLKDGLQTLPTSMAKYLELQPNVEIFYNSEIQEINAKTPHIVVNNQVQKYDHIRSTINTNTLSKLITNDEIKAVLPLEYVSIFLVNIYCRKPILIPSDKNGFGFLVPKVNQNHESLLGIMYDSDIERHVKPLYLNEKISTDNYNKITLMMGGHYYNKIGIPSNNLNVKAIKNVLSSILNTSLKDHNLIFRNEAQMTDKSLSLEENDIMISYNLHRDCIPQYNVGYEKQKQKLYEIMNQQCNGKFSLGGMGFAAGMGVPDCVMNGLVDSLEIA

SEQ ID NO: 25386 - protein, 477 aa, Arabidopsis thaliana
MALTTKPHHLQRSFLSPSRVSGERYLESAPSCLRFRRSGVQCSVVAKECRVKGVKARQIIDSRGNPTVEVDLITDDLYRSAVPSGASTGIYEALELRDGDKSVYGGKGVLQAIKNINELVAPKLIGVDVRNQADVDALMLELDGTPNKSKLGANAILGVSLSVCRAGAGAKGVPLYKHIQETSGTKELVMPVPAFNVINGGSHAGNSLAMQEFMILPVGATSFSEAFQMGSEVYHTLKGIIKTKYGQDACNVGDEGGFAPNVQDNREGLVLLIDAIEKAGYTGKIKIGMDVAASEFFMKDGRYDLNFKKQPNDGAHVLSAESLADLYREFIKDFPIVSIEDPFDQDDWSSWASLQSSVDIQLVGDDLLVTNPKRIAEAIKKQSCNALLLKVNQIGTVTESIQAALDSKAAGWGVMVSHRSGETEDNFIADLSVGLASGQIKTGAPCRSERLSKYNQLLRIEEELGNVRYAGEAFRSP

SEQ ID NO: 25387 - protein, 222 aa, Nostoc punctiforme PCC 73102
MKYNSIDELFRNNQAWVAEKLAIDPTYFQELSKGQTPPFLYIGCSDSRLPLTNLTRTEPGELFVHRNIANQVSLTDINFLAVLEYAILHLKVEHIIVCGHYDCGGIKAALEGRTIGILDNWVNPIRELYLHKQEEIDALPTREERLNRLAEINVVAQVKNLYQTSIMRQALYERKAPMVHGWVLDIRTGLIKDLNVSTVQWQLHICPLLLEFRLYAMLKNES

SEQ ID NO: 25388 - protein, 189 aa, Pyrococcus horikoshii OT3
MMIVIMDNGGQYVHRIWRTLRYLGVETKIIPNTTPLEEIKAMNPKGIIFSGGPSLENTGNCEKVLEHYDEFNVPILGICLGHQLIAKFFGGKVGRGEKAEYSLVEIEIIDEDEIFKGLPKRLKVWESHMDEVKELPPKFKILARSETCPIEAMKHEELPIYGVQFHPEVAHTEKGEEILRNFAKLCGEL

SEQ ID NO: 25389 - protein, 308 aa, Pyrococcus horikoshii OT3
MDWGRFVEEKVREIRETVGDSKAIIALSGGVDSSTAAVLAHKAIGDRLHAVFVNTGFLRKGEPEFVVKTFRDEFGMNLHYVDAQDRFFSALKGVTDPEEKRKIIGRVFIEVFEEVAKKIGAEYLIQGTIAPDWIESQGKIKSHHNVGGLPEKLNLKLIEPLRDLYKDEVRELAKFLGLPEKIYNRMPFPGPGLAVRVIGEVTPEKIRIVREANAIVEEEVERAGLRPWQAFAVLLGVKTVGVQGDIRAYKETIAVRIVESIDGMTANAMNVPWEVLQRIAFRITSEIPEVGRVLYDITNKPPATIEFE

SEQ ID NO: 25390 - protein, 893 aa, Blastopirellula marina DSM 3645
MAKKKAAAKSAKMVYYFGKTKTEGKGVSKAILGGKGLNLAGMTNIGLPVPPGFTITTEVCDLYYKGGEKLPKAMQEEVAKNIATLEKELKKKLGDDKNPLLVSVRSGAAVSMPGMMNTILNLGLTDASVVGLANATNNERFAYDAYRRLINMFGDVVMGMDHHDFEEAFSKIKMKYGAALDTDVPAQGMIELCEAYKAVYKKATGEDFPQDPLKQLELSIEAVFKSWNTSRAVRYREVENIRGLLGTAVNVQSMVYGNMGDDSGTGVAFTRNPSNGENKFYGEFLINAQGEDVVAGIRTPQPVSEMSKWNRAVYKQLIEIKDTLETHYKDVQDIEFTIERGELFMLQTRNGKRTGAAAVKIACDMVKEGLIDEMTALERIPANDLTQLLLPSFDAAGKASATVLTRGLPASPGAAVGALAFSAEEAVERTHAGEKVLLVRKETSPEDIDGMHSAAGILTSTGGMTSHAAVVARGWGRCCVAGAGEIEIDAKAKKIKVGGKTYGPKDILSLDGSTGEVMLGSVSTSEPKLSGDFSKVMKWADEYRTLGIRTNADTPADSQRARDFGAEGIGLCRTEHMFFEDERIGLMREMILAEDEATRRKALGKLLPFQRKDFVGIFTAMKGLPVTVRLLDPPLHEFLPHDKKAQAEIAKEIGVSADKVRSRVAQLHESNPMLGHRGCRLSVTYPEILEMQVTAIVEAAIECKKKRIDAQPEIMIPLVGTAAELKLLRGMAEATIEKVKADANFTGELPILIGTMIEIPRAALTADEVAEHAEFFSFGTNDLTQMTFGFSRDDINTFLPDYLHRELLPVDPFQSLDTSGVGQLVEMGVTKGRSTSKKLKVGICGEHGGDPASIDFCHRVGLDYVSCSPFRVPIARLAAAQAAIRNGGKKKKK

SEQ ID NO: 25391 - protein, 679 aa, Pyrococcus horikoshii OT3
MLNGIGMGVRVVCPYCGFGCNLLIDPKSRRVKPYPGEPNRGKLCPKGLYALEHVFSKDRLKHPLKKEGESFRRISWEKAISEISTKLKEIIEDYGPGSIAFIASSKVTNEENYLIQKIARLLGTNNVDNCARLCHESSVHALKLTLGDGVQTNPYSDLERFGAIMIWGYNPAETHPVVMQYILGAKRRGGKIIVIDIRETLTMRFADYRLVIKPGTDITLANAIMNVIIEGNLYNKEFVESRTTGFSEIRMGVKKYTPEYAEKVTGVPAELIREVAEVFAKAGSGAIMWGMGITQQISGVENVLALVDIALLLGYFGEKGGLYPMRGQNNVQGAAYMGTLSEFLPGYIPLSDSKFRRKVAKMWGVEDLPTERGFYLTEYWDAILKGDLKALYIVGENPAVSDANALKVRKALTKLDLLVVQDLFLTKTARFAHYILPAAAFCEKEGSYMNSERRIQWSFKVCDPPGESKPDWEILVMLARALGLKGFDYSKVEDITREYFKLFPALRNRSIEELKARGIIIPAPRLYVDSFNTHDGKARFVAVEQIMPWEEPNGEYPLILTTVRLINHYNTGEMTRRSPSLAKMSGESVVFISREDAREYGIEDGDYVIVETRRGSLRLKAKIAKIQKGVIAIPFHFDANLLTNDALNKAGTPEFKFSAARIRKIEKENYGTKCDEGKG

SEQ ID NO: 25392 - protein, 164 aa, Cucumis sativus
GTADAVRQFIWLFEDAKTKNVEHTLILSGDHLYRRDYMDFVQRHIDTNADITVSCIPMDDSRASDYGLMKIDDTGRILDFAEKPKGSDLEAMQVDTTVLGLSDEDARKNPYIASMGVYVFRTDLLLKLLTWSYPACNDFGSEIIPAAVKDYKVQAYLFNDYWED

SEQ ID NO: 25393 - protein, 516 aa, Nocardioides sp. JS614
MSDAATDRDEAMGPDQALGRDDALARLRAMQAADLPVHGGRTLAYVYDSGLPDVDRIGRAAVAAYAGSNGLDPTAFPSLLQMENELVGFAADLLDAPGTCVGTVTSGGTESVLLAVQGARDSRPDLARPRMVLPATAHAAFHKAAHYFGVEAVLVPVGPDFRADPAAMAAAIDEDPDRTVLVVASAPSYAHGVVDPVTEVAAAAAARGIRCHVDACIGGWVLPYATRLGRSVPAWTFAVEGVTSISVDLHKYGYAPKGTSVLLHRTAGLRRPQYFASAAWPGYTMLNSTLQSTKSGGPLAGAWAVVQSLGDTGYELLSRETFEAVDAIVAGLADIPALVLAAVPDSTLVAIATDDSCDAFTVCDEMATRGWYVQPQLSYAGHPPTIHLSVSAATNAHVDDFLAALAASVAAAQAAGPVSVDPGIAEFIGALDPATLSDADFDGLLAAAGLVGGDAAAGLDLPERMAEVNAMLDLASPAMREALLVAFLDRLARPRRQGQGQRVAVDPAKASTESSE

SEQ ID NO: 25394 - protein, 394 aa, Xanthomonas campestris pv. vesicatoria str. 85-10
MDSTLPYAGGYSRRSQDIAPFHVMSLLARANALEQAGHDVIHLEIGEPDFTTAAPIVAAGQAALAAGHTRYTAARGLPALREAIAGFYAQRYACNLDPERILVTPGGSGALLLASSLLVDPGKHWLLADPGYPCNRHFLRLVEGAAQLVPVGPDSDYQLTPALVESAWNADSVGALVASPANPTGSVLSRTQLAALSQALHARGGHLVVDEIYHGLTYGLDAHSVLEVDDGAFVLNSFSKYFGMTGWRLGWLIAPPDAVPELEKLAQNLYISASTIAQHAALACFTPESIAIFEARRGEFQQRRDYLLPALRALGFEIAVEPQGAFYLYADISGFSDDAQAFCAHFLETEHVAFTPGIDFGHYRANQHVRIAYTQSLPRLQQAVERIARGLKRL

SEQ ID NO: 25395 - protein, 308 aa, Nocardioides sp. JS614
MKIATVGVHVLDTHVLGIESIPARSDGQLVETIRMSPAGTAGGTAVVLSRLGAEVRSFGAVGADPIGSTLLALLEREGVDVTGLVRKPDQQTSASVLPVRPNGDRPAWHCIGANGAFTLDDLDLAALDGCTHVHLGGPEFLGGEAAGKLLEHARSLGATTSLDLLAPGDPDLLAWVADALPHTDYLLPNDEQVLGFTGASSIADGARALVAAGAGCVAVTQGSRGALVVTADEVVEVPAYAIEVVDTTGCGDAFSAGFLRGLSLGRDLRDAAELGCATAAQVAQGLGTDAGDYSLDSVLAFAGSTATR

SEQ ID NO: 25396 - protein, 232 aa, Arabidopsis thaliana
MFVFCLSLEALINQTRQQTKYCLGLASQSSKKGNGNHYNNGGLDEEETIEKMRKEIESSQENALSLCTEKVLLARQAYDLIDSHVKRLDEDLNNFAEDLKQEGKIPPDEPSVLPPLPIVPKAEKRKSFYGTPQPKKIDYRDRDWDRDRDFELMPPPGSNRKDLMPIEEQPIDPNEPTYCVCHQVSFGDMIACDNENCQGGEWFHYTCVGLTPETRFKGKWYCPTCRLLPQSH

SEQ ID NO: 25397 - protein, 267 aa, Triticum aestivum
  misc_feature (100)..(100): Xaa can be any naturally occurring amino acid
  misc_feature (237)..(238): Xaa can be any naturally occurring amino acid
  unsure (1)..(267): unsure at all Xaa locations
MVKKLGLTSLIFSSKQVDSAASTSGAAPSSVASSSSMSATSWQWPSCKQPRTLSFRQQQHHQTAYKTMKLGLLARLRRGLVLLQTPSPRSTTASPRRPRXASGLVEATDRETVIRALRSGRLFFEPHATPATSSSILDEAKLKVKDSDTTTVTTCCGSGKVDKTAPFEGATALTMDSSNPYRDFRASMEEMVMSHGVKDWCWLEKMLGWYLRANGKSTHGLIVGAFVDLLVALSDTXXRSSRTRQHKRSFSLGAPTDQGEEDYRAHW

SEQ ID NO: 25398 - protein, 213 aa, Erwinia carotovora subsp. atroseptica SCRI1043
MKEIETLIANNQLWSKTMVEEDPGYFERLAQAQRPRFLWIGCSDSRVPAESLTSLEPGELFVHRNVANLVIHTDLNCLSVVQYAVEVLEVEHIIICGHYGCGGVQAAVENPELGLINNWLLHIRDLWYKHSSLLGELPPEQRLNTLCEINVVEQVYNLGHSTIMQSAWKRGQKVTIHGWVYGIQDGRLRDLEVTATNRETLEQRYRRAISTLS

SEQ ID NO: 25399 - protein, 344 aa, Nostoc punctiforme PCC 73102
MVQERTLPTFNPATTQITKEEGLWLYEDMVLGRLFEDKCAEMYYRGKMFGFVHLYNGQEAVCTGVVQSMRPGEDYVCSTYRDHVHALSAGVPAREVMAELFGKATGCSKGRGGSMHMFSAEHRLLGGYAFVAEGIPVAAGAAFQSKYRREVLGDKNADQVTACFFGDGAANNGQFFETLNMAALWKLPILFVVENNKWAIGMSHERATSQPEIYKKASAFNMVGVEVDGMDVLAVRAVAQEAVARARAGEGPTLIEALTYRFRGHSLADPDEMRSKAEKEFWFARDPIKKLAAYLLEQNLANEGEIKAIDRKIQDVIDEAVKFAESSPEPDPSELYRFVFAEDE

SEQ ID NO: 25400 - protein, 289 aa, Nostoc punctiforme PCC 73102
MFSIAVQQQQYKTYILSDEAAGSQLEVVPERGGIITRWRIQGQEIFYLDTERFTHPDLSVRGGNPILFPICGNLPDNTYTHNGQQYTLKQHGFARELPWKVTEQETRDKASLTVVLDSNEQTKAVYPFDFQLAFTYELQGNTLEVRQQYKNLSSTPMPFSAGFHPYFLCGDKTQLEVEIPSKQYQDNQTKEFHSFDGNFDFSRDEIDFAFGQLTSHSATAIDRSRKLKLTLDYDDFSTYLVFWTVKGKEFYCLEPWSATRNSLNTGDNLTVLAPGASHTASVRLTANFF

SEQ ID NO: 25401 - protein, 111 aa, Rhizobium leguminosarum bv. viciae 3841
MSGIHEFIDNEIKTNDVVLFMKGTPQFPQCGFSGQVVQILDYIGVDYKGVNVLADSEIRQGIKEYSNWPTIPQLYVKGEFVGGCDIVREMFQAGELQQHLQENGIAVRAAS

SEQ ID NO: 25402 - protein, 235 aa, Glycine max
SARVPLLGGLLSVWYSDFFQAQTHLVAPFDQYLHRFPAYLQQLSMESNGKTITSDGSSAKYTTGPILFGEPCTNAQHSFFQLVHQGTKLIPTDFILAAKSHNPVSDNLHQKMLASNYFAQAEALMVGKTDDQVRAEGTPEELVPHKRFLGNRPTTSILVGGAIGPAELGALIVYYEHLTFTEGAIWDINSFDQWGVELGKVLAKKILKELDEAGNGEGHDASTGGLIGAFKKYGN

SEQ ID NO: 25403 - protein, 335 aa, Pyrococcus horikoshii OT3
MDKLKIIMEKGTERLKRGFAKMVKGGVIMDVTNAEQARIAEEAGAVAVMALHKVPADIRKAGGVARMAPVEKIQEIMDAVTIPVMAKCRIGHEAEARILEALGVDMIDESEVLTPADPFFHIYKKKFTAPFVCGARNLGEAVRRIWEGAAMIRTKGEAGTGNIIEAVRHVRLVNENIRLIQRMTDEEIYGVAEKFAEPYLRLAFSVKEISGLPKRVLENEPIYEGFTYREIVEDIYKILLEIKKLGRLPVVNFAAGGVATPADAALMMAMGMDGVFVGSGIFKSSNPPKMARAIVEAVNHWDEPDVLAEISREIGEPMRGQAIEELQVRMEERGI

SEQ ID NO: 25404 - protein, 309 aa, Rhizobium leguminosarum bv. viciae 3841
MADLQATLDSIYADIQPRIGEGKVADYIPELAKVDPQQFGMAIVTVDGKVYRVGNADTAFSIQSISKVFMLTLALGKVGEGLWKRVGREPSGSAFNSIVQLEHESGIPRNPFINAGAIAVSDVVMAGHAPREAIGELLRFVRYLADDESITIDDKVARSETQTGYRNFALANFMRAYRNLDHPVDHVLGVYFHQCALSMSCEQLARAGLFLAARGSNPTTGHSVVSPKRARRINALMLTCGHYDGSGDFAYHVGLPGKSGVGGGIFAVAPGIASIAVWSPGLNKVGNSQLGAAALEMLAARTGWSVFGD

SEQ ID NO: 25405 - protein, 437 aa, Ashbya gossypii ATCC 10895
MAISKVYARSVYDSRGNPTVEVEVTTENGTFRSIVPSGASTGVHEALELRDGDKSKWLGKGVTKAVSNVNDIIAPALLSANVDVKDQKAVDALMLTLDGTPNKSKLGANAILGVSMAVAKAAAAEKKVPLYQHLADLAGSSTTPFVLPVPFLNVLNGGSHAGGALALQEFMIAPTGAESFSEALRMGSEVYHNLKSLTKKRYGASAGNVGDEGGVAPNIQTAEEALDLIVDAIKAAGYEGKIDIALDCASSEFFKDGKYDLDFKNPESDSSKWLSGQELADLYKKLVEKYPIVSIEDPFAEDDWEAWSHFYKNAGVQIVADDLTVTNPTRIATAIQKKAADALLLKVNQIGSLTESIQAAKDSFDATWGVMVSHRSGETEDTFIADLVVGLRTGQIKTGAPARSERLAKLNQLLRIEEELGSKAIYAGKKFHNANKL

SEQ ID NO: 25406 - protein, 311 aa, Ustilago maydis 521
MASIFQQASKAAKGKRKADAHDEDAVAAPIRRNKQRVLMLPSRGVTSRMRHLINDLESLMPHAKKDSKLDSKSQLHLLNELAELNNCNNALYFEARKREDLYMWASKTPNGPSAKFQVQNIHTMDELKMTGNCLKGSRPILSFDKEFDEKPHWTLVKEMFTQMFGVPKGARKAKPFVDHVISFSIVDNKIWFRNYQIVESDPGATAMAKVEEAQDGKKKAGGAKDASRQPKLVEIGPRMVLSPIRVFEGSFGGATVFENPEYISPNAIRHMVRKQKGNKYADRVNQQESFRTKKDRLKPREDALSRNKVFA

SEQ ID NO: 25407 - protein, 865 aa, Gossypium hirsutum
MLSHLLHAVAGDDNGNKKMKPEKIKGTVILMKKNVLDFNDFHASFLDGFHELLGKRVSFQLISSQHVDADNGLQGKLGKEAYLEDWNSTETSAVAGESKFDVNFDFEEEIGLPGAFLIKNNHHSEFYLKTLTLEHVPGHGRFHFVCNSWVYPDKKYDNPRVFFTNKTYLPHDMPKPLLQYREQELMALRGNGQGELQEWDRVYDYAYYNDLGNPDKGPEYARPVLGGSAKYPYPRRGRTGRPPTKSDPKTESRIPLLMSLNIYVPRDERFGHLKMSDFLAYALKSIVQFIVPELQDLTDKTHNEFDSLEDVLELYYGGVKLPSGPLLDNIINNIPLEMLKEIFRTDGAQLLKFPVPQVIQDSKTAWRTDEEFAREMLAGVNPVIIRLLQEFPPTSNLDPKVYGNQNSAITKEHIEHNLEGLTVEEALRTNRLFILDHHDSLMPYLRRINTTTTKTYASRTILLLRNDGTLKPLVIELSLPHPNGDQLGAVSKVYTPAEHGVEGSIWQLAKAYVAVNDSGVHQLISHWLNTHAAMEPFVIATNRQLSVVHPIYKLLYPHFRDTMNINAFARQILINGGGVLELTVFPGKYAMEMSSVIYKSWNLLDQALPRDLKKRGVAVDDKSSPHGLRLLIKDYPYAVDGLEIWFAIEKWVRDYCSFYYKTDEMVQQDPELQAWWKELREEGHGDKKDEPWWPKMQTREELIDSCTIIIWVASALHAAVNFGQYPYAGYLPNRPTISRRFMPEKGTPEYTELESNPDKVFLKTITAQLQTLLGISLIEILSRHSSDEVYLGQRASPEWTSDETPLAAFDEFGKRLTGIEERIVEMNNDEQLKNRVGPVNMPYTLLYPTSEGGLTGKGIPNSVSI

SEQ ID NO: 25408 - protein, 129 aa, Brassica napus
  misc_feature (3)..(3): Xaa can be any naturally occurring amino acid
  misc_feature (7)..(7): Xaa can be any naturally occurring amino acid
  misc_feature (104)..(104): Xaa can be any naturally occurring amino acid
  unsure (1)..(129): unsure at all Xaa locations
SGXVRIXLECDKAKEEAKEDGDRRPRRLVEEPVWRTYCNGKKCGFAARRECGEKEKKVLKALEMVSMGAGVLPETEETSGGGGGGGGGEIMYMRAKFERIVGSXDSEAFYMMNPDSNGAPELSIYLLRI

SEQ ID NO: 25409 - protein, 131 aa, Haemophilus influenzae
DFCQRIISGEWKGYTGKAITDVVNIGIGGSDLGPYMVTEALRPYKNHLNMHFVSNVDGTHIAETLKKVNPETTLFLVASKTFTTQETMTNAQSARDWLLKAAKDESAVAKHFAALSTNAKDVEKFGIDTNN

SEQ ID NO: 25410 - protein, 131 aa, Haemophilus aegyptius
DFCQRIISGEWKGYTGKAITDVVNIGIGGSDLGPYMVTEALRPYKNHLNMHFVSNVDGTHIAETLKKINPETTLFLVASKTFTTQETMTNAQSARDWLLKAAKDESAVAKHFAALSTNAKDVEKFGIDTNN

SEQ ID NO: 25411 - protein, 287 aa, Erwinia carotovora subsp. atroseptica SCRI1043
MSQKEIWYETLHANFGQYFSVDRVLYHEKTDHQDLIIFENDALGRVMALDGVVQTTERDEFIYHEMLTHVPLLSHGNAKRVLIIGGGDGGMLREVSRHHGVEQITMVEIDAGVVEFCRQYLPNHSAGSYDDPRFNLVIDDGVNFVRQCSEKFDVIISDCTDPIGPGESLFTSDFYQGCARSLNEGGIFVAQNGVCFLQQDEAIGSHKKLSHYFNDVSFYQAAIPTYYGGIMTFAWASNNPALRQMDIVTLRQHFAQSGITCRYYTPDVHIGSFALPQYLLSALQNAQ

SEQ ID NO: 25412 - protein, 85 aa, Zea mays
  misc_feature (7)..(7): Xaa can be any naturally occurring amino acid
  misc_feature (9)..(9): Xaa can be any naturally occurring amino acid
  misc_feature (15)..(15): Xaa can be any naturally occurring amino acid
  misc_feature (17)..(18): Xaa can be any naturally occurring amino acid
  misc_feature (21)..(21): Xaa can be any naturally occurring amino acid
  misc_feature (25)..(26): Xaa can be any naturally occurring amino acid
  misc_feature (28)..(30): Xaa can be any naturally occurring amino acid
  misc_feature (32)..(32): Xaa can be any naturally occurring amino acid
  misc_feature (37)..(37): Xaa can be any naturally occurring amino acid
  misc_feature (39)..(39): Xaa can be any naturally occurring amino acid
  misc_feature (47)..(47): Xaa can be any naturally occurring amino acid
  misc_feature (70)..(72): Xaa can be any naturally occurring amino acid
  misc_feature (74)..(75): Xaa can be any naturally occurring amino acid
  unsure (1)..(85): unsure at all Xaa locations
LEEEVVXAXSMLSSXAXXVPXRSQXXMXXXFXGLKSXAXFPVTRKAXNDITSIASNGGRASCMKVCPPVXXXKXXIFLPAPPLPS

SEQ ID NO: 25413 - protein, 228 aa, Novosphingobium aromaticivorans DSM 12444
MPRLILIRHGQSQWNLENRFTGWWDVDVTEKGAAEAFAAGKLLKDKGVLPTLAFTSLQTRAIKTLHLALEAAGRLWVQEDKDWRLNERHYGGLTGLDKAETAAKHGDEQVKVWRRSFDVPPPPLEAGSEFDLASDPRYDGIAVPATESLKDTIARVLPCWEEKIAPALRAGETVIVSAHGNSLRALVKHLSGISDEDITGLEIPTGQPIVYELDNDLAQVERYYLSER

SEQ ID NO: 25414 - protein, 230 aa, Photobacterium sp. SKA34
MKNTRIVLLRHGQSVWNKENRFTGWANVSLSELGETEARNAGIKLKENGFNFNFCYTSMLDRAIKTSNLALEQLDSLWIPVEHDWQLNERHYGDLQGLNKTETAEEFGDEQVHIWRRSYDIEPPQVSEDSFFYPGNDRRYQELQHSQLPHGESLKDTYDRVIPFWNENIVPNVKQGSDILIAAHGNSLRALIKYLDNIPDDKITELEIPTGAPLVYEFNKQMKPVQSYYL

SEQ ID NO: 25415 - protein, 369 aa, Oryza sativa (japonica cultivar-group)
MCMTLIMPGAPDVGSYYGEQWAPLAMSSLSSLFSYSPPGTAKYAAALASPSQQVSTTMPELETEGELKTLPAPMTIETTAAAAAAARSPEIVKVRSVWAHNLDEEANLIESLFPSFRLAAVDTEFPGTVHRPSAPAYTLTRKQKYALLKKNVDELHLVQLGLTLFDAGGRLPDLGTGGAARYVWEFNFREFDLRRHAHAPESIALLRSKGVDFDRTRRGGVDAAAFGPRLRRWLRAGLGRAGLVTFSGAYDLAYMLKMLYGGGGGGYRLPGDAATFEFVVRAVIGRTLYDVGKMARHCPGDMRGGLERVAGKLGVRRAVGEAHQAGSDSLLTSQMFMRMRERYFDDQDALTAVAGINFGYLNFTSCEYT

SEQ ID NO: 25416 - protein, 404 aa, Mesoplasma florum L1
MNYNLKKTLKDINVKGKKVLVRVDFNVPLKDGVITDDNRIQAALPTIKYLVENGAKVILFSHLSRIKSEDDKKTKSLAPVAKRLEEVLAQSVNFVNQTRGTELETAINALNEKEVLLFENTRFEDVKDGEVVKAESKNDPELGKYWASLGDVFINDAFGTAHRAHASNVGIASNISESALGFLVQNEIEMLGKGIDAPERPFVAILGGAKVSDKIGVIDNLLTKVDKILIGGGMTYTFHKAMGLEIGNSLLEADKVELAKEYLEKANGKIMLPVDSLCAPEYADVAPTLCGENVPAGMMGLDIGPKTIEMYEKELANAKTVVWNGPMGVSEFENFKAGTVAVCEAAAKRKADGGFTLIGGGDSAAAAIKLGFKDEFSWISTGGGASLEYMEGKELPGIAAIQNK

SEQ ID NO: 25417 - protein, 229 aa, Pyrococcus horikoshii OT3
MNVEEMKKIAAKEALKFIEDDMVIGLGTGSTTAYFIKLLGEKLKRGEISDIVGVPTSYQAKLLAIEHDIPIASLDQVDAIDVAVDGADEVDPNLNLIKGRGAALTMEKIIEYRAGTFIVLVDERKLVDYLCQKMPVPIEVIPQAWKAIIEELSIFNAKAELRMGVNKDGPVITDNGNFIIDAKFPRIDDPLDMEIELNTIPGVIENGIFADIADIVIVGTREGVKKLER

SEQ ID NO: 25418 - protein, 101 aa, Glycine max
QVIPWGDLDSLAMLQRQLDVDILVTGHTHQFTAYKHEGGVVINPGSATGAYSSITYDVNPSFVLMDIDGLRVVVYVYELIDGEVKVDKIDFKKTSTSHSAH

SEQ ID NO: 25419 - protein, 249 aa, Dechloromonas aromatica RCB
MCLIVVGWRVHPDYPLVVAANRDEFYARPTAALARWPDAPQVIGGLDLEAGGTWLGITGMGRFAAVTNVREPGVVKGLLSRGALTRNFLTSELTASEYASQIDYAQYSGFNLLLSDGESLVYCSNRDGQPRVLAPGVYGLSNQLLDSPWPKLLQARERFAEALPRLPDEPAFFDLLADQGIVDDKNLPSTGAPIEWERLLSAIFVKSENYGTRASTLVWQGANGDITIHEKSFGPFGQPLQSSVISTSV

SEQ ID NO: 25420 - protein, 131 aa, Haemophilus parainfluenzae
AFCYRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 25421 - protein, 164 aa, Oryza sativa (indica cultivar-group)
MPPRSLTLSRLPVAALGLPFSSCSPPPPRLRFPIAARRARSLATRASSSSPDSSFGSRMEDSVKRTLADNPVVIYSKSWCSYSMEVKALFKRIGVQPHVIELDQLGAQGPQLQKVLERLTGQSTVPNVFIGGKHIGGCTDTVKLHRKGELATMLSELDIDVNNS

SEQ ID NO: 25422 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDSSAVAKHFAALSTNGKAVAEFGIDTNN

SEQ ID NO: 25423 - protein, 131 aa, Haemophilus parainfluenzae
AFCERVISGEWKGYTGKAITDVVNIGIGGSDLGPYMVTEALRPYKNHLNMHFVSNVDGTHIAETLKKVNPENTLFLVASKTFTTQETMTNANSARDWLLAAAKDNSAVAKHFAALSTNGKAVAEFGIDTNN

SEQ ID NO: 25424 - protein, 174 aa, Triticum aestivum
  misc_feature (23)..(23): Xaa can be any naturally occurring amino acid
  unsure (1)..(174): unsure at all Xaa locations
MAPTVMASSATSGTPFQGLKSTXAGLPISRRSSSAGLSSVSNGGRIRCMQVWPIEGIKKFETLSYLPPLSTEALLKQVDYLIRSKWVPCLEFSKVGFVFREHNSCHGYYDGRYWTMWKLPMVWCTDATQVLNEVEEVKKEYPDAYVRVISIDNLRQVQCVSFIAFMPPGCEESG

SEQ ID NO: 25425 - protein, 368 aa, Xanthomonas campestris pv. vesicatoria str. 85-10
MKTRAAVAWGPHQPLTIEEVDLQPPRPGEVLVRLVATGICHGDAHALAHGHAGSFPAILGQEGAGVVEDVGIGVTSVRAGDHVIPLYMPECGVCKFCRSGRTNLCQAIRSSQERGLMPDGSSRFSLHRRPVLHHMGTSTFSEYTVLPEIAVARIHPDAPLEQACLLGCTVTTGVGAVLNSTHVRPGDCVAVFGLGGIGLSVIQGAVLAQAGRIIAVDIDPAKFALARKLGATDCLDPRDYGAPIQQVIVDLTDGGADHSFECIGDVGAMRAALECCHKGWGESVILGVAEDTQEISTRPFQLVTGRVWRGSAFGGVKGRSELPGYVERYLHGDIQLAPLITRTLALVDINQALADLRAARGIKSIVVY

SEQ ID NO: 25426 - protein, 251 aa, Persicaria hydropiper
AYNQFSSDIPVISLAGIDDVGGKREEICGKIVAACEDWGVFQVVDHGVDTQLVSEMTRLAREFFALPAEEKLRFDMTGGKKGGFIVSSHLQGEAVQDWREIVTYFSYPIKNRDYSRWPDTPEGWLKATEHYSEQLMGLACKLLGVLSEAMGLEAEALTKACVDMDQKVVVNYYPKCPQPDLTLGLKRHTDPGTITLLLQDQVGGLQATRDDGKTWITVQPVEGAFVVNLGDHGHFLSNGRFKNADHQAVVN

SEQ ID NO: 25427 - protein, 101 aa, Manihot esculenta
MATLGGIKEVEESANSVEIDNLARFAVDDYNKKQNALLEFKRVVSTKQQVVAGTMYYITLEVADGGQTKVYEAKVWEKPWLNFKEVQEFKPIGVAPSDSTA

SEQ ID NO: 25428 - protein, 255 aa, Oryza sativa (japonica cultivar-group)
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYALSQGIKVIACIGETLEQREAGTTMEVVAAQTKAIAEKISDWTNVVLAYEPVWAIGTGKVATPAQAQEVHDGLRKWLVTNVSPAVAESTRIIYRGSVNGANCKELAAKPDVDGFLVGGASLKPEFVDIIKSATVKSSA

SEQ ID NO: 25429 - protein, 274 aa, Glycine max
MHVSNGRQWLPTPEAADGLQSELPFEFQVLEIALEAVCTYLDSNVGDLERGAYPVLDELARNVSTKNLEHVRSLKSNLTRLLARVQKVRDEIEHLLDDNEDMAQLYLTRKWLQNQQFEEAHLGATTSNNFPNTSRSVRRLGSNRSESLVTCHYEDDNNVEDLEMLLDAYFMQLDGTRNKILSVREYIDDTEDYVNIQLDNHRNELIQLQLTLTIASFAIAIETMIAGAFGMNIPCNLYHIDGVFWPFVWITSAACVLLFLLILAYARWKKLLGS

SEQ ID NO: 25430 - protein, 635 aa, Saccharomyces cerevisiae
MSGARSTTAGAVPSAATTSTTSTTSNSKDSDSNESLYPLALLMDELKHDDIANRVEAMKKLDTIALALGPERTRNELIPFLTEVAQDDEDEVFAVLAEQLGKFVPYIGGPQYATILLPVLEILASAEETLVREKAVDSLNNVAQELSQEQLFSDFVPLIEHLATADWFSSKVSACGLFKSVIVRIKDDSLRKNILALYLQLAQDDTPMVKRAVGKNLPILIDLLTQNLGLSTDEDWDYISNIFQKIINDNQDSVKFLAVDCLISILKFFNAKGDESHTQDLLNSAVKLIGDEAWRVRYMAADRFSDLASQFSSNQAYIDELVQPFLNLCEDNEGDVREAVAKQVSGFAKFLNDPSIILNKILPAVQNLSMDESETVRSALASKITNIVLLLNKDQVINNFLPILLNMLRDEFPDVRLNIIASLKVVNDVIGIELLSDSLLPAITELAKDVNWRVRMAIIEYIPILAEQLGMQFFDQQLSDLCLSWLWDTVYSIREAAVNNLKRLTEIFGSDWCRDEIISRLLKFDLQLLENFVSRFTILSALTTLVPVVSLDVVTEQLLPFISHLADDGVPNIRFNVAKSYAVIVKVLIKDEAKYDALIKNTILPSLQTLCQDEDVDVKYFAKKSLAECQELLKN

SEQ ID NO: 25431 - protein, 321 aa, Pseudomonas fluorescens PfO-1
MNQLPIIDISPLYSDDQNAWPAVAEQIDHACREWGFFYIKGHPISAQRIASLLDHAQRFFALPEAEKLRIDITQTRHHRGYGAIATEQLDPDKPSDLKETFDMGLHLPADHPEVLAVKPLRGPNRHPAIPGWETLMEQHYLDMQALAQTLLRAMTLALGIERDFFDTRFNEPVSVLRMIHYPPRHTASSAEQQGAGAHTDYGCITLLYQDAAGGLQVKNVKGQWIDAPPIDGTFVVNLGDMMARWSNDRYRSTPHRVISPLGVDRYSMPFFAEPHPDTRIECLPGCQDAQHPAKYPTTTCAEFLLSRFADTYAYRREQEAV

SEQ ID NO: 25432 - protein, 131 aa, Haemophilus parainfluenzae
AFCDRVISGEWKGYTGKAITDVVNIGIGGSDLGPYMVTEALRPYKNHLNMHFVSNVDGTHIAETLKKVNPETTLFLVASKTFTTQETMTNANSARDWLLAAAKDNSAVAKHFAALSTNGKAVAEFGIDTNN

SEQ ID NO: 25433 - protein, 131 aa, Haemophilus pittmaniae
AFCERVISGEWKGYTGKAIRDVINIGIGGSDLGPYMVTEALRPYKNHLNMHFVSNVDGTHIAETLKKVDPETTLVLVASKTFTTQETMTNALTARDWLLAAAKDQAAVAKHFAALSTNAKAVAEFGIDTDN

SEQ ID NO: 25434 - protein, 552 aa, Ralstonia eutropha JMP134
MTPDTSLEKTSQSTDGGDDCPLRWFDADLGAFESLERLIAEHPADFFAGKSFEPVGACHTREAVFASVELPETPTSPQAHADHLLHDVFRHVMPVASPTFVGHMTSSLPSFMPSLAKVVAALNQNVVKLETSGALTGLERQVVGMLHKLVFSQDSAFYGRWLHDADHALGAICSGGTVANLTALWASRNKLLGARDGFAGIHRAGMVAALRHYGYDGLAIVVSERGHYSLGKAADVLGIGRDNLVPVEVDAEGRMRIDLLRDTMRDLQQRNIRPMAIVGIAGTTETGSVDPLDAIADIAQEAGCHFHVDAAWGGATLLSERERWRFAGIERADSVVIDAHKQFYVPMGAGMVLFRSPAWTQEIIQHANYIVRKGSVDLGRHTLEGSRGAAAVMLYANLHLLGRKGLAQLIDRSIDNAHYFASLIAQQPDFELVSHPQLCLLTYRYLPETVRAALATASEDKREKILDALDALTVSIQEMQRDAGRSFVSRTQLTSTQFAGRPIAVFRVVLANPDTTHAILQDILDEQRMLAAASPCMAALMALVEASGRLQR

SEQ ID NO: 25435 - protein, 515 aa, Brucella suis 1330
MSREKYYITTAIAYPNGKPHIGHAYELIATDAMARFQRLNGMDVYFLTGTDEHGIKMLQSARKEGITPRELADRNTSAFRRMAEVLNSSNDDYIRTSEERHYKASQAIWQAMVANGDIYKGGYAGWYSVRDEAYYGEEETEVRADGVRYGPQGTPVEWVEEESYFFRLSAYQDKLLDLYENNPGFIMPAERRNEIVSFVKSGLKDLSISRTTFDWGIPVPGDEKHVMYVWVDALTNYITALGYPDTTDERWAYWPANAHIIGKDISRFHAVYWPAFLMSAQLPLPKRVFAHGFLFNRGEKMSKSVGNVIDPFELVERYGLDQLRYFLMREVPFGQDGSYSHEAIVNRTNADLANDLGNLAQRSLSMIAKNCEGKVPQPGAFSEADKAILDQADAALETARKAMDDQALHLALGAIFAVVAEANRYFAGQEPWALRKTDPARMGTVLYVTAEVLRRVGIMVQPFIPQSAEKLLDILAVPADKRQFADVLASPLAGGTDLPAPQPVFPRYVEADEQN

SEQ ID NO: 25436 - protein, 131 aa, Haemophilus parahaemolyticus
DFCERVISGEWKGYTGKVITDVINIGIGGSDLGPYMVTEALRPYKNHLTMHFVSNVDGTHIAETLKKVNPETTLVLVASKTFTTQETMTNAHSARDWLLAAAKDESAVAKHFAALSTNAKEVEKFGIDTNN

SEQ ID NO: 25437 - protein, 325 aa, Alteromonadales bacterium TW-7
MAKMNMLHAINSALDITMNEHPQACIFGEDVGYFGGVFRATSGLQEKYGKHRVFNTPLTEQGILGFANGLAAFGAPALAEIQFADYIFPAFDQIVNESAKFRYRSGNEFNVGNLTVRTPYGGGIAGGLYHSQSPEAYFAHTPGLKIVVPRNPYQAKGLLRASIKDDNPVIFFEPKRLYRASTGEVPEEDYSIELGKAEVVQEGSDITVLAWGAQMEIIEDAAKLASEQGIHCEVIDLRSILPWDIDTIAKSVTKTGRLVISHEAPITNGFGAEIAASIQQACFLHLESPILRVCGLDTPYPLALEKEYVPDALKVLAAIKQSMDF

SEQ ID NO: 25438 - protein, 205 aa, Nicotiana tabacum
MGSVGENNGVQDKCKRSLTRGKLKSSSSSSSSFRLRSPSLNSIRLRRIFDVFDRNHDSLISVDELSQALNLLGLDADQSEIESMVRSYIKSGNNGLRFEDFEALHRSLDDVFFGSKYEEDKIVLDQDPDQDEVDLKDAFNVFDENGDGFISAKELQAVLEKLGLPEGNEIDRVEMMISSVDQDHDGQVDFVEFKDMMRTVIVPSS

SEQ ID NO: 25439 - protein, 317 aa, Oryza sativa (japonica cultivar-group)
MGECSEHRCWDELLPDALGLIFRKLSLKDVLTVVPRVCKSWGRVVAGPYCWQEIDIQEWSQQQSKPDQLKRMVRMLVARSGGSFHRISVSGLPGDPLFTFIGDHARSLKTMELPRSDISDSLVENVAPRLSNVTFLDISSCTKIGARALEAFGKHCKSLIGLRRVMHPTDVVGRASQHDEARAIACNMPKLRHLEIGYMLIATKAVVEIASQCHDLKFLDLRGCWNVDDKLLQESYPGLKVVGPYVDDCYENSFWEECSDDSDDSIYWELMDDDYYAAGSDDEGIWDDGQGLEGLEVRFYGGGFSESHAGFDWPPSP

SEQ ID NO: 25440 - protein, 183 aa, Nicotiana tabacum
MLASNNPKKRAGRKKLRETRHPVYRGVRKRNSGKWVCEVREPNKQSRIWLGTFPSAEMAVRAHDVAAIALRGRSACLNFADSAWKLHIPASTDAKDIQKAAAEAAEAFRTSEAENMPEYSGEDSKEVNSTPENMFYMDEEALFCMPGLLANMAEGLMLPPPQCSQIGDHMEDDFDMPLWSYSI

SEQ ID NO: 25441 - protein, 115 aa, Erwinia carotovora subsp. atroseptica SCRI1043
MSNIIKQIEDEQMKQDVPAFRPGDSVEVKVWVVEGSKKRLQAFEGVVIAIRNRGLHSAFTVRKISNGEGVERVFQTHSPVIDSIAVKRRGAVRKAKLYYLRERTGKSARIKERLS

SEQ ID NO: 25442 - protein, 304 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDQDICALAKEYEIAMLLVTKGAEGVVVCYRGQVHHFAGMSVNCVDSTGAGDAFVAGLLTGLSSTGLSTDEREMRRIIDLAQRCGALAVTAKGAMTALPCRQELE

SEQ ID NO: 25443 - protein, 182 aa, Nicotiana tabacum
MDQNLPVTAKKFWKIVRVAFFMLRKGLSKRKLMFDLNLLMKRGKIAGKAAIQNLMFHHNNNTCPSSTSSSKEYYEFSCSNSPAFHLPFNLNKRSKHNRHHETDGDVLMVNAAVLKALEMIQSETASPALPGFGRTPTVRQLRVTDSPFPIRDGEGNSHVDEKADEFISRFYKDLRREASAFA

SEQ ID NO: 25444 - protein, 301 aa, Nostoc punctiforme PCC 73102
MKNLQVVEKEFSSLPIIDISALVSGKGNLYSAASQIRQACRESGFFYIIGHGVDENLQQRLEELSRQFFAQDLETKLKIRMALAGIAWRGYFPVGGELTSGKPDLKEGIYFGTELPDEHPLVQAGTPMHGANLFPANMPQFGETVLEYIEAMTKLGHTLMTGIAMSLGLEESYFADRYTSDPLVLFRIFNYPPNLSPSDGNPIWGVGEHTDYGVLTILKQDDSGGLQVKSKSGWVAAPPVPGSFVCNIGDMLDKMTGGFYRSTPHRVQNQSQNHRLSFPFFFDPNFDVEVKPIELDNYSSE

SEQ ID NO: 25445 - protein, 242 aa, Oryza sativa (indica cultivar-group)
MRKAYKDSFKVLEADIQHANTLASEFPREYDGACLQMRLSYSPAAHIFLFLVQWTDCSLAGALGLLRILVYKVYVDGTTTMSTHERKASIKEFYAVIFPSLLQLQRGITDTEDKKQKAVCMERYRRRDEDERNILSEIDAEREEECGICMEMNSKVVLPNCTHNMCLRCYQDWNSRSQSCPFCRDNLKKTDPGDLWIYVEDQDVVDMETVSRENLRRLFMYINKLPLIVPDVIFSIYDSHIK

SEQ ID NO: 25446 - protein, 513 aa, Candida glabrata CBS 138
MSKRSLDSSADERVVSARTGSQSVPKSYSTADGEQISDSGMIEDLSDNFESDEDIIEIDGEDDEDEDEITDESAFLQKKEAKAKETIEKDNQQEKGGEELYLPHMSRPLGPDEVLEADPTVYEMLHNVNMPWPCLSLDIIPDTLGSERRNYPQSILMTTATQASKKKENELMVLSLSNLTKTLLKDEEEEEEEEDDDDVEPIIENENIALRDTTNRIKVSPFASQSQEVLTATMSENGEVYIFDIGAQAKCFNSPGYQIPKQSKRPVHTIRNHGNVEGYGLDWSPLIKSGALLSGDCSGQIYLTQRHTSKWVTDKQAYSVGNNKSIEDIQWSKTESTVFATAGCDGYIRVWDTRSKKHKPAISVKASNTDVNVISWNEKIGYLLASGDDNGSWGVWDLRQFTPDNAANIQPVAQYNFHKGAITSIAFNPLEESIVAVGSEDNTVTLWDLSVEADDEEIKQQTEETKELKEIPPQLLFVHWQKEIKDVKWHKQIPGCLVSTGTDGLNIWKTISV

SEQ ID NO: 25447 - protein, 525 aa, marine gamma proteobacterium HTCC2080
MTADIHQHRILILDFGSQYTQLIARRVREAGVYSEIYAWDITEADIRAFNPSGIVLSGGPESVTEADSPRAPEVVFELEVPVLGICYGMQTMAVQMGGEVQGSETSEFGYAQIRRSADGGLLQDISDHHDDSGQALLDVWMSHGDKVVSLPPNFQCIAETDSCPLAGIAHNAKPWFGIQFHPEVTHTTQGERIFEHFVLEICGCEALWTPANIVEDAIQRVRTQVGTDRVLLGLSGGVDSSVVAAMLHRAIGDQLTCVFVDNGLLRLDEGEQVMAMFAQNMGVRVIRANAEARFLGKLKGVSDPEAKRKAIGNTFIEVFDEEATKITGVKWLAQGTIYPDVIESAGSKTGKAHVIKSHHNVGGLPDDMALELVEPLRELFKDEVRRIGLELGLPKDMVFRHPFPGPGLGVRILGEVKKEYADLLRQADAIFIEELHRSGWYDKTSQAFAVFLPVKSVGVVGDGRRYEYVIAIRAVQTVDFMTARWAHLPYELLEVVSNRIINEISGISRVTYDISGKPPATIEWE

SEQ ID NO: 25448 - protein, 181 aa, Fagus sylvatica
MASSMISSATVATVSRATPAQATMVAPFTGLKSTAAFPATQKSNNDITSLASNGGRVQCMKVWPPLGLQKFETLSYLPPLSLESLAKQIEYLILKGWIPCLEFELEHPFVYRENNRSPGYYDGRYWVMWKLPMFGCTDATQVLAELQEASKTYPTSHIRIIGFDNKRQVQCISFIAYKPPK

SEQ ID NO: 25449 - protein, 482 aa, marine gamma proteobacterium HTCC2080
MVKHSNTEDPWALKVLAAVAELGPQRYYDPVITSEVVKNDLVSLIRASQKLKEKVAIASPEARHDRRNIIGAIRGYSEMLLEDSEVLPAAVRAHLLQILAAAKNEPKPASESATPTKSVTLLPSEEPGVILAVDDLPENRELVSRLLQKTGHTVISAESGEEALELLDTMGVDVVLLDLVMPGIGGAEVLKRLKEDERLRATPVVMISGQQDMDQIVMCIEAGADDYLLKPFNPVLLQARISAGIERKRWHDREELYREQLERREQFIRATFGRYLSDDIVDEILERPEGLELGGDLREVTIMMSDIRGFTTLVEHLPPQQVVTLLNRYLGRMTEIILEFGGTIDEFLGDAVLAVFGAPRRNDDDPDRAVRCALVMQEAMADINIANSADGLPEVEMAIALNTGSVVAGNIGSERRSKYGFVGHAMNVTSRIEDVAKPGEILISQTTYEKLESDYKFGNSRSLSVKGIEAELRVHAVLGGIQ

SEQ ID NO: 25450 - protein, 151 aa, Archaeoglobus fulgidus DSM 4304
MERTFVMVKPDGVQRGLVGEVIGRLERKGLKIVAMKMLWIAREMAENHYAEHREKPFFSALVDYITSGPVVAMVVEGKNAIKVVRTLVGATNPAEAAPGTIRGDFGLDVGRNVVHASDSPQSAEREISLFFSDDEIVNWEKADEDWIYEER

SEQ ID NO: 25451 - protein, 400 aa, Magnaporthe grisea 70-15
MGKSLAVAKKGETSVVPISSEQTLKASKALLSHMQKAAKEAAASADKKNLLEESTEAETPIWLTATTKRNVRDTNKLKPGRVTLPHPLNRTDPETTICLIVADPQRFYKDVVASEEFPEALGKRITRVVDLKHLQAKFRTFEAQRKLFSEHDVFLADERIVNRLPKALGKTFFKTTAKRPVPVKLHRPDKKADGVKSTPGQKKAQKEQGSSVKHAKSAGDMAKEIEAAVGAALVHLTQTTNTAVKIGYAAFTPQQIAENAEAVVTALVEKFIPRGIDNLRAVYLKGPETAALPIWQTEELWLDGDKDVLAEGSEELKALEEKKEKANVGKKRKAPAADEQVKEEEEQVDAAAEVEKPAKKKNKKAKVDAESNDAKLDAQIKERKEKLKKQKKAAKAAMEE

SEQ ID NO: 25452 - protein, 131 aa, Haemophilus parahaemolyticus
DFCERVISGKWKGYTGKAITDVINIGIGGSDLGPYMVTEALRPYKNHLTMHFVSNVDGTHIAETLKKVNPETTLVLVASKTFTTQETMTNAHTARDWLLAAAKDESAVAKHFAALSTNAKEVEKFGIDTNN

SEQ ID NO: 25453 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPETTLVLVASKTFTTQETMTNAHTARDWLLAAAIDESAVAKHFAALSTNAKEVEKFGIDTNN

SEQ ID NO: 25454 - protein, 449 aa, Pseudomonas fluorescens PfO-1
MNMPENAPSPLASQLKLDAHWMPYTANRNFQRDPRLIVGAEGSWLIDDKGRKVYDSLSGLWTCGAGHTRKEIQEAVAKQLGTLDYSPGFQYGHPLSFQLAEKITDLTPGNLNHVFFTDSGSECADTAVKMVRAYWRLKGQSTKTKMIGRARGYHGVNIAGTSLGGVNGNRKLFGQAMMDVDHLPHTLLASNAFSRGMPEQGGIALADELLKLIELHDASNIAAVFVEPMAGSAGVLVPPQGYLKRLREICDQHNILLVFDEVITGFGRTGTMFGATTFGVTPDLMCIAKQVTNGAIPMGAVIASSEIYQTFMNQPTPEYAVEFPHGYTYSAHPVACAAGLAALDLLQKENLVQSVAEVAPHFENALHGLKGAKNVIDIRNFGLAGAIQIAGRDGDAIVRPFEAGMALWKAGFYVRFGGDTLQFGPTFNSKPQDLDRLFDAVGEVLNKLD

SEQ ID NO: 25455 - protein, 175 aa, Oryza sativa (japonica cultivar-group)
MASSSSAQETGRWSLAGATALVTGGSKGIGRAIVEELASFGATVHTCARNEATLNSCLEEWSAKKLSITSSVCDVSARADREALAGRVTAMFDGKLDILVNNVGFLFLKPAVNVTPEELSRVMAGNLESCFHLSQLMHPLLKTSGKGNVVNISGISTVTGFPSLPICAFCAAKGS

SEQ ID NO: 25456 - protein, 469 aa, Brucella suis 1330
MTTANDILKQIKDNDVKFVDLRFTDPKGKLHHVTMDIGLVDEDMFVDGVMFDGSSIAGWKAINESDMVLMPDPETAHIDPFFAQSTLVILCDILEPLSGESYSRDPRTTAKKAEAYLKSLGIGDTVYVGPEAEFFVFDDVKFKADPFNTGFKLDSAELPSNDDTDYETGNLGHRPRVKGGYFPVPPIDSLQDMRSEMLTVLSEMGVTVEKHHHEVASAQHELGTKFDTLVRNADKMQIQKYVVHQVANAYGKTATFMPKPVFGDNGSGMHVHFSIWKDGKPTFAGNEYAGLSENCLYFIGGVIKHAKAVNAFTNPSTNSYKRLVPGYEAPVLLAYSARNRSASCRIPFGSSPKSKRLEVRFPDPSANPYLCFSALLMAGLDGIKNKIHPGQAMDKDLYDLPPKELKQIPTVCGSLREALQSLDKDREFLKAGGVFSDDQIDSFIELKMAEVMRFEMTPHPVEFDMYYSV

SEQ ID NO: 25457 - protein, 131 aa, Haemophilus paraphrohaemolyticus
DFCERVISGEWKGYTGKAITDVINIGIGGSDLGPYMVTEALRPYKNHLTMHFVSNVDGTHIAETLKKVNPEATLVLVASKTFTTQETMTNAHTARDWLLNAAKDESAVAKHFAALSTNAKEVEKFGIDTNN

SEQ ID NO: 25458 - protein, 501 aa, Brucella suis 1330
MFELLTPEEMARADRLTMEGGIKDGFALMLAAGRAVADIAQHMFPQKQPVAVLCGPGNNGGDGYVAAQYLLEAGYEAVCFAAAPPRQGTDAMRASIFYKGQVRDLNEFSPASFGGIIDALYGAGLARAVEGAQATVIDAVNASGLPVVAVDLPSGISGATGMALGAAMRAKATVTFFRKKPGHLLQPGRAHCGIIHIADIGIPDRILGEINPRVFENSPELWADSLPSPAVDAHKYSRGHAAVFSGAMHSTGAARLSAMAAARSGAGAVTLLSPPDALAVNAAHLTSIMVRETRSQQDAAQFITDRKVTAAVLGPGYGNPAFARDYTKMLLSAASGKAGQFRGLVLDADGITAFENKPDELFDTHRSSATALVLTPHEGEFKRLFPDIAEDNTSKIDKARKAAMRANAVVIYKGPDTVIAEPGGLAVINSNGTPFLATAGSGDVLTGIVCGLLAQGMAPFAAACASVWVHADAARRFGHGLIAEDLPAQLPAVWSSLSRFG

SEQ ID NO: 25459 - protein, 131 aa, Actinobacillus lignieresii
DFCERVISGSWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 25460 - protein, 334 aa, Geobacillus stearothermophilus
AVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 25461 - protein, 131 aa, Actinobacillus pleuropneumoniae
DFCERVISGGWKGYTGKAITDVINIGIGGSDLGPYMVTEALRPYKNHLNMHFVSNVDGTHIAEVLKKVNPETTLVLVASKTFTTQETMTNALTAREWLLAAAKDESAVAKHFAALSTNATEVAKFGIDTAN

SEQ ID NO: 25462 - protein, 363 aa, Nostoc punctiforme PCC 73102
MESLSKASYRIVAIPGEGIGPEVVEASLKILQHVAKIQGFTLQVDYGWLGATAFEQLGSYFPQATTELCDGADGIVFGAVSQGGLLELRKHFDFFCNLRPIRSVNSLLHKSSLRPEKIQGLDILIVRELVSGIYFGPSGRSSDERGNYGYHTMRYYDEEIRRIARKALEQAQYRRGLLTVAHKENALPHLHWTRLVQEEATKFPNVIVEPMLVDNLAMQMVLNPQRFDVILASNLFGDILSDIGGALVGSIGLLGSASLNANGFGLYEAIHGTAPDIAGLGIANPLGTLGACVLMLQQWGEVQAAQQIIAAQDRILAKGYRTADLFTQGEEILVNTATLVDLLLEELSVVQHSQLGVLHESRK

SEQ ID NO: 25463 - protein, 188 aa, Erwinia carotovora subsp. atroseptica SCRI1043
MYDRYQGLIFDMDGTLLDTEPTHHKAWDLVLARYGMSYDASAMTALNGSPTWRIAQRIIDSHQADIDAHQLAAEKTAIVEEMLLDTVKPLPLIDVVKHYRGRRSMAVGTGSTHGMADRLLMHLGLHDYFDAIVGADDVTQHKPFPDTFLRCAALISVAPEHCIVFEDADYGVEAAKRANMAVVDVRTL

SEQ ID NO: 25464 - protein, 583 aa, Shigella flexneri 2a str. 301
MLTACISFGVAMTTNTHFRGEELKKVWLNRYPADVPTEINPDRYQSLVDMFEQSVARYADQPAFVNMGEVMTFRKLEERSRAFAAYLQQGLGLKKGDRVALMMPNLLQYPVALFGILRAGIIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 25465 - protein, 593 aa, Camptotheca acuminata
MDVRRRSINSIHQIPSVGGTAPPMLKPKQPTKVDAVDLPDSPKASDALPLPLYITNGVFFTLFFTVVYYLLVRWREKIRNSTPLHVVTLSEIAAIFTFVASFIYLLGFFGIGLVQPFTSRSSHDDVWGVDDDEDVDEIVLKEDTRTVPCAAAPVDCPLPPIKPKVVDPVPISPPSSEEDEEIIKSVVEGTTPSYALESKLGDSHRAAAIRREALQRMTKKSLAGLPLDGFDYDSILGQCCEMPVGYVQIPVGIAGPLLLDGREYSVPMATTEGCLVASTNRGCKAIFACGGATSVLLRDAMTRAPVVRFGSAKRAADLKFFLENPLNFETLAAVFNSSSRFGKLQNIKCAIAGKNLYMRYSCSTGDAMGMNMISKGVQNVLDFLQDDFPDMDVIGISGNYCSDKKPAAVNWIEGRGKSVVCEAVIKEEVVKKVLKTNVASLVELNMLKNLTGSAMAGALGGFNAHASNIVSAVYLATGQDPAQNVESSHCITMMEAINDGKDLHVSVTMPSIEVGTVGGGTQLASQSACLNLLGVKGASKEAPGSNARLLATIVAGSVLAGELSLMSAIAAGQLVNSHMKYNRSNKDVTKASS

SEQ ID NO: 25466 - protein, 199 aa, Oryza sativa (indica cultivar-group)
MAAVSLRKSNARLPPEVNRVLYVRNLPFNISSEEMYDIFGKYGAIRQIRLGNAKDTRGTAFVVYEDIYDAKNAVDHLSGFNVANRYLIVLYYQPAKMSKKSDVKKKEEEITRLQEKYGLGSKTPSSAPDAPLELICNYVLRIKLWLCTSNMCYLLFLLGQQNLCNKMALANTSYSIARHIIVLQVTKTKGLGKLKGTTT

SEQ ID NO: 25467 - protein, 239 aa, Triticum aestivum
MDMTGSDQQRSSPSSPSSSSHLKRPAGRTKFKETRHPVYRGVRRRGSAGRWVCEVRVPGKRGERLWLGTHLTAEAAARAYDAAMLCLIGPSTQCLNFADSAWLLAVPSALPDFADVRRAALSAVADFQRREAASGAATRSLDATVPVDDGTCSQSAQSSMENTGSSWTSSSLPSGNGMFEVPATLGCDMFELDMSGEMDLDTYYAYFAEGLLLEPPQPPVAGACWDTEGGGADAALWSY

SEQ ID NO: 25468 - protein, 276 aa, Nostoc punctiforme PCC 73102
MEASELLETITLLIYQAEQGEIDPWDVQVIEVIDRYLELMAPESIGRGYEADLSQSGQAFLSASMLVLFKANTLMQLSTVGDIQDGVLDDAILEDEDGISHHGHRLPLERQLRRRPSAMPPPKRRVTLQELIKQLQIMANQLKIVEKVSKPIRPRRLPSVQSMREALELAHQENLTEVAGELEQVLNLSARELNSEQNWLNLEQLVELWTQTKLFNQNGSGHETKHSHLVSVFWALLLLSAQSKVELFQEEFYHEIKVRLLTDSPKTSKPFEQSMN

SEQ ID NO: 25469 - protein, 389 aa, Nostoc punctiforme PCC 73102
MKAMILAAGKGTRVRPITYTIPKPMIPILQKPVMEFLLELLRQHGFDQIMVNVSHLAEEIENYFRDGQRFGVQIAYSFEGKIDDDGKLVGEAIGSAGGMRRIQDFSPFFDDTFVVLCGDALIDLDLTAAVKWHRAKGSIATIITKSVPQEEVSSYGVVVTDEEGRVKAFQEKPSTEEALSTNINTGIYIFEPEVFNYIPSDVEYDIGSQLFPKLVEIKAPFYAIPMDFEWVDIGKVPDYWRAIRGVLLGEIKNVQIPGHEVAPGIYTGLNVAVNWDKVDITGPVYIGGMTRIEDGAKIVGPAMIGPNCWICSGATVENSVIFEWSRLGPGVRLVDKLVFGRYCVDKTGAAIDVQAAALDWLITDARQIPPSHTPVERQAIEELLGTNAS

SEQ ID NO: 25470 - protein, 262 aa, Pyrobaculum aerophilum str. IM2
MYFAVIGAHVRGKSASPAMHTASFKALGINAVYIAVDVPKEELGCFAQIARLNFRGFNVTIPHKEEVVKFLDALSAEARAIGAVNTVLVERNLMVGYNTDAHAVYKLAGGHMEGAEVLILGAGGAARAALFAAIKAGAKKIYVKNRTAERAEALAREFREKFERPIEAIPWSGAVKADVVINATPIHDAVIADLTGASLYVEFVYTPTPRTKMVEEAERLGVKVVDGVDLLVEQGAQAEKIWLGVEPDRAVMKKAVLEFLGL

SEQ ID NO: 25471 - protein, 234 aa, Triticum aestivum
MDFGINGWISSPSSSTSGHELGDAVPVWSPAAKRPAGRTKFKETRHPVYRGVRRRGSAGRWVCEVRVPGKRGERLWLGTYVAAESAARAHDAAMLALLGRSPSAAACLNFPDSAWLLVMPPRLSDLADVRRAAIQAVAGFLRPEAATVVPDVDEATSPVYLPSPVDNADEVFQVPTFSPLGSDMFELDMSGEMDLDAYYAGFAQGMLLEPPPTPAYWETGECGDGGAAAGLWSY

SEQ ID NO: 25472 - protein, 149 aa, Nostoc punctiforme PCC 73102
MERTFLAIKPDGVQRGLVGEIIRRFETKGFTLVGLKFLKVSKELAEQHYGVHRERPFFGSLVEFITSSPVVAMVWEGDGVVASARKIIGATNPLTSEPGTIRGDFGINIGRNLIHGSDAPETAQQEIALWFKDEELVNWQPHITPWLHE

SEQ ID NO: 25473 - protein, 212 aa, Oryza sativa (indica cultivar-group)
MQRWALAELWAAARSASPVAVIAAVAGAAVVYKVGSSLLAPPPPPARPREEPSEEAPPPPEPVQVGEITAEELLQYDGSDPEKPLLMAIKGQIYDVSQSRLFYGPGGPYALFAGKDASRALAKMSFEPQDLTDDISGLSLLELSALQDWEYKFSSKYVKVGTIKKVLVEQGGDSTADAIEEAAVDGEDSILTAKMSNQLLYEEEMEVGSDDP

SEQ ID NO: 25474 - protein, 399 aa, marine gamma proteobacterium HTCC2080
MNHNFQRIDRLPPYVFNIIGELKTSARARGEDIIDFGMGNPDQPTPSHIVDKLADTIHRGDTHRYSQSKGIPRLRKAICDWYQRRYDVVLDPNSEAIVTMGSKEGLAHLALATTSTGDSILVPNPSYPIHPYGFVISGADLRHVPMSDEATFFEELERAIRNSYPKPKMLVLNFPSNPTGHCVELSFFEKVIAVAREAGIWVVHDLAYADLCFDGYVAPSILQVEGARDIAVEFFTLSKSYNMPGWRVGFCCGNPELIAALTRIKSYLDYGIFTPVQVAAIAALEGDQQCVSDICDMYRSRRDVLCQGLNEAGWPVTPPKATMFVWAEIPESFRAMGSLEFSKLLLAEAGVAVSPGIGFGEYGEGYVRFGLIENEHRTRQALRGIKKVLRSGPPHSSGV

SEQ ID NO: 25475 - protein, 788 aa, Ostreococcus tauri
MSRSALVPKASLRGSPRSFVVLVDRAPRRRRPRTRDDGVDAERVARRAARVVVRDTYSTVSHRDTTFSLNLLRLDTHRRYAMSTPARKRLMRDFKRLQTDPPAGISGTPSESNIMSWHAVIFGPEGTPWEGGTFKLTIAFSEEYPNKAPVVKFVTKMFHPNVYNDGSICLDILQNQWSPIYDVGAILTSIQSLLCDPNPNSPANSEAAALYNENRRAIVGWKSGREREPGERETLRANARLPRFLVRLTSNTRERTRGKVSFSQASMRTIDEDAGKATATNDALKTGEEDDDSNATTTTTVTTTTMRALDDDARRSILAWYDANKRELPWRVMTRRRRRVKVEVEAEAEAVTVADAARMWTERAFEGETSDGEASVMGDDQYAYGVLVSEIMSQQTQIDRVAEYWTRWVARWPTARALAEASQEDVNEEWAGLGYYRRAGFLLKGAKYVSEDLGGRYPRTAAELLKIPGVGPYTSSAVSSIAFGERTAAVDGNVHRVLTRARLIKGDPTKGETAKELRRVADAFVDAERSGDFNQAMMELGATVCTPTNPKCAQCPIAAWCEGLSRERETSGVFKVTELPETAKKAEKRQEQRAYVVLRRGTKEAGFEYLLSKRPEGGLLSGLWEFPNSLIATETDDAFANRPKSDVTEAHEAICDALVASSTHRRIEAVSGKAAHVFSHVRQVMHYQLVHVETADCEHSNELISVDFPNVKWFPARAFEESGIFTSGVAKVYAKCARGEVKHSGAQKRKFGVNRTDEDSQKTIRSFFTPRVDRTDVTVRDAEDLTSA

SEQ ID NO: 25476 - protein, 394 aa, Arabidopsis thaliana
MGKHKSFRSKAVHFVTDLTAGLLNPISDKPSSAHPPPPLPDEEDESKRNQLESTTAEQPKDLVDEPDTSSFSAFLGSLLSSDPKDKRKDQDPEDEEDEEEDEEEDSEAETSDTSSSSANPTRTMKETTSGGAAKKSFLSKYKQHFRNFYQAVKFPGVKERKGNSDVIPDDEETEYYDGLEMKPMQNNNVKEEVTVVVQAIIPEISEPSLLLSEQSRRSLYTSLPALVQGRKWILLYSTWRHGISLSTLYRKSLLWPGLSLLVVGDRKGSVFGGLVEAPLIPTDKKYQGTNSTFVFTNKSGQPTIYRPTGANRFYTLCSKEFLALGGGGRFALYLDSELLSGSSAYSETYGNSCLADSQDFDVKEVELWGFVYGSKYDEILAHSKTMEPGLCRWS

SEQ ID NO: 25477 - protein, 247 aa, Nocardioides sp. JS614
MTHTLILLRHGESEWNAKNLFTGWVDVNLTEKGRAEAVRGGELMREAGVLPDVVHTSVQRRAINTACLALDAADRHWIPVRRSWRLNERHYGALQGKNKKETLEAYGEEQFMLWRRSFDVPPPPIEEDSEFSQFGLPQYAGLGDDMPHTECLKDVIARFLPYWESDIVPDLRAGHTVLIAAHGNSLRALVKHLDGISDEDIAGLNIPTGMPLVYELDDDFRPTVPHGRYLDPEAAAAAAAAVANQGR

SEQ ID NO: 25478 - protein, 232 aa, Brucella suis 1330
MDEARKLKIAAAAEALTYVKDGMRLGIGTGSTAEEFVRLLAEKVKGGFRVIGVPTSERTAKLCEELGVALTTLEETPHLDLTIDGADEVDGELSLIKGGGGALLREKIVAAASDSMIVIADQSKVVETLGRFPLPIEVNRFGLGATIRAIEAAAVKCGLAGPLNLRLKDGSPFLTDGGHYIVDASFGRIPDPKTLSDALFAIPGVVEHGLFIGLARAAIIAGTDGIRTMNRS

SEQ ID NO: 25479 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTDN

SEQ ID NO: 25480 - protein, 464 aa, Brucella suis 1330
MTGFDYDLFVIGGGSGGVRAGRLAGAIGKKVGLAEEYRMGGTCVIRGCVPKKLFVYASQFPEHFEDSAGYGWSMGEAAFDWKKLIAAKDKEISRLEGLYRKGLENSHVDIFASRAELIDEHTIELKADGRRVTADKILIATGGRPNTHESLPGHEYCISSNEAFHLEELPKSIVIAGGGYIAVEFANIFHGLGVETTLVYRGKEILSRFDHDIRSLLHETMEAKGIRILCGAIFEKVEKKADGKLSVELSNGETLETDQAMLALGRIPNTDGLGLEKAGVKIDKSGAIEVDDYSRTNVENIWAVGDVTNRVQLTPVAIHEAMCFLETAFKDNPTKPDHELIATAVFSQPEIGTVGLSEDEAAKKYPELEIYRALFRPMKNTLSGRSEKTLMKLVVESKSRKVLGAHIMGPDAGEMAQLLGISLKAGATKDDFDRTMAVHPTATEELVTMYKPTYRVVDGKKIEG

SEQ ID NO: 25481 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLILVASKTFTTQETITNALSARNWFLAAAKDPAHVAKHFAALSTNAKAVAEFGIDTDN

SEQ ID NO: 25482 - protein, 490 aa, Pseudomonas putida GB-1
MARFGTQKLYIDGAYVDAGSDATFEAINPATGEVLAHVQRATEADVEKAVESAERGQKVWAAMTAMQRSRILRRAVDILRERNDELAQLETLDTGKSYSETRYVDIVTGADVLEYYAGLVPAIEGEQIPLRESSFVYTRREPLGVTVGIGAWNYPIQIALWKSAPALAAGNAMIFKPSEVTSLTTLKLAEIYTEAGLPNGVFNVLTGSGREVGTWLTEHPRIEKVSFTGGTTTGKKVMASASSSSLKEVTMELGGKSPLIICADADLDKAADIAMMANFYSSGQVCTNGTRVFIPAEMKAAFEAKIAERVARIRVGNPEDENTNFGPLVSFAHMENVLSYIAKGKEEGARVLCGGERLTEGEFAKGAFVAPTVFTDCSDDMTIVKEEIFGPVMSILSYETEEEVIRRANDTEYGLAAGVCTNDITRAHRIIHKLEAGICWINAWGESPAEMPVGGYKQSGVGRENGVSSLAQYTRIKSVQVELGGYNSVF

SEQ ID NO: 25483 - protein, 131 aa, Aggregatibacter aphrophilus
TFCARVISGEWKGYTGKAITDVINIGIGGSDLGPYMVTEALRPYKNHLTMHFVSNVDGTHIAETLKKVNPETTLVLVASKTFTTQETMTNALSARDWFLAAAKDPAHVAKHFAALSTNAKAVAEFGIDTDN

SEQ ID NO: 25484 - protein, 774 aa, Brucella suis 1330
MTKKPSSPSTRSDFDEAALFFHRYPKPGKLEIQATKPLGNQRDLALAYSPGVAAPCLAIHDDPATAAEYTARGNLVAVVSNGTAVLGLGNIGALASKPVMEGKAVLFKKFADIDVFDIEIDAHEINRIVDVVSALEPTFGGINLEDIKAPECFEVEEQLRERMNIPVFHDDQHGTAIIVASAVLNGLELAGKKIEEAKIVTSGAGAAALACLNLLVNLGAKRENIWVCDIEGVVYDSRNTLMDRWKEVYAQKTDARTLADVIGGADVFLGLSAAGVLKPELLKQMAEKPLIMALANPKPEIMPEEARAARADAMICTGRSDFPNQVNNVLCFPYIFRGALDVGATVINEEMKLAAVRAIASLAREEPSDVAARAYSGDTPTFGPDYIIPSPFDQRLILRIAPAVAKAAMETGVATRPIEDMEAYLDRLNRFVFRSGLIMKPVFAAARTQGAPMRVIYADGEDERVLRAAQVVIEERIAAPILVGRPQVVETRLRRYGLKIRPGTDFELINPEDDPRYRDYVDLYLSYTGRQGVTPEAARTIVRTNSTAIAALAVMRDEADAMICGLEGRFERHLRVVRQIIGKVPGIRDYSALSLLISQRGALFLTDTYVNAEPDANEIAEMAVLAAREISRFGIEPKAALVSHSNFGSKESASAKKMRQAAAILAEKAPDLESDGEMHGDAALSQTLRDRVFPSSRLKGEANLLVFPNLDAANITLNVVKAVTDALHVGPILLGATRPAHILTPSVTSRGVVNMTALAVVEALQKNASNRRQK

SEQ ID NO: 25485 - protein, 131 aa, Aggregatibacter segnis
SFCERVISGEWKGYTGKAITDVINIGIGGSDLGPYMVTEALRPYKNHLTMHFVSNVDGTHIAETLKKVNPETTLILVASKTFTTQETMTNALSARDWFLAAAKDPAHVAKHFAALSTNAKAVAEFGIDTNN

SEQ ID NO: 25486 - protein, 308 aa, Ralstonia eutropha JMP134
MSRPLPRYVVFGEALTDMVLQADGNWLGLPGGSCWNVARVGARLGIDTAFAGAVSQDLFGDTLARATEEAGLDMRFLQRVERSPFLAFVASRHPPQYFFVGDDSADLHFEPSRLPQGWREAAEVIHFGSISLVRQPLAGRLCEEATQAAAAGKRIAFDPNYRSLMSAPGYGETLAHMLRLASYVKISDEDLAGLFPALPLDAALAQVRAIAPNATIMLTRGADGLTLLQSDIVVEQPAFRVEVADTVGCGDAAMGGWMASVLSEPRADLAGQARLAAAAAAVAASHAGAYAPLWRELEGLAAMPRGSA

SEQ ID NO: 25487 - protein, 542 aa, Ralstonia eutropha JMP134
MSTSLSAWQSLREHAAKIRHTHMRDWFTGPQGQARSVRLTVEACGLTLDYAKNRVTEDTLSLLFALARQARVCERRDAMFAGEPVNTTERRAALHMALRAHPGDGYRALGVPVEADVSAVLAQMERFARDVRSGSWTGFDGRAITDVVNIGIGGSDLGPRMVCRALEQDTEPGPRLHFVANVDGYDLARTLARLDAATTLVIVCSKTFTTLETMANARTARDWFLRHGVTHSDLARHFVAVSTNRDAVAAFGIDPVNMFPFWDWVGGRFSLWSAVGLSIAVAIGFDRFRQLLDGARAMDRHFAGAPPEQNLPMILGLLDVWYRSFLGTASRCVAPYCEPLDLLPAFLQQLEMESNGKSVQHDGAALEAGSAAVVWGTTGTNGQHAYFQMVHQGSQLVPVDFIACLQPHSDLPGHHTKLLANCFAQGEALLRGRTADEVRAEGKADEALVPHLVFEGNRPSNTLLLQRLDAFHLGALLAMSEHRTFVQGALWNINPFDQWGVELGKMLARPIERELEGAPPQPHDASTAALIRRAAQFCASTD

SEQ ID NO: 25488 - protein, 252 aa, Zea mays
  misc_feature (96)..(96): Xaa can be any naturally occurring amino acid
  unsure (1)..(252): unsure at all Xaa locations
MAANFWESSQYKQLLDQEEVDVVQPLDKERGISVEDFKLIKFHMSNHIMKLAQHIKVRQRVVATAITYMRRVYTKKSMVEFEPRLVAIACLYLAFXAEESIVQARNLVFYSKRLYPDEYKYELKDILGMEMRVLEALDYYLVVFHPYRSLSDFLQDAALNDVNMNQFTWGIVNDTYKMDLILVHPPYRIALACIYIASVQREKDITAWLQDLNEDMNLVKDIAMEILDFYENYRTITDEKVSSAFSKLALKP

SEQ ID NO: 25489 - protein, 189 aa, Mycobacterium tuberculosis H37Rv
WGEPLANYARVLAAVQRITARPPSGFGISARAVTVSTVGLAPAIRNLADARLGVTLALSLHAPDDGLRDTLVPVNNRWRISEALDAARYYANVTGRRVSIEYALIRDVNDQPWRADLLGKRLHRVLGPLAHVNLIPLNPTPGSDWDASPKPVEREFVKRVRAKGVSCTVRDTRGREISAACGQLAAVGG

SEQ ID NO: 25490 - protein, 282 aa, Triticum aestivum
HYRTSLYKKAGWYRSGIPGISSTHASDGFISDAGSIYKTKIDGAKSAAIELTDKDELIVIRSDESSGLDVLDNELANLATWLAGSYQKADSKLNIPLKSGNSLTLFLTKEADVEFASSLISLLKTIERGIQVHEDFSGGIVSPAELLVCHFTGIKALEDEYGSAEIVKQGAEVVQTALTKALDQLQGAYNGKIVGLVISAKEASTSLASIIDALSSLHISRRLAEASKTNATASIAAIYLVRLSLAWITGIILLVSTLIGICLLMNMPLTRDTLLYSNVKID

SEQ ID NO: 25491 - protein, 275 aa, Mycobacterium tuberculosis H37Rv
MVPELMFDEPRPGRPPRHLADLDAAGRASAVAELGLPAFRAKQLAHQYYGRLIADPRQMTDLPAAVRDRIAGAMFPNLLTASADITCDAGQTRKTLWRAVDGTMFESVLMRYPRRNTVCISSQAGCGMACPFCATGQGGLTRNLSTAEILEQVRAGAAALRDDFGDRLSNVVFMGMGGAAGQLRQGVGRSSAHYRAAAVRFRDFGPRGDGVDGGSGPCYPQPCRRAARRDPGAVAARPRRRVARYTSSGQQPVEDQRSARCGPVLRQCDRATGVY

SEQ ID NO: 25492 - protein, 511 aa, Pseudomonas putida GB-1
MTSTPKPLVLIILDGFGHSEVPEHNAIFAANTPVYDRLRATLPHGLISGSGMDVGLPDGQMGNSEVGHMNLGAGRVVYQDFTRVTKAIRDGEFFKNPVLTGAVDKAASAGKAVHILGLLSDGGVHSHQDHLVAMAELAAQRGAEKIYLHAFLDGRDTPPRSAQSSIELLDATFAKLGKGRIASLIGRYYAMDRDNRWDRVSAAYNLIVDSAAEYTADTAQAGLEAAYARDESDEFVKATRIGEAVKVEDGDAVVFMNFRADRARELSRAFVEPDFTEFARARLPKMAAYIGLTQYSAKIPAPAAFAPSSLNNVLGEYLAKNGKTQLRIAETEKYAHVTFFFSGGREEPFEGEERILIPSPKVATYDLQPEMNAPQVTDRIVEAIEQQRFDVIVVNYANGDMVGHTGVFEAAVKAVEALDTCVGRIVDALEKVGGEALITADHGNVEQMEDECTGQAHTAHTTEPVPFIYVGKRNLKVRDGGVLADVAPTMLQLLGLEKPVEMTGTSILVDA

SEQ ID NO: 25493 - protein, 181 aa, Arabidopsis lyrata subsp. petraea
NLQTKLNSLSLSSNLTSLCFDPNQFVINNETCAGIQTTQDWVSRLGPSTALDSACSSGLTDLTRCDACVAAGFRVQKQLITLDGNSSHGVYCYHFAVLYAAGIVNKKGPESDDALSCLFSLSLRSPLSSKKKRHTVALLLGITGAVFGALVIAGLICLYFRFGKAVKGGEVGWEDQESRPK

SEQ ID NO: 25494 - protein, 402 aa, Oryza sativa (indica cultivar-group)
MATKRSVGTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESRTVAASAIPDGWMGLDVGPDAIKTSSEALDTCNTIIWNGPMGVFEFEKFAAGTDAIAKKLADLTTTKGATTIIGGGDSVAAVEKAGLADKMSHISTGGGASLELLEGKTLPGVLALDEA

SEQ ID NO: 25495 - protein, 402 aa, Oryza sativa (indica cultivar-group)
MATKRSVWTLGEADLRGKKVFVRADLNVPLDDAQKITDDTRIRASVPTVKFLLEKGAKVILASHLGRPKGVTPKYSLKPLVPRLSELLGVDVVMANDCIGEEVEKLAAALPEGGVLLLENVRFYKEEEKNDPEFAKKLAAVADLYVNDAFGTAHRAHASTEGVTKFLKPAVAGFLMQKELDYLVGAVANPKKPFAAIVGGSKVSTKIGVIESLLAKVDVLILGGGMIFTFYKAQGYAVGKSLVEEDKLELATSLIEKAKAKGVSLLLPTDVVVADKFAADAESKTVAASAIPDGWMGLDVGPDAIKTSSEALDTCNTIIWNGPMGVFEFEKLAAGTDAIAKKLADLTTTKGATTIIGGGDSVAAVEKAGLADKMSHISTGGGASLELLEGKTLPGVLALDEA

SEQ ID NO: 25496 - protein, 234 aa, Triticum aestivum
MDMGINGWISSPSSSTSGHELGEAVPVWSQAAKRPAGRTKFKETRHPVYRGVRRRGSAGRWVCEVRVPGKRGERLWLGTYVAAESAARAHDAAMLTLLGRSPSAAACLNFPDSAWLLVMPPRLSDLADVRRAAIQAVVGFLRLEAATVVPDVDEATSPVYLPSPVDNADQVFQVPTFSPLGSDMFELDMSGEMDLDAYYAGFAQGMLLEPPPTPSYWENGECGDGGAAAGLWSY

SEQ ID NO: 25497 - protein, 225 aa, Triticum aestivum
MDTNAAWPQFDGQEYRTVWPEEQEYRTVWSEPPKRRAGRNKLQETRHPVYRGVRRRGREGQWVCELRVPAGSRSYSRIWLGTFASAQMAARAHDSAALALSGRDACLNFADSAWRMMPVHAAGSFKLAAAQEIKDAVAVALKEFQEQQRPADESTAPSSTAEESALSIIPSDLSGLDNEHWIGGMEAGSYYASLAQGMLMEPPADGAWREDREHDDGFDTSLWSY

SEQ ID NO: 25498 - protein, 118 aa, marine gamma proteobacterium HTCC2080
MSTNKIISEINAEQMTKEITDFAPGDTVVVQVKVKEGTRERLQAFEGVCIGKRNRGLNSAFTLRKISHGVGVERTFQTYSPLLDSISVKRRGDVRQAKLYYLRERSGKAARIKEKLSR

SEQ ID NO: 25499 - protein, 181 aa, Triticum aestivum
  misc_feature (45)..(45): Xaa can be any naturally occurring amino acid
  unsure (1)..(181): unsure at all Xaa locations
AQSVGPYVADIDGYLRSLEVKQLRRPRDDYMVAMQKDISATMRGXLVDRLVDVVDEFNLLVDTLYLALSYIDRFLTASVITRDRLQLLGVASLFVAAKYEEIHVPKLDKFSDITDGTYTNQQVVKMEADILKYLNFQMGSPTIRTFLLRFLISCRGGHCASAKRLELMCCYLAEFSLLDYD

SEQ ID NO: 25500 - protein, 852 aa, Caulobacter crescentus CB15
MIVSNLVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 25501 - protein, 230 aa, Triticum aestivum
TVWSEPPKRRAGRNKLQETRHPVYRGVRRRGREGQWVCELRVPAGSRSYSRIWLGTFAGAQMAARAHDSAALALSGRGACLNFADSAWRMMPVHAAGSFKLAAAQEIKDAVAVALKEFQEQQRPADVSTAPSSTAEESALSIIPSDLSGLDNEHWIGGMEAGSYYASLAQGMLMEPPADGASWREDREHDDGFDTSLWSYQCDQLIKQCKVLESTASARLCFTKYGKNRE

SEQ ID NO: 25502 - protein, 619 aa, Ostreococcus tauri
MSERRGHGGLELTTSHDVRARPDAGSGQPSGVSAASRTSTTTVIGRHEHTISGYSLLKGIGDGEPIASDRFMVGGHEWVLLFYPDGKRSMSDGGAPPTQQDDPYAALFVALIGEGPRPLGVVQSGQGRVVRAFHRFTLVDQSGNGAVKISCARQDPQARNCHGYRKFVRRSVLEASGSGYLVDDVVVIRYEIELVVTNGGALNKNAKLLPAASVNVPSYPTIGKHLVGLLYDRNDETFDCTFDVEGEKFRAHKLILSSRSSVFAGMLRTGAAMKEGREGVLKLNDVKADVFRLLLHFVYADEIPRGGGAEASLYEHTARLGAEEAPGAAGDELTTRNGRASDELALDVPMTQHLLVAADKFDLSRLRAMCEARLCDSVDMSTVANTLLLAELNHAYALKRACMGFIAANLSDVMSTEGYEAMNTACPHLASEILSAVAEMRPLRPQGAPLALPQDTGTAIQSAAAANPATAAAFATAAAAAARPDRDIAQGGVLAVPPTVAHDLTNLSFPAMSTLSNFLSRAVQPPTQALDHPPPSTPHAATLVNNAGEEAQREVAAAMAARHAQRGGDIANVVDDSLLLFASPQAQRVPSEAPAPVREGDEIAGGNDGQEGRRVRPRR

SEQ ID NO: 25503 - protein, 192 aa, Triticum aestivum
MDTIAAWPQFDGQEYRTVWPEEQEYRTVWSEPPKRRAGRNKLQETRHPVYRGVRRRGREGQWVCELRVPAGSRSYSRIWLGTFASAQMAARAHDSAALALSGRDACLNFADSAWRMMPVHAAGSFKLAAAQEIKDAVAVALKEFQEQQRPADESTAPSSTAEESALSIIPSDLSGLDNEHWIGGMEAGSYYA

SEQ ID NO: 25504 - protein, 145 aa, Medicago truncatula
MGRATLITTAVVFLAIGVIFSPETFGSKSTTLSTYIKLAHLLGFSIAFGAALWVTFIGGIIMFKNLPRHQFGNLQSKMFPAYFSMVGVCIAVTVASFGYLHPWKTSSTSQRYQLGFLISALAFNLTNLFVFTPMTIEKNNEKRRV

SEQ ID NO: 25505 - protein, 398 aa, Candida glabrata CBS 138
MPRTITFNIPKEYKLVDLVGEGSYGIVCSATHLPTGNKVAIKRIRFPDSPPSDDGQGVPRLEEDDEHDNIAKVALIRTIREIKILSHFNNHENIITIFEKIKPMQSINFKEIYLVQELMETDLSRILASSNTLTVDHIQYFLYQILRALKAIHSAKVIHRDLKPSNILLNSNCDLKICDFGLARTYDPDDDASTMNGNNVGFLTEYVATRWYRAPEIMLNFQDYSTAIDIWSCGCVLAEMLFRKPIFPGKDYHHQLLLILDTLGTPSPEDIEAINYGRAKEYILSLPHFPKKDWSQLLGTDNEMLLDILDKLMIFNPKRRITAEQALEHPFLATYHDPKDEPNFPPLNFKGDEFWQLDNCMETSNGYGTDDSNNLRANVTRRKLREILYQEMVTPAPR

SEQ ID NO: 25506 - protein, 217 aa, Triticum aestivum
MDTAAPGSPREGHRTVCSEPPKRPAGRTKFKETRHPLYRGVRRRGRLGQWVCEVRVRGAQGYRLWLGTFTTAEMAARAHDSAVLALLDRAACLNFADSAWRMLPVLAAGSSRFSSAREIKDAVAVAVMEFQRQRPVLSTPETHDGEKDVQGSPTPSELSTSSDLLDEHWFGGMNAGSYYASLAQGMLMEPPAARARSEDGGEYSGVQTPLWNTYPTN

SEQ ID NO: 25507 - protein, 167 aa, Oryza sativa (indica cultivar-group)
MGCAGSVGAMEMAELFEIHASRGGFGLSVCRSVGFVACVVRMFYGPGGPYALFAGKDASRALAKMSFEPQDLTGDISGLGPFELDALQDWEYKFMGKYVKVGTVKKTVPVEDGAPSTSPETTETAAAAEPEKAPATEEKPREVSSEEVKEKEDAVAAAAPDEGAKES

SEQ ID NO: 25508 - protein, 167 aa, Oryza sativa (japonica cultivar-group)
MKAGRKNLRRACSEGAVTLGEGESIMQVLALRGSNVIEVMDAKGVKSLALFPAKFQKSFWIKNGNFVVVDASGRDQALESGSKIACVVSQVLFHDQVRAMEKSEEWPAIFKSTSKEGSEAGTQEGTRPQIEEEPDSDEDDDLPPLEANTNRQRPFELYADSESDSDS

SEQ ID NO: 25509 - protein, 102 aa, Glycine max
QLRRPPPGLYFETVTKIFKKILEKNDAGDHFPLFATCLGFELITMIISQDNNILEEFSASNQASTLQFVENANIGESVFQRFPPELLGKMSTDCLVMQNHRV

SEQ ID NO: 25510 - protein, 378 aa, Oryza sativa (indica cultivar-group)
MAASGVKRPPRPAPASSGGKLFVIFELNTEEVPRVRKLILALAVFLPALLYSQLQPPPPKICGSPGGPPITGTRTRLKDGRYLAYLESGVPKEQAKYKIIFVHGFDSCRYDALPISPELAQELGIYQLSFDRPGYAESDPNLASTEKSIALDIEELADNLQLGPKFYLMGFSMGGEIMWSCLKHISHRLAGVAILAPVGNYWWSGLPSNVSWHVWNQQLPQDKWAVWVSHHLPWLTYWWNSQKLFPASSVIAYNPALFSEGDKLLLSKFAFRTYMPQIRQQGEYGCLHRDMTVGFGKWSWSPLELEDPFAGGEGKVHLWHGAEDLIVPVSLSRYLSEKVPWVVYHELPKSGHMFPLADGMADTIVKSLLLGDQPPQAS

SEQ ID NO: 25511 - protein, 131 aa, Aggregatibacter actinomycetemcomitans
SFCERVISGEWKGYTGKAITDVINIGIGGSDLGPYMVTEALRPYKNHLTMHFVSNVDGTHIAETLKKVNPETTLVLVASKTFTTQETMTNANSARDWFLATAKDEKHVAKHFAALSTNAKEVEKFGIDTDN

SEQ ID NO: 25512 - protein, 631 aa, Nocardioides sp. JS614
MPTTARTDLRNVAIVAHVDHGKTTLVDAMLRQGGAFTEHQAEGVAERVMDSGDLEREKGITILAKNTAIHYAGAAAEGRPMTINIIDTPGHADFGGEVERGLSMVDGIVLLVDASEGPLPQTRFVLRKALNADMPVVLVVNKVDRGDARIEEVVDETYELFMDLLDEHHSQDALDFPVVYASAKSGRASLEMPENGGLPDSPDLEPLFKTILETIPAPTYTEGAPLQAHVTNLDASPFLGRLALVRVHEGTLRKGQQVAWMKRDGSTKSVKITELLVTEGLERKPGESAGPGDIVAVAGIPEITIGETLADAENPVALPLIHVDEPAISMTIGTNTSPLVGKGGKGHKVTARLVKDRLDAELVGNVSLNVLPTERPDAWEVQGRGELALAILVEQMRREGYELTVGKPQVVTKEIDGKLHEPVERLTIDAPEEYLGTITEMLATRKGRMEQMTNHGTGWVRMEFLVPARGLIGFRTEFLTATRGTGIAHHISEGYEPWAGEIRSRASGSLVADRSGAATAYAMTSLQERGVLFVDPTTEVYEGMIVGENSRADDMDVNITKEKQQTNIRSSTSDNFEKLVPPRKLSLEQCLEFCREDECVEVTPETVRIRKVVLDQNARAKSASRARKASS

SEQ ID NO: 25513 - protein, 131 aa, Pasteurella multocida
DFCHRVISGEWKGYTGKAITDVVNIGIGGSDLGPYMVTEALRPYKNHLNLHFVSNVDGTHIAETLKKVNPETTLFLVASKTFTTQETMTNAHSARNWFLTTAKDESHVAKHFAALSTNSKAVAEFGIDTNN

SEQ ID NO: 25514 - protein, 500 aa, Oryza sativa (japonica cultivar-group)
MAMMAMGAASWAPIPAPARAAAAFYPGRDLAAARRRRGAAARRPFVFTPRAVSDSRSSQTCLDPDASTSVLGIILGGGAGTRLYPLTKKRAKPAVPLGANYRLIDIPVSNCLNSNVSKIYVLTQFNSASLNGHLSRAYGNNIGGYKNEGFVEVLAAQQSPENPNWFQGTADAVRQYLWLFEEHNVMEFLILAGDHLYRMDYQKFIQAHRETNADITVAALPMDEERATAFGLMKIDDEGRIIEFAEKPKGEKLKSMMVDTTILGLDTERAKELPYIASMGIYVFSKDVMLKLLRQNFPAANDFGSEVIPGATEIGMRVQAYLYDGYWEDIGTIEAFYNANLGITKKPVPDFSFYDRSAAIYTQPRYLPPSKVLDADVTDSVIGEGCVIRHCTINHSVVGLRSCISEGAVIEDSLLMGADYYETETDKKALSETGGIPIGIGKNAHIRKAIIDKNARIGENVKIINVDNIQEASRETDGYFIKSGIVTVIKDALIPSGTVI

SEQ ID NO: 25515 - protein, 468 aa, Pseudomonas putida GB-1
MSKSVQLIKDHDVKWIDLRFTDTKGIQHHVTMPSRDALDEDFFEVGKMFDGSSIAGWKGIEASDMILMPVDDTAVLDPFTEEPTLIITCDIVDPSSMQGYDRDPRAIAKRAEEYLKSTGIGDTVFAGPEPEFFIFDEVKFKSDISGSMFKIFSEQGSWMTDADVEGGNKGHRPGVKGGYFPVPPFDHDHEIRTAMCNALEEMGQTVEVHHHEVATAGQNEIGVKFNTLVKKADEVQALKYVVHNVADAYGRTATFMPKPLYGDNGSGMHVHMSIWKDGKNTFSGEGYAGLSDTALYFIGGIIKHGKALNGFTNPSTNSYKRLVPGFEAPVMLAYSARNRSASIRIPYVGSPKARRIEARFPDPSANPYLAFAALLMAGLDGIQNKIHPGDAADKNLYDLPPEEAKNIPQVCGSLKEALEELDKGRAFLTKGGVFSDDFIDAFIELKSEEEIKVRTFVHPLEYELYYSC

SEQ ID NO: 25516 - protein, 601 aa, Burkholderia xenovorans LB400
MSESIAAVCRGITQLEEVRVSFTLHGIPVSRGIAIGRAYLIAPAALDVDHYLIEPAQIDGEVERFRAAQQHVHRELDALRADLAADAPSEMGAFINVHSMILNDAMLVQETIDLIRTRRYNVEWALTEQLERLSRHFDDIEDEYLRERKADIEQVVERVLKALAGASVALVDGVHGACDEMIVVAHDIAPADMMQFKTQTFQGFVTDLGGRTSHTAIVARSLGIPAAVGVQHASALIRQDDLIIVDGDHGIVIVDPAPIVLEEYSYRQSEKALEQRKLQRLKFSPTQTLCGTRIELCANIELPEDARAALEAGAMGVGLFRSEFLFMNHKDRLPEEEEQFAAYRRAVELMNGLPVTIRTIDVGADKPLDSMGGGDGYETAANPALGLRAIRWSLSEPQMFLTQLRAILRASAFGTVKILIPMLAHAQEIDQTLDLIREAKRQLDDAGIAYDPNVQVGAMIEIPAAAIALPLFLKRLDFLSIGTNDLIQYTLAIDRADNAVAHLYDPLHPAVLHLIAFTLREAKRAGVPVSVCGEMAGDPALTRLLLGMGLTEFSMHPSQLLVVKQEVLRAHLKTLEKPVADVLASFEPEEVQAALKRVTLA

SEQ ID NO: 25517 - protein, 248 aa, Burkholderia xenovorans LB400
MYKLVLIRHGESTWNKENRFTGWVDVDLTEQGNNEAQQAGVLLKDSGYTFDIAYTSVLKRAIRTLWHVQDKMDLMYLPVVHSWRLNERHYGALSGLNKAETAARFGDEQVLVWRRSYDTPPPALEPTDERAPYNDPRYAKVPREQLPLTECLKDTVARVLPLWNESIAPAIKSGRQVLIAAHGNSIRALVKYLDDISDNDIVGLNIPNGVPLVYELDENLRPIKHYYLGDQEAIAKAQAAVARQGKAG

SEQ ID NO: 25518 - protein, 212 aa, Triticum aestivum
MDTAAPGSPREGHRTVCSEPPKRPAGRTKFKETRHPLYRGVRRRGRLGQWVCEVRVRGAQGYRLWLGTFTTAEMAARAHDSAVLALLDRAACLNFADSAWRMLPVLAAGSSRFSSAREIKDAVAIAIVEFQRQRPVVSTSETHDGEKDVQGSPTPSELSMSSDLLDEHWFGGMDAGSYYASLAQGMLMEPPSARTWSEDGGEYSGVYTPLWN

SEQ ID NO: 25519 - protein, 139 aa, Caulobacter crescentus CB15
MSTDLFPQAHSKHDLERGFALAPRFNADGLVVAVAQHADTGEILMLAWMNAEALKLTVETQIAHYFSRSRNELWKKGDTSGQLQDVVELRVDCDQDAVLLKVRPRGDGGACHVGFRSCFYRVLENGVLVEREAPLHDHA

SEQ ID NO: 25520 - protein, 478 aa, Listeria monocytogenes str. 4b F2365
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLSSAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 25521 - protein, 94 aa, Oryza sativa (japonica cultivar-group)
MGFVMEFAENLILRMMEDPGKRDAAQREHVYRMKERCERTKAAWSLPLRPYGFWTFDRFNSQLSWDPQISHAPGRRDPYDDVLHRHSNPPPSSS

SEQ ID NO: 25522 - protein, 813 aa, Myxococcus xanthus DK 1622
MRTHRMSRLVGAALSTALFITGCSESDYVRLYHSAARAPSYSVDDIESLRQIGPTYVDKGVNFALYSENATRLELLLFEDPESNRPARAYEMTRYGDVWSVYVEGVGVGQHYGFRAWGPNWEFDPRWFPGSIHGFKADADVYGNRFNPNKLLTDPYSKALHRDHDWSKGSTASGPARTQVTYAASAKSVLVKSGDYQWGEVEQQWRANRQDENWQGHGWQDLIVYEVHAKGFTADPASGVRFPGTYRGFGEKAAYLAELGITAVELLPIHEKPLDGGYWGYQTINFFAPELSYAAFKEPHQVINEFKWMVEQLHKHGIEVIIDVVYNHTGEGGLWREKLETDDVMPGEPLESLDPAETAGLYSFRGIDNQAYYALNPDRRTYWNNTGVGNQTRPNHRPTRKLIIDSLRFYVEELHVDGFRFDLAPILGERDGDYNRWDDPRNTVLQDVIDDPVLQKYNTRIMAEPWSAGGWYCMPLGEFPNAKTQPGNGWYEWNGRFRDWWRAFMNQDGWKLNSNEGSLCGRPGTVDGGFLMYGSQEWFERNGRRPYHSMNFITVHDGFTMYDLFAYDEKQNRCGPLNPVCCDTPNSPFCDKVSGEEHNRSRNWGPIGDERAESMRRQMIRNAFMSMMISHGTPMILGGDEWMRTQLGNNNAYSTLSDNPFNWYQWGTYLARDERHRMFEFVKAAIRLRKEHAYAFAPKDYGKGAPLAWKSAQNTEAAWDSKQLMIHYHDASYGPELLVLINMEPRAVTFTLPEGRKWTRLIDTQAYFDSSAYLTTAGLDSRSTGNSWLDAPSPVNGPTYGMPERTIVVLRAE

SEQ ID NO: 25523 - protein, 332 aa, Candida glabrata CBS 138
MSTENGGNSTLENLRNAGTNVVTDTGEFELISKFKPRDSTTNPSLILAATKNPNYASLIDVAIDYAKAKGGTIEQQTNNAADRLLVEFGKRITDLIPGVVSTEVDARLSFDKKGTVDKALQIIKLYEENGVSKDRVLIKIASTWEGIQAARELEAQHGIHCNLTLLFNFTQAVACAEANVTLISPFIARVLDWYKANTKNDYNIENHPGVLFVKKTYNYYKKHGYKTIIMGASFRTLDEIRALAGLDNATLGIPLLENLQNSTEKIDRVLTPEGAQKDGVDMITLIDDEAKYRYEFNSDAMAVEKLADGIRTFAKDTNTLYSLLRTKLEKAN

SEQ ID NO: 25524 - protein, 202 aa, Triticum aestivum
MDADAASPSDQHRTVWTEPPKRPAGRIKYKETRHPLYRGVRRRGRYGRWVCEVRVRGTKETRLWLGTFRTAEMAARAHDSASLALSGSAACLNFADSAWRMLPVLAAGSSSFSSAREIKDAVAVAVVAFQRQRSVASTADGEKDVQGSPTPSELSTSSDLLDEHWFGGTDAGSYYSPGMFMEPPERPGNRELGAGEVETLLW

SEQ ID NO: 25525 - protein, 233 aa, Aeropyrum pernix K1
MVEVVSVREHDRWRGVYVVELEDGSLRIATKNLVPGQRVYGERIFRYNGEEYREWNAYRSKLAAALLKGLIELPVKEGDRILYLGIASGTTASHMSDIIGPRGRIYGVEFAPRVMRDLLTVVRDRRNIFPILGDARFPEKYRHLVEGVDGLYADVAQPEQAAIVVRNARFFLRDGGYMLMAIKARSIDVTTEPSEVYKREIKTLMDGGLEIKDVVHLDPFDRDHAMIYAVMRR

SEQ ID NO: 25526 - protein, 376 aa, Zea mays
MAEEDVQPLVCDNGTGMVKAGFAGDDAPRAVFPSIVGRPRHTGVMVGMGQKDAYVGDEAQSKRGILTLKYPIEHGIVGNWDDMEKIWHHTFYNELRVAPEEHPILLTEAPLNPKANREKMTQIMFETFSCPAMYVSIQAVLSLYAMGRTTGIVLDSGDGVQHCPPIYEGYTLPHAIIRLDLAGRDLTDNLMKILTERGYSFTTTAEREIVRDIKEKLAYIALDYEQELETARTSSTVEKSYELPDGQVITIGAERFRCPEVLFQPSFIGMESPGIHEATYNSIMKCDVDIRKDLYGNVVLSGGSTMFPGIGDRMSKEIAALAPSSMKVKVVAPPERKYSVWIGGSILASLSTFQQMWISKEEYDESGPGIVHMKCF

SEQ ID NO: 25527 - protein, 202 aa, Triticum aestivum
MDADAASLSDQHRTVWTEPPKRPAGRIKYKETRHPLYRGVRRRGRYGRWVCEVRVRGSKETRLWLGTFRTAEMAARAHDSASLALSGSAACLNFADSAWRMLPVLAAGSSSFSSAREIKDAVAVAVVAFQRQRPVASTADGEKDVQGSPTPSELSTSSDLLDEHWFGGTNAGSYYSPGMFMESPEQPENHELGGGDVKTPLW

SEQ ID NO: 25528 - protein, 212 aa, Triticum aestivum
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGLPAPSALSMSSELLNEHWFGGMDAGSCYSEFMESPDTRPWREDFELGGVETPPWSYLFD

SEQ ID NO: 25529 - protein, 262 aa, Zea mays
MVVRELNGGRLEVTEIFNFSQDDLLTEDMMILDTHGEVFIWIGQYVESKEKQKAFDIGQACHRWDASAGREDVETLAQCQRMIACGEWPPLAVAYDHVEGSTMEAGGMQVLVDQMMAVTESSRFHVSLKKDDVHIRRLIINQVLPPSASFCRFCAAKWRKLEHKMLDNFFSVLSCVISVPFYTGFLPLLFWSGHGRLARQMTLLMAFCDYLGNSVKVLPSACIQLKIFVTLCPDIWRTWQSYSCCGFISSSLTPNLLRVFQQ

SEQ ID NO: 25530 - protein, 336 aa, Pseudomonas putida GB-1
MSRVTLSRYLIEQTRSNNTPADLRFLIEVVARACKEISHHVSKGALGGVLGSMGTENVQGEVQKKLDVISNDILLEANEWGGHLAGMASEEMDNAYQIPGKYPKGAYLLVFDPLDGSSNIDVNVSVGTIFSVLRCPNQYLSQNESLNEEAFLQPGTEQVAAGYAIYGPQTMLILTLGNGVKGFTLDRELGSFVLTHENIQVPATTAEFAINMSNQRHWEAPVQRYVGELLAGETGPLKKNYNMRWIASMVADVHRILTRGGLFMYPRDAREPSKPGKLRLMYEANPMSFIIEQAGGASTNGYDRILDIKPESLHQRVSVILGSKEEVERVTAYHKE

SEQ ID NO: 25531 - protein, 590 aa, Nicotiana plumbaginifolia
MALPETQQDTKTLPDAWDYKGRPAVRSSSGGWSSAAMILGIEAVERLTTLGIAVNLVTYLTGTMHLGNASSANNVTNFLGTSFMLTLLGGFVADTFLGRYLTIGIFTTIQAMGVTILTISTIIPSLRPPKCSPGSSTCIPASSKQLMVLYIALYMTALGTGGLKSSVSGFGSDQFDETDKKERGQMIKFFNWFFFFINVGSLGAVTVLVYIQDNLGREYGYGICACAIVIGLVIFLSGTRKYRFKKLVGSPLTQIASVFVAAWNKRHMDLPSDSTLLYNIDDIPGDGNKKAKQRLPHSKEFRFLDKAAIKVQDTESAGITVVNKWNLSTLTDVEEVKLVVRMLPTWATTIMFWTVYAQMTTFSVSQATTMDRHIGNFEIPPASLTLFFVGSILLTCIFYDRAVVPVCRRVLNNPHGTTPLQRIAVGLILSIIAMVAAALTEVKRLNVAHLHGLTNDANAKVPLSVFWLVPQFLLVGAGEAFTYIGQLDFFLRECPKGMKTMSTGLFLSTLSLGFFVSSILVTIVHKVTVKNPWLADNLNQGRLYDFYWLLATLSVLNLMVFLFISRRYVYKEKRLAECGIEMEDSEPACH

SEQ ID NO: 25532 - protein, 345 aa, Arabidopsis thaliana
MASSTGEKGLIVSFGEMLIDFVPTVSGVSLSESPGFLKAPGGAPANVAIAVSRLGGRAAFVGKLGDDDFGHMLAGILRKNGVDDQGINFDEGARTALAFVTLRSDGEREFMFYRNPSADMLLRPDELNLELIRSAKVFHYGSISLITEPCRSAHMKAMEVAKEAGALLSYDPNLREPLWPSPEEARTQIMSIWDKADIIKVSDVELEFLTENKTMDDKTAMSLWHPNLKLLLVTLGEKGCTYFTKKFHGSVETFHVDAVDTTGAGDSFVGALLQQIVDDQSVLEDEARLRKVLRFANACGAITTTKKGAIPALPTDIEALSFLKDQKKRQTNLKFSKWCCTASPC

SEQ ID NO: 25533 - protein, 594 aa, Nicotiana plumbaginifolia
MALPETQQDSKALPDAWDYKGRPALRSSSGGWASGAMILGVEAVERLTTLGIAVNLVTYLTGTMHLGNATAANNVTNFLGTSFMLTLLGGFVADTFLGRYLTIGIFATVQAMGVTILTISTIIPSLRPPKCEQVGSSSCIPANSKQLMVLYIALYMTALGTGGLKSSVSGFGTDQFDDGDKKEKGQMIKFFDWFFFFINVGSLGAVTVLVYIQDNLGREWGYGICACAIVIGLVVFLSGTRKYRFKKLVGSPLTQIASVIVAAWKKTHLELPSNSSLLFEIDNIFGEGNKKSKQKLPHSKEYRFLDKAAIKEDNDLESNGTKVVINKWKLATLTDVEEVKLLIRMLPTWATTIMFWTVYAQMTTFSVSKATTMDRHIGTFEIPPASLTVFFVGSILLTVIFYDRIIVPICRRFMNKPHGLTPLHRIFTGLVLSILAMIAAALTEVKRLKVAHLHGLTNDANATIPLTVFWLVPQFLLVGAGEAFTYIGQLDFFLRECPKGMKTMSTGLFLSTLALGFFVSSILVTIVHVVTGTKNPWLADNLNQGRLYDFYWLLAILSVFNLMFFLYSSRKYVYKEKRLAEMGIELEDDGPVCH

SEQ ID NO: 25534 - protein, 131 aa, Glycine max
  misc_feature (54)..(54): Xaa can be any naturally occurring amino acid
  unsure (1)..(131): unsure at all Xaa locations
LTGCFNGIKVLQEQYETESIAQHGVELLYATMTKIFSSLQEAYKGQIVGFYILXVATTQESGKKFDVIFTPHHPYARWLAETNAVNATLPEVVLVRRTLAWVTGIILLISTFMGVSISEIMILVNSYIIIY

SEQ ID NO: 25535 - protein, 92 aa, Triticum aestivum
MPATPTIIGALLGLGTQMYSNALRKLPYMRHPWEHVLGMGLGVVFVNQLVKFDEKTKTTISCSNLFGGNRGFFSLLWSEKLAPHFICGSVIN

SEQ ID NO: 25536 - protein, 392 aa, Zea mays
  misc_feature (168)..(168): Xaa can be any naturally occurring amino acid
  misc_feature (172)..(172): Xaa can be any naturally occurring amino acid
  unsure (1)..(392): unsure at all Xaa locations
DRTACIWKLPNLVFSVALKGHKRGIWSVEFSPVEQCVMTSSGDRTIKIWSVADGSCLKTFEGHTSSVLRASFLSRGTQVVSCGSDGLVKLWTIKTNECIATYDKHDGKVWALAVGRKTEMVATGGTDAVLNLWHDCTMEDKQEDFRKKASETFCDTLVCHCQARCLLXEKLXNSSVLDLEQEVLRGQELENAVSDSDYAKAIQLAFELRRPHKLLDLFSQLARRADAEDPIEKALLGLPKDGLRVLLEYAREWNTKPKFCHVAQFVLFRVLRSFSPTDILEIKGISELLEGLIPYSQRHFSRVDRLVRSTFLLDYTLTRMSVVDPDVDAGSIKDEMNGSSVENGELAEPRPASPVPEKSSKKRKSGKSSKKGKEKVMKLASSGLGKGVSVEA

SEQ ID NO: 25537 - protein, 214 aa, Triticum aestivum
MDAVDAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHPVASMAPLSPARTTDDEKEIDGSPAPSALFMSSELLNEHWFVGIDAGSCYSEGLFMESPDTRPWREDLELGGVETPPWSYLFD

SEQ ID NO: 25538 - protein, 302 aa, Neurospora crassa
IRSFATHAQLPISIVNREDDAFLNPNFRFIDHSIIGKNVPVADQSFRVGCSCASDEECMYSTCQCLDEMAPDSDEEADPYTRKKRFAYYSQGAKKGLLRDRVLQSQEPIYECHQGCACSKDCPNRVVERGRTVPLQIFRTKDRGWGVKCPVNIKRGQFVDRYLGEIITSEEADRRRAESTIARRKDVYLFALDKFSDPDSLDPLLAGQPLEVDGEYMSGPTRFINHSCDPNMAIFARVGDHADKHIHDLALFAIKDIPKGTELTFDYVNGLTGLESDAHDPSKISEMTKCLCGTAKCRGYLW

SEQ ID NO: 25539 - protein, 647 aa, Candida glabrata CBS 138
MSSQFFLKTSKDIELFQGYPDFTQSNSAANAKDDQVISSVLSPCGRFFAISTKGNVKVFSGELLEVELLNLTINDVYEIQFSPSGNYMSTWERPSAKDAEHKNVKVWYLNKVFTEGEEQEPVFQYQHKPQNGWFMQFSKLDDYALKMFKNEIRIVKINDANKTNFHFDQPFATLSKTQENDSQPFSTYQVSPADFPTICTFTPEKGGKPAQLSIWSITEGKITKKIASKTFFKADSCQLQWNPQGNAVLCVATTDFDSTNKSYYGENTLYLLSFQGVNGAVGNNSVRVSLAKGPVHDISWSPTSRQFGVISGYMPATIQFFDLRGNVVHSLEKQPKNTILFSPSGRYILIAGFGNLQGSVQILDRHDKFKSLTVFNAANTSVCKWSPGGEFIMTATTSPRLRVDNCIKIWHVSGTLVFAKEFEELLKVDWRNTCKYKTLKDHPHVIKDWTPLNNTDAASLDPQIASPKKDLAIHESAKEYEAKHPKRDAKTGNGSTQSKSASTGGAYKPPHARRAAAVANNRSVPGASPKVQRAIPGLIPGLPVNEGSAAANKNRKRRANKKANSGTGEGAEKAESPAAPSITSTEPAKEASPEEKKIRSLLKKLRAIEMLKEKQAAGEKLQDLQVKKIETEGKFREELAALGWKEE

SEQ ID NO: 25540 - protein, 222 aa, Triticum aestivum
MDVADAASKSGQHEQGHRTVSSEPPKRPAGRTKFHETRHPLYRGVRRRGRVGQWVCEVRVPGVKGSRLWLGTFTTAEMAARAHDAAVLALSGRAACLNFADSAWRMLPVLAAGSFGFGSAREIKLAVAVAVVAFQQQQIILPVACPTVEAAASPSNSLFYMSSVDLLELDEEQWFGGMDAGSYYESLAQGMLMAPPDDRARREDAEQTGVETPTPLWSYLFD

SEQ ID NO: 25541 - protein, 301 aa, Pyrobaculum aerophilum str. IM2
MLQYGVLICGVVPVRKPRDIEKALEAPVTCLELRLDYLEADLAEVRPLLEHAVARRVVIFTVRRREEGGQWRGDEEGREALYRKLLELNPHYIDVEAESPIIGEVAKIKGKAQLIASRHDFEKTPPLDVLSQWAKKAAAVGDLVKIVTYAKEPGDGLRVLSLIGAVEKPTVAFAMGPAGAYTRVAAAALGSPIMYVSLGEATAPGQLTADAYYAALLALGITPSGGGLPALREALDWVDGGLMYLLKKRLEVCRDMGRLKKDAGLPIYDDVREAQVLRRAGDFKQIFELVVQMCKAVQLVA

SEQ ID NO: 25542 - protein, 222 aa, Triticum aestivum
MDVADAASKSGHQEQGHRTVSSEPPKRPAGRTKFRETRHPLYRGVRRRGRVGQWVCEVRVPGVKGSRLWLGTFTTAEMAARAHDAAVLALSGRAACLNFADSAWRMLPVLAAGSFCFGSAREIKLAVAVAVVAFQLQQNIPPAACPTVEPTDSPSNSLFYMSSGDLLELDEEHWFGGMDAGSYYDSLAQGMLVEPPDDRARREDAEQTGVETPTPLWSYLFD

SEQ ID NO: 25543 - protein, 157 aa, Ostreococcus tauri
MRGTMTDDDAHAIVRANRPDGVQRGLVAEIIARFARKGFTLRAMKMMNVTKEHAEKHYADLSSKPFFGGLVSYMCSGPVVAMVWEGKDVVKTGRKIIGATNPAASEPGTIRGDFCIEVGRNVIHGSDAVESANHEIGLWFPEGVCEYEPCAKAWIYE

SEQ ID NO: 25544 - protein, 393 aa, Listeria monocytogenes str. 4b F2365
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLETNGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 25545 - protein, 147 aa, Nostoc punctiforme PCC 73102
MIIDKLTMTQTVESLFDTGLERYKAGEAVDSLIPVFKEVCDRAPKTSAAWICLAWLYLLDNKPNLAYKAAQKAVKLNPQDPQARVNIALAMLETGQKGLREHIDIAQQLIFVNEEWQDEIKNSIEDGLTRKPDWQSLKKVKNWLFEE

SEQ ID NO: 25546 - protein, 536 aa, Ostreococcus tauri
  misc_feature (536)..(536): Xaa can be any naturally occurring amino acid
  unsure (1)..(536): unsure at all Xaa locations
MNRRRGERATDSDASTDDASTSDRALRRALSRVDILFLGVGGIVGAGVFVLTGEVASRRAGPGVAASYALAAMTSAITGLAYAEFATMMPEAGSSYSYAYAAFGEFGGVITGGNLVLELLIASAAIARGWTSYAAALVGCERGGGAVERHRGRRRRGRRRGIGRGAMTACSSRGAKETARFNFAVTCASLLVIALVVVAGSTKIDVANWSPFAPYGVGGIISGAAVVIFSFVGFDTVATCAEEVADPSVDLPIGILGSLGICASLYVIMCLVITGMISYADIDVNAPFAVAFTNFGMSWVASFVSVGALAAITTSLLLSMMGQPRIFMVMARDGLLPPWFSRVSERFGTPANATIFSGIVTGVMAVLLDINLLAQLVSIGTLSVFCCVNLGILIVRCTPEDADWSRRTPPLRRALGLLLSSLAFGLDYRQRGSAVSWFGVLCLALVVVSTLSFLTLPVVAKSGSRKTFRAPMVPFLPAVGVLLTCVLIGGLGAMAWIRYIVYTLACTAAYVTFAWRQYEHQKASSSASSGIELAEX

SEQ ID NO: 25547 - protein, 196 aa, Candida albicans SC5314
MNRGRGGFRGGRGGRSGPVQYGPPDTVLEMGSFMQACEGDIVCRSINVKIPYFNAPIYLENKTQVGKVDEILGPLNEVFFTIKPSEGVKAESFKEGDKFYIGPDKLLPLERFLPKPPSVGPKPKRKTGGKSAGGSSRGGFSSRGGGRGGFSSRGGGRGGFSSRGGGRGGFSSRGGGRGGARGNSRGGFRGGRGGRF

SEQ ID NO: 25548 - protein, 219 aa, Triticum aestivum
MILGAGPIVIGQACEFDYSGTQACKALVEEGYEVVLVNSNPATIMTDPDLAHRTYIGPMTPPLVEGIIANERPDALLPTMGGQTALNLAVSLAESGALDRLGVRLIGASLPAIRAAEDRQLFKQAMDRIGLKTPPSGIGTTLEECLAIAKDIGEFPLIVRPAFTLGGTGGGIAYNRAEFEDICRSGLAASHTQQVLVEKSLLGWKEYQLEVMRDMADNV

SEQ ID NO: 25549 - protein, 113 aa, Mycobacterium tuberculosis H37Rv
MNRLDFVDKPSLRDDIPAFNPGDTINVHVKVIEGAKERLQVFKGVVIRRQGGGIRETFTVRKESYGVGVERTFPVHSPNIDHIEVVTRGDVRRAKLYYLRELRGKKAKIKEKR

SEQ ID NO: 25550 - protein, 291 aa, Bifidobacterium longum DJO10A
MGNGVNLRTLTNDGGSAVISDYGAHLLRWAPAGQPDVIWTPRTWHFEAGQPVGGGVPVCFPWFGPGFVHGGQTAKRPIHGFARLRQWALDEGAFTGARVRYVLDSERLTTGEVPWIEDEPNVRFHAAYEVCASDTLTMTLTVTNTGGEPMSYEAALHSYLHVGDVLGARLVGLRGATYLDATEAGFPPKLQEQPSVMFGDQPVDRVYYSDAALELQDHVLGRVIRIGKTGSPQTVVWNPGEQGGNAIAHAKTGEWRGFVAVEAAACRDRIVALSPGESYMLSQSIAVMPLG

SEQ ID NO: 25551 - protein, 388 aa, Shigella flexneri 2a str. 301
MIQFRVVWVDDRNQIQVNRAWRVQFSSAIGPYKGGMRFHPSVNLSILKFLGFEQTFKNALTTLPMGGGKGGSDFDPKGKSEGKVMRFCQTLMTELYRHLGADTDVPAGDIGVGGREVGFMAGMMKKLSNNTACVFTGKGLSFGGSLIRPEATGYGLVYFTEAMLKRHGMGFEGMSVSVSGSGNVAQYAIEKAMEFGARVITASDSSGTVVDESGFTKEKLARLIEIKASRDGRAADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 25552 - protein, 219 aa, Alteromonadales bacterium TW-7
MRKLKNLFDNNKNWAARTSEANPEFFKILSMQQNPEYLWIGCSDSRVPANQIVDLLPGELFVHRNVANVVVHTDHNCLSVMQYAVEVLKVKHIMVVGHYGCGGVQAVLSDAKFGFIDNWLRHVGDVKEKHIDQLNSIDEEQRLSRLIELNVIEQVRNVCRTNIVQDAWERGQDLTIHGWVYGLENGHLHDLEAVVTCAEEESDSYKRAIQHVFKKAGCE

SEQ ID NO: 25553 - protein, 453 aa, Arabidopsis thaliana
MDSANLHQLQDQLQLVGSSSSSSSLDNNSDPSCYGASSAHQWSPGGISLNSVSLSHNYNNEMLNTRAHNNNNNNNTSECMSLSSIHNHSLIQQQDFPLQWPHDQSSYQHHEGLLKIKEELSSSTISDHQEGISKFTDMLNSPVITNYLKINEHKDYTEKLLLKSMSSGFPINGDYGSSLPSSSSSSSPSSQSHRGNFSQIYPSVNISSLSESRKMSMDDMSNISRPFDINMQVFDGRLFEGNVLVPPFNAQEISSLGMSRGSLPSFGLPFHHHLQQTLPHLSSSPTHQMEMFSNEPQTSEGKRHNFLMATKAGENASKKPRVESRSSCPPFKVRKEKLGDRIAALQQLVSPFGKTDTASVLMEAIGYIKFLQSQIETLSVPYMRASRNRPGKASQLVSQSQEGDEEETRDLRSRGLCLVPLSCMTYVTGDGGDGGGGVGTGFWPTPPGFGGGT

SEQ ID NO: 25554 - protein, 532 aa, Trichodesmium erythraeum IMS101
MKNGSISPVVLIILDGWGYREEKYGNAIAVGKTPNIDSLWQAYPRTLIQASGKAVGLPEGQMGNSEVGHLNIGAGRVVPQELVRISDAIEDGLIVQNQAIKKICQDVIERNSKLHLVGLCSSGGVHSHVNHLLGLLDVAKAKGISDVCVHAITDGRDTNPKSGLHVLKQIEYHTNQIGIGRIATVSGRYYAMDRDKRWDRIQKAYEVMTQDGYGTGCSASDLLQKSYAEGITDEFVLPVRVAPGAVEPGDGVIFFNFRPDRARQLTQAFVAPDFNGFERQTIQPLTFLTFTQYDSSFPVLVAFEPQNFNNILGQVISQHGLRQFRTAETEKYAHVTYFFNGGLEQPFEGEDRELVQSPMVSHYDEAPEMSAEDLTEVAIAAVKKQIYSLIVINYANPDMVGHTGAMDAAVNAVQTVDHCLGKLLQGISKVGGTAIIIADHGNAEYMWDEDGNPWTAHTTNLVPFILIEGEVSKIPGHGTKVPLRENGCLADIAPTILEILNLPQPAEMTGKSIIKKAEYELKPNRTPVRVGL

SEQ ID NO: 25555 - protein, 398 aa, Streptococcus pneumoniae R6
MAKLTVKDVDLKGKKVLVRVDFNVPLKDGVITNDNRITAALPTIKYIIEQGGRAILFSHLGRVKEESDKAGKSLAPVAADLAAKLGQDVVFPGVTRGAELEAAINALEDGQVLLVENTRYEDVDGKKESKNDPELGKYWASLGDGIFVNDAFGTAHRAHASNVGISANVEKAVAGFLLENEIAYIQEAVETPERPFVAILGGSKVSDKIGVIENLLEKADKVLIGGGMTYTFYKAQGIEIGNSLVEEDKLDVAKALLEKANGKLILPVDSKEANAFAGYTEVRDTEGEAVSEGFLGLDIGPKSIAKFDEALTGAKTVVWNGPMGVFENPDFQAGTIGVMDAIVKQPGVKSIIGGGDSAAAAINLGRADKFSWISTGGGASMELLEGKVLPGLAALTEK

SEQ ID NO: 25556 - protein, 344 aa, Glycine max
  misc_feature (128)..(128): Xaa can be any naturally occurring amino acid
  misc_feature (157)..(157): Xaa can be any naturally occurring amino acid
  misc_feature (170)..(170): Xaa can be any naturally occurring amino acid
  unsure (1)..(344): unsure at all Xaa locations
MAQVRNKQVLLKDYVTGFPKESDMNIVESTITLKLPQGSNDVLLKNLYLSCDPYMRNLMNRPEGPPNSRAYTPGSPLIGYGVSKVLESGHPDYKEGDLVWGFTKWEEYSLLPSAQILFKIEHTDVPLXYYTGILGMPGVTAYAGLFEVGSLQKGEKXFVSAASSPAGQLXVGQCAKLNGCYVVGSAGSKEKVDLLTNKFGFDGGFNYKEEPDLDAALKRHFPEGIDVYFENVGGKTLDAVLLNMRVRGRIPVCGMISQYNLTQHEGVTNLAQIIYKRIRLQGFNFMDFVHLYPKFLEFLLPNIREGKVVYVEDIAEGLENGPSALVGLFSGRNVGKQVLVVSHE

SEQ ID NO: 25557 - protein, 386 aa, Arabidopsis thaliana
MSVYDAAFLNTELSKPTSIFGLRLWVVIGILLGSLIVIALFLLSLCLTSRRKNRKPRADFASAAIATPPISKEIKEIVPAQNQSVPAEIQVDIGKIEHRVVFSDRVSSGESRGTASASETASYSGSGNCGPEVSHLGWGRWYTLRELEAATNGLCEENVIGEGGYGIVYRGILTDGTKVAVKNLLNNRGQAEKEFKVEVEVIGRVRHKNLVRLLGYCVEGAYRMLVYDFVDNGNLEQWIHGDVGDVSPLTWDIRMNIILGMAKGLAYLHEGLEPKVVHRDIKSSNILLDRQWNAKVSDFGLAKLLGSESSYVTTRVMGTFGYVAPEYACTGMLNEKSDIYSFGILIMEIITGRNPVDYSRPQGEVFDKHIQSSLCFCKWSYYVSWL

SEQ ID NO: 25558 - protein, 269 aa, Triticum aestivum
MDVADIASRSGQQEQGHRTVSSEPPKRPAGRTKFHETRHPLYRGVRRRGRVGQWVCEVRVPGIKGSRLWLGTFNTAEMAARAHDAAVLALSGRAACLNFADSAWRMLPVLAAGSFGFDSAREIKAAVAVAVVAFQRKQIIPVAVAVVALQQQQVPVAVAVVALQQKQVPLAVAVVALQQLQVPVAVAVVALQQQQQIILPVACLAPEFYMSSGDLLELDEEQWFGGMEAGSYYASLAQGMLVAPPDERAGPEHGEQSGVQTPLWSCLFD

SEQ ID NO: 25559 - protein, 269 aa, Triticum aestivum
MDVADIASPSGQQGHRGHRTVSSEPPKRPAGRTKFHETRHPLYRGVRRRGRVGQWVCEVRVPGIKGSRLWLGTFNTAEMAARAHDAAVLALIGRAACLNFADSAWRMLPVLAAGSFGFGSASEIKAAVAVAVVAFQRKQIIPVAVAVVALQQQQVPVAVAVVALQQKQVPVAVAVVALQQLQVPVAVAVVALQQQQIILPVACLAPEFYMSSGDLLELDEEQWFGGMDAGSYYASLAQGMLVAPPDERARPEHGEQSGVQTPLWSCLLD

SEQ ID NO: 25560 - protein, 186 aa, Arabidopsis thaliana
VRNHISNIVPPPSRLCLLVAGFIDKTVRCLGYGASSEERTLAMIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 25561 - protein, 497 aa, Ustilago maydis 521
MPTLNLDLPNGIKSTIQADLFINNKFVPALDGKTFATINPSTGKEIGQVAEASAKDVDLAVKAAREAFETTWGENTPGDARGRLLIKLAELVEANIDELAAIESLDNGKAFSIAKSFDVAAVAANLRYYGGWADKNHGKVMEVDTKRLNYTRHEPIGVCGQIIPWNFPLLMFAWKLGPALATGNTIVLKTAEQTPLSAIKMCELIVEAGFPPGVVNVISGFGPVAGAAISQHMDIDKIAFTGSTLVGRNIMKAAASTNLKKVTLELGGKSPNIIFKDADLDQAVRWSAFGIMFNHGQCCCAGSRVYVEESIYDAFMEKMTAHCKALQVGDPFSANTFQGPQVSQLQYDRIMEYIESGKKDANLALGGVRKGNEGYFIEPTIFTDVPHDAKIAKEEIFGPVVVVSKFKDEKDLIRIANDSIYGLAAAVFSRDISRAIETAHKLKAGTVWVNCYNQLIPQVPFGGYKASGIGRELGEYALSNYTNIKAVHVNLSQPAPI

SEQ ID NO: 25562 - protein, 275 aa, Triticum aestivum
MDVADAASSSGQEQQGHRTVSSEPPKRPAGRTKVHETRHPLYRGVRQRGRVGQWVCEVRVPGVKGSRLWLGTFATAEMAARAHDAAVLALSGRAACLNFADSAWRMLPVLAAGSFGFGSAREIKAAVAVAVVAFQKEQIIPVAVAVVALQKQQIIPVAVAVVALQKQQIPVAVALVALQEQQVPVAVAVVALHRQQVPVACPATSGPGSALFYMSSSDLLELDEEQWFGGMEAGSYYASLAQGMLVAPPDERARPEDGEQSGVQTPLWSQSHLFN

SEQ ID NO: 25563 - protein, 308 aa, Candida glabrata CBS 138
MSAVFNNATLTDLVREDTYFKTLANIGKFQPQLNFMEQYWAAWYTYMNNDVLATGLMFFLLHEFMYFFRCLPWFIIDQIPYFRKWKLQPTKIPSTKEQLYCLKAVLLSHFLVEAIPIWTFHPMCEKLGITVEVPFPSIKKMSLEIALFFVLEDMWHYWAHRLFHYGVFYKYIHKQHHRYAAPFGLSAEYAHPLETMSLGFGTVGMPILYVMYTGNLHLFTLCVWITLRLFQAVDSHSGYDFPWSLNKFLPFWAGAEHHDLHHHYFIGNYASSFRWWDYCLDTESGPEAKVAREERMKSKAEQKAKKTN

SEQ ID NO: 25564 - protein, 270 aa, Mycobacterium tuberculosis H37Rv
MEEMALAQQVPNLGLARFSVQDKSILITGATGSLGRVAARALADAGARLTLAGGNSAGLAELVNGAGIDDAAVVTCRPDSLADAQQMVEAALGRYGRLDGVLVASGSNHVAPITEMAVEDFDAVMDANVRGAWLVCRAAGRVLLEQGQGGSVVLVSSVRGGLGNAAGYSAYCPSKAGTDLLAKTLAAEWGGHGIRVNALAPTVFRSAVTEWMFTDDPKGRATREAMLARIPLRRFAEPEDFVGALIYLLSDASSFYTGQVMYLDGGYTAC

SEQ ID NO: 25565 - protein, 290 aa, Triticum aestivum
MDVADAASPSGQEQQGHRTVSSEPPKRPAGRTKVHETRHPLYRGVRQRGRVGQWVCEVRVAGVKGSRLWLGTFTTAEMAARAHDAAVLALSGRAACLNFADSAWRMLPVLAAGSFGFGSAREIKAAVAVAVVAFQKEQIIPVAVAVVAIQKQQIIPVAVAVVAIQKQQIIPSPSWRSRSSRFQWPSPSWRSRNSRSQSPSPSWRFIGSRFQSRAREPPARAALCFTCRPATCWSSTRSSGLAAWRPGRTTRAWRRGCSWHRRTKERGRRTASRAASRRRYGATCSPNLAV

SEQ ID NO: 25566 - protein, 275 aa, Triticum aestivum
MDVADAASPSGQDQQGHRTVSSEPPKRPAGRTKVHETRHPLYRGVRQRGRVGQWVCEVRVPGVKGSRLWLGTFTTAEMAARAHDAAVLALSGRAACLNFADSAWRMLPVLAPGSFGFGSAREIKAAVAVAVVAFKKQQIIPVAVAVVALQKQQIIPVAVAVVALQKQQIPVAVALVALQEKQIPVAVAVVALHRQQVPVDDPATSGPGSALFYMSSSDLLELDEEQWFGGMDAGSYYASLAQGMLVAPPDERARPEDGEQSGVQTPLWSQSHLFN

SEQ ID NO: 25567 - protein, 344 aa, Synechococcus sp. WH 8102
MPRPTLLAGDMGGTKTLLALYDLEGETLIKRHQQRFVSADWSSLEPMLQAFVEERPKDVQAPTHGCIAVAGPVRNRQARITNLPWQLKEEDLAAAAGMQQLELVNDFGVLIYGLPHFGADQQVVLQEGSQDDGPLAILGAGTGLGMARGVRTSNGLMALSSEGGHREFAPRSDEEWQLACWLKQDLGVDRLSIERVVSGTGLGHIAHWLLQQPGAQSHPLRPVAEAWRRNMASDLPAQVSLAAEEGDPLMRHALDLWLSAYGSATGDLALQELCSGGLWVGGGTASKQRNGLQSPLFLEAMRDKGRFKDFISGLKVTAVIDPEAGLFSSACRARMLAESGGTLA

SEQ ID NO: 25568 - protein, 801 aa, Bacillus cereus E33L
MKKRLVMIGNGMAGIRCMEEILKHDCDSYEITIFGDEPHPNYNRIMLSHVLQGKTNIQNIIMNEYSWYEENEITLYTNERVQSIDREEKVIITEKNRTLTYDKLIIATGSSAFILPVEGSTLPGVTGFRTIEDTQFMMDTAKEKKKAVVIGGGLLGLEAARGLIDLGMDVHVVHLMPSLMEQQLDTKAASLLREDLEAQGMKFLMEKKTVKILGTNHVEGIQFEDGEVVDCDLIVMAVGIRPNTQIARDAGLIVNRGIVVNDYMLTNDESIYAVGECAEHDGIAYGLVAPLYEQGAILAKHISNLQTDGYSGSIVGTQLKVAGCDLFSAGQIYEDDQTKAISIFNECKRSYKKVLIRDNKVVGIVLYGDTADGTRLFSMLKKEEDIQEYTPASILHKAGEEIELDVATMSADDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLGFVHEDGCSKCRPALNYYLRMAIPEEYEDDKASRFVNERMNGNIQHDGTFSVIPRMYGGVTTADDLMKIAEVAKKYDVPLVKITGASRIGLYGVKKQDLPNVWADLNMTSGYAYSKSLRNVKSCVGSRFCRFGTKDSLGLGMLLEQSLEMVDTPHKMKMGVTGCPRNCAEVLTKDFGVVCVENGYQLYIGGNGGTEVREADFVMIVPTEDDVLHIATAYMQYYRETGIYGERTAYWTERLGFDHIKEILQDANMVTKLNERFQTARGTYKEAWGQALETKSLKAMYEVETVK

SEQ ID NO: 25569 - protein, 481 aa, Zea mays
MGRTIKKAKKAQSKKSKKKTESSSSSNPAIASGPAKVWQPGVDTLEDGEELQFDPQAYNYLRGFGIGWSCLSFDVVRDQLGLVRSEFPHTFYGVAGTQAEKASWNYIGVFKLSNISGKKREPIPASAVEADTDVDSDSSSDEEDEEINEDTKPILHLKKVAHAGCVNRIRSMTQKPHISATWGDTGHVQVWDLSSFLNSLAESGTAAPKEDDIIHKHLPLKVFSGHKDEGYAIDWSPLVTGRLVSGDCNKCIHLWEPTSNNWNVDANPFVGHSASVEDLQWSPTEADIFASCSVDGTISIWDIRTGKKPCISVKAHEADVNVISWNKLASCMIASGCDDGSFSVRDLRSIEEDSLVAHFEYHKKAITSIEWSPHEASSLAVTSEDHQLTIWDLSLERDAEEEAEFRAKMKEQANAPEDLPPQLLFAHQGQRDLKELHWHPQIPSMIISTAIDGFNVLMPSNIDTTIPGSTDAAMPSAEPQH

SEQ ID NO: 25570 - protein, 212 aa, Arabidopsis lyrata subsp. petraea
VVIDNLTNVWARLYVPMMTTTKSSVSKLLPLIVYFHGGGFCVGSTSWSCYHEFLARLSSRSRCMVMSVDYRLAPENPLPAAYEDGVNAILWLNKARNDNLWTKLCDFGRIFLAGDSAGGNIADQVAARLASTEDLTLKIEGTILIQPFYGGEERTESEKRVGNNKSSVRTLEGSDAWWRLSLPRGADREHPYCKPVKINSSTVIRTLVCVAE

SEQ ID NO: 25571 - protein, 130 aa, Pseudomonas putida GB-1
MKDWLDEIKWNSDGLVPAIAQDHKTGRVLMMAWMNRESLALTATEQRAIYWSRSRGKLWRKGEESGHVQKLHELRLDCDADVIILMVEQLGHIACHTGRESCFYRVYEDGQWKIVDPVLKDPDAIYSAGH

SEQ ID NO: 25572 - protein, 540 aa, Pseudomonas putida GB-1
MKLLAVRRLFRIQRVVIRYRLDDLLFEQPLLPWWLASLRLLMPWRWLPRKPTELSRGARLRLALQDLGPIFIKFGQLLSTRRDLLPTDIADELMLLQDRVPPFDPQKAVALIEEQLGAKVGEVFSRFDVEPLASASVAQVHAARLKTGEEVVVKVVRPGLKPVIAQDLAWLFLIAKAAERASADARRLHPVEIVGDYEKTIYDELDLLREAANASQLRRNFEGSELMYVPQVYWDLCRPKVLVMERIYGVPVTDMVTLADQRTDMKLLAERGVEVFFTQVFRDSFFHADMHPGNIFVSTVKPWSPQYIAIDCGIVGSLTAEDQDYLARNLIAFFKRDYRRVAQLHIDSGWVPAHTKVNEFEAAIRTVCEPIFEKPLKDISFGQVLMRLFQTARRFNMEVQPQLVLLQKTLLNIEGLGRQLYPDLDLWSTAKPFLERWMRDRYSPKAVFGNIHGQVEQLPHLANMARDLLERLSQPHLNDPQLPERRRQGDRWALRLLGAGLLGGGAVLAAGAAEAASLAAPAAWPAWLMLAAGLYLIVRQ

SEQ ID NO: 25573 - protein, 225 aa, Alteromonadales bacterium TW-7
MLKSRIKYNTASFVTSAPDITKLPADTGIEVAFAGRSNAGKSSALNALTDQKLARTSKTPGRTQLINTFELADVDNMRLIDLPGYGFAKVPIEMKKKWQKSLGEYLQKRQSLKGIVVLMDIRHPLKDLDRDLINWAIGSEIPVLALLTKADKLKQGARKAQVLQVRRELSELDGDITVHAFSSLKGTGLPEVAKKLDEWYLGPVIAVPPVEKVSDESSSDTNTAS

SEQ ID NO: 25574 - protein, 129 aa, Glycine max
MASETEAALAATPSDGPTVFDKIINKEIPSTVVYEDDKVLAFRDIDPQAPTHILIIPKVRDGLTGLSKAEERHCEILGRLLCTAKLVAKQEGLDDGFRIVINDGRDGGQSVYHIHVHLIGGRQMGWPPF

SEQ ID NO: 25575 - protein, 239 aa, Zea mays
CLLMTMESPTTAAGGELESYFSLGLTVSHSQKDNAEFPKVLLLLSAYLDKTVQQNEELLDSSKIKESTTIFHGQRVPELSIKLYAERIFKYAKCSPSCFVLALIYMERYLQQPNIYMTSFSVHRLLITSVVVAAKFIDDAFFNNAYYGRVGGISTREMNMLELDLLFGLDFRLKVDIETFESYCLQLEEALVLVLERPIQVQEANVTKHLICNSSADETCKHELGLERYSSQAVQGCSW

SEQ ID NO: 25576 - protein, 392 aa, Trichodesmium erythraeum IMS101
MYSINPAKRVQALPPYVFARLDELKARAREQGLDLIDLGMGNPDGATPKPVVEAAIAALQDSTNHGYPPFEGTASFRKAITDWYFRRYSVKLDPDGEALPLLGSKEGLTHLALAYINPGNLVLAPNPAYPAHFRGPLIAGGKVHSILLKPENDWIIDLADIPDSVAEQAKVFYFNYPSNPTGATAPREFFQDIVTFAKKYEILLVHDLCYAELAFDGYQPTSLLQIPGGKDIGVEFHTMSKTYNMAGWRIGFVVGNSNVIQGLRTLKTNMDYGVFSALQLAAKTALQLPDEYLSQVQERYRQRRDFLIQGLGKLGWNVQKTMATMYLWVPCPPGIGSTDFALSVLQKTGVVVTPGNAFGSGGEGYVRISLIAECKRLDEALNRFKKAGIYYQ

SEQ ID NO: 25577 - protein, 226 aa, Glycine max
  misc_feature (53)..(53): Xaa can be any naturally occurring amino acid
  misc_feature (76)..(76): Xaa can be any naturally occurring amino acid
  unsure (1)..(226): unsure at all Xaa locations
ILKWTFHPFILKNRKIYTVLIWCRVLAFLVASQVLRIITFYSTQLPGPNYHCXREGSKLATLPRPDSVFEVLLINXFPRGVIYGCGDLIFSSHMIFTLVFVLTYQKYGTRRSIKQLGWLLAVVQSLLIVASRKHYTVDVVVAWYTVNLVVFFIDKKLPELPDRSIAAATLLPLSTKDKDNRTKEENHKLLNGNSGDPADWRQRTQVNGKIMEDGNTLHADSAMNGA

SEQ ID NO: 25578 - protein, 315 aa, Glycine max
TQSQTIIDLSSPHRLSTANSIRQACVEYGFFYLVNHGVDTDFVSKVFDQSCKFFSLPVQRKMDLASKEYRGYTPLYAETLDPTSLSKGDPKETYYIGPIEDTSIAHLNQWPSEELLPNWRPTMKSLYWKLLAAGKSLLSLIALSLNLEEDYFEKIGALNKPASFLRLLHYPGELGSDEQICGASPHSDYGMITLLMTDGVPGLQICKDKVNQPQVWEDVPHVEGALIVNIGDMMERWTNCLYRSTLHRVMPTGKERYSVAFFFDPASDCVVECFESCCSESSPPRFSPIRSGDYLNERFRLTYGSEKDLKCDLSS

SEQ ID NO: 25579 - protein, 854 aa, Burkholderia xenovorans LB400
MSHSEGHIVLLAPMTGPVVPLANVPDPVFSGGMFGDGIGIDPLEGRLVAPCDGTVTHLARTGHAVTLATAEGAEILLHIGIDTVALNGKGFAPMVAQGAHVRAGQVLIEFDQDQVALNAPSLVSVVAIANSDAFEIVERVQGGLLKAGETPLLVLRARGGAAAEASRQASATNVAEEARQQVTLVHAGGLHARPAARAREAARGFDARVEVRYEGRKAAIESVVGLLGLGAGEGATVELLGIGPQARAAIEAIAHELTREAQGEAEEKPARESSPAPQAVGHAADEALAPNTLAGVCAAPGVAVGKLVRWDDADIDPPEKAAGTSAAESRLLDKAIATVDADLGTTVRDASQRGAVGEAGIFAVHRVLLEDPTLLDAARDLISLGKSAGFAWRAAIRAQIAILAKIEDALLAERAADLRDIEKRVLRALGYTNAASRTLPEEAVLAAEEFTPSDLSTLDRSRVTALVMARGGATSHAAILARQAGIPALVAVGDALHAIPEGTQVVVNATTGRLEFAPTELDVERARLERSRLAGVREANRRTSQQAAVTSDGRAIEVAANIATLDDAKTAVENGADSVGLLRTELLFIHRAAAPTTDEHRQSYQAIVDALSGRTAIIRTLDVGADKEVDYLTLPPEPNPALGLRGIRLAQVRPDLLDDQLRGLLAVRPLGAVRILLPMVTDVGELIRIRKRIDEFARESGRTEPIEVGVMIEVPSAALLADQLAQHADFLSIGTNDLTQYTLAMDRCQADLAAQADGLHPAVLRLIAATVQGAGKHGKWVGVCGALAGDPLAMPLLIGLGVTELSVDPVSVPGIKARVRNLDYQLCRQRAQDALALESAQAVRAASRETWPLD

SEQ ID NO: 25580 - protein, 857 aa, Brassica oleracea var. alboglabra
MKDVRIYHHSFLLVFVVVILFHPALSIYFNILSSTATLTISSNRTLVSPGDVFELGFFKTTSSSRWYLGIWYKKLYFGSIKNYVWVANRDSPLFNAIGTLKISNMNLVLLDQSNKSVWSTNLTRGNERSPVVAELLANGNFVMRDSNNKDASGFLWQSFDYPTDTLLPEMKLGYDHKTGLNRFLTSWRSSDDPSSGEISYKLDTQSGMPEFYLLINGSPDHRSGPWNGVQFSGIPEDQKLSYMVYNFIENTEEVAYTFRMTNNSIYSRLTISSKGILERWTWTPTSFSWNLFWSLPVDLKCDLYMACGAYSYCDVNTSPECNCMQGFMPFNMQQWALRDGSGGCIRRTRLSCSSDGFTRMKKMKLPETRMAIVDPSIGLKECRKRCLSDCNCTAFANADIRNGGTGCVIWTGELEDIMTYFAADLGQDIYVRLAAADIVKKRNADGKIITLIVGVSVLLLMIMFCLWKRKQKRAKAMATTIVNRQRNQNLLMKLMTQSNKRQLSRENKTEEFELPFIELEAVVKATENFSNCNELGQGGFGIVYKGMLDGQEVAVKRLSKTSLQGIDEFMNEVRLIARLQHINLVRILGCCIEADEKILIYEYLENSSLDYFLFGKKRSSNLNWKDRFAIINGVARGLLYLHQDSRFRIIHRDMKPSNILLDKYMIPKISDFGMARIFARDETEANTENAVGTYGYMSPEYAMDGVISEKTDVFSFGVIVLEIVSGKRNRGFYQLNPENNLLSYAWSHWAEGRALEIVDPVIVDSFSSLPSTFQPKEVLKCIQIGLLCIQERAEDRPTMSSVVWMLGSEATDIPQPKPPIYCLITSYYANNPSSSRQFEDDESWTVNKYTCSVIDAR

SEQ ID NO: 25581 - protein, 327 aa, Spiroplasma citri
MLKKIGILTSGGDSQGMNAAIAGVIKTAHAKGLETYIIRDGYLGLINNWIEVVDNNFADSIMLLGGTVIGSARLPEFKDPEVQKKAVDILKKQEIAALVVIGGDGSYQGAQRLTELGINCIALPGTIDNDITSSDYTIGFDTAINIVVEAIDRLRDTMQSHNRCSIVEVMGHACGDIALYAGIAGGADIISINEAALSETEIADRVAMLHQAQKRSVIVVVSEMIYPDVHKLAKLVESKSGYITRATVLGHTQRGGNPTAMDRYRAFQMAQFAVEQIIAGVGGLAIGNQGDQIIARPIMEALSIPRSSRKEIWAKFDQLNQNIYQKS

SEQ ID NO: 25582 - protein, 320 aa, Burkholderia vietnamiensis G4
MLRRARDPGARGAQRDDAMSGGTFPAFVSAGDILTDMVRAGDAQWTSVPGGAGWNVARAVARLGLPSALAGAIGEDCFSDVLWRASEAAGLDLRFLQRVPRAPLLAIVHETRPPAYFFIGDASADLAFDPARLPQGWAEHVKWAHFGCISLVREPLASTLVALAAQLHARGVKISFDPNYRNLMTAAYRPTLEKMAGLADLIKVSDEDLRHLFGGDGPDAVAAVRALNPRAAVFVTRGAQAATLYAGDDVLEASPPRVEVVDTVGAGDASIGGMLFSLMAAPQRSWREHLAFALAAGAAACRHTGAHAPTLDEVVALLER

SEQ ID NO: 25583 - protein, 220 aa, Vibrio cholerae O1 biovar eltor str. N16961
MSVKIHYQNTHFITSAPDIRHLPEDEGIEIAFAGRSNAGKSSSLNRLTNQKNLAKTSKTPGRTQLINLFKVADGCHIVDLPGYGFAQVPLEMKLKWQRALGEYLQKRQSLKGLVVLMDIRHPMKDLDQQLIIWAVECGIPVQVMLTKADKLKSGARKAQVLKVREEAKTFGGDVAVDAFSSLSGIGVDTLRAKLDEWYAPMLAALAEQEEGEQPESSTDQ

SEQ ID NO: 25584 - protein, 130 aa, Candida glabrata CBS 138
MTRSSVLADALNAINNAEKTGKRQVLIRPSSKVIIKFLQVMQRHGYIGEFEYIDDHRSGKIVVQLNGRLNKCGVISPRFNVKIGDIEKWTANLLPARQFGYVILTTSAGIMDHEEARRKHVSGKILGFVY

SEQ ID NO: 25585 - protein, 148 aa, Gloeobacter violaceus PCC 7421
MALWAISALMAASVLMSQAIAAQTASRAGAGGGGQLKITSDIQEADTKSGVVIARGNVRIEYPARKVVATAEKATYLRDEKKIILSGNVRVVQDENRMNAEVMTYFIDKGLFDAQPPSGKQVEAIYTVPPSEDPQEPPQKTSESKPQQ

SEQ ID NO: 25586 - protein, 189 aa, Zea mays
VRIQLGEGSAGQVTRNVLANEGVRSFYKGCFVFLGACLSAGLLRQATYTTARLGSFRKLFIGLTAGAIGACVGSPADLALIRMQADSTLPAAQRRNYKNAFHALYRITADEGEGVLALWKGAGPTVVRAMALNMGMLASYDQFFASACSLPFDYVKTQIQKMQPDANAYSSNDNSNANDLDILESDPEV

SEQ ID NO: 25587 - protein, 327 aa, Zea mays
MAKFSFNDADEDPPTFSSEGEKRKRDDGPGEAAASGGPSKARILTVEGEEQDGGAVVGAGRAEGNGSKGVETVVGGEADGISVRIDPDVLDCSICFDPLQPPLYQCQNGHVACFSCWSRLTNKCHICSSDANFVRNIALEKVVESVKSSCSYAKWGCNKLVSYACRNAHEESCLFAPSMCPIPGCGYRGFTGWWSGHFLTNHNSDGLRFSYGQCFDVSLEMSVPFLVLLAEDDHLFIFINKNVIPFGHALSVCCLRTGNLNWNFLYEMRATSKGNTKNSLQLKASVTNTREWRGLNPTEVFLLVPYAFSKSSKLTLNVSIERVADVK

SEQ ID NO: 25588 - protein, 385 aa, Azoarcus sp. EbN1
MPTFPARIDSRLPQVGTTIFTVMSRLAQECGAINLSQGFPDFNADDVLFERVAHWMRAGFNQYAPLAGVAPLREAIAHKVAALYGTAYDAETEITVTAGATQALFTAVAALVHPGDEVIVFEPVYDSYAPAIELQGGRVVRLQLAAPDYRPDWDAVAAAITPRTRMIMINSPHNPTATVWSADDLAHLAALTRGTGIVIVSDEVYEHIVFDGTRHESCARDAELAARSVIVSSFGKTYHITGWKVGYVVAPRELMAEFRKVHQFNVFTVNTPVQLALADYMADASRHEGLAAFYQAKRDFFRTALGGSRFELLPSAGTYFQLARYRAICDEPDTAFVERLTRDSGVAAIPVSAFFADGRDERVIRFCFAKNEATLAAACERLCRV

SEQ ID NO: 25589 - protein, 69 aa, Zea mays
MGFVVTSAIFFLAGFIACLFSLLCCNRGASTNIFHLTLVITATVCCWMMWAIVYLAQMKPLINPILSGE

SEQ ID NO: 25590 - protein, 417 aa, Vibrio cholerae O1 biovar eltor str. N16961
MDYFNYQEDGQLWAEQVPLADLANQYGTPLYVYSRATLERHWHAFDKSVGDYPHLICYAVKANSNLGVLNTLARLGSGFDIVSVGELERVLAAGGDPSKVVFSGVGKTEAEMKRALQLKIKCFNVESEPELQRLNKVAGELGVKAPISLRINPDVDAKTHPYISTGLRDNKFGITFDRAAQVYRLAHSLPNLDVHGIDCHIGSQLTALAPFIDATDRLLALIDSLKAEGIHIRHLDVGGGLGVVYRDELPPQPSEYAKALLDRLERHRDLELIFEPGRAIAANAGVLVTKVEFLKHTEHKNFAIIDAAMNDLIRPALYQAWQDIIPLRPRQGEAQTYDLVGPVCETSDFLGKDRDLVLQEGDLLAVRSSGAYGFTMSSNYNTRPRVAEVMVDGNKTYLVRQREELSSLWALESVLPE

SEQ ID NO: 25591 - protein, 513 aa, Oryza sativa (japonica cultivar-group)
MAWLDDVLSLCNNNTRMCNALVLSVVVVSFLQLLKHVLLTPSRLPLPPGPRNLPVVGSAHRLVNTLAHRVLRDLADVHGPLMHLRVGQVPVVVVTSKELARDILKTHDANFATRPKLVAGGIVAYDWTDILFSPSGDYWRKLRRLCIQEILSAKRILSFEHIREDEVRMLADEIRAVGPSVAVDLSARLHRITNTIVSRAAFGNKRSNAADFLVAIKQSVIMASGFYVPDLFPRFSVLLCWLTGMRRTLHGIRDTIDSILEEIISEKEEAKQQQDNNLVDVLLSLKDKGDFGFPITRDTIKAIVLDIFAGGSGTSANAMEWAMSELMMNPRVMNKVQAEIRDAFHGKQSIGEADLRARDLKYLKLVMKETLRLHPPAPLLVPRESIDACEINGYMIPAKARVIVNSWAISRDPRYWEDAEEFKPERFAEGGIDFYGSNYEYTQFGSGRRMCPGYNYGLASMELTLAQLLHSFDWSMPDGATEVDMTEAPGLGVRRKTPLLLCAAPYVASHIYA

SEQ ID NO: 25592 - protein, 114 aa, Glycine max
  misc_feature (37)..(37): Xaa can be any naturally occurring amino acid
  unsure (1)..(114): unsure at all Xaa locations
MISTLVVMTSNDFGEGTSPSAPGIETTRVIPKNKARXMTAGEETELHAGVKNDGDTSLNDIAIKASVHLPYDHRMLVHNVTAQGSNNGSVPSSAQATMPYVSAAVSSGRLNFRP

SEQ ID NO: 25593 - protein, 118 aa, Synechococcus sp. WH 8102
MVRLAGLLLMLLALIGPVLVPIPACALESALIEQGEQIFSSNCAACHMGGGNVIRANRSLKIRDLNAHLEEYQQDPLEAIEHQIEAGKNAMPSYEGKLTEAEIIAVATYVEQQAELGW

SEQ ID NO: 25594 - protein, 166 aa, Brassica napus
  misc_feature (12)..(12): Xaa can be any naturally occurring amino acid
  misc_feature (16)..(16): Xaa can be any naturally occurring amino acid
  misc_feature (27)..(28): Xaa can be any naturally occurring amino acid
  misc_feature (36)..(36): Xaa can be any naturally occurring amino acid
  misc_feature (40)..(40): Xaa can be any naturally occurring amino acid
  misc_feature (48)..(48): Xaa can be any naturally occurring amino acid
  misc_feature (50)..(50): Xaa can be any naturally occurring amino acid
  misc_feature (53)..(54): Xaa can be any naturally occurring amino acid
  misc_feature (60)..(61): Xaa can be any naturally occurring amino acid
  misc_feature (64)..(64): Xaa can be any naturally occurring amino acid
  misc_feature (66)..(66): Xaa can be any naturally occurring amino acid
  misc_feature (80)..(80): Xaa can be any naturally occurring amino acid
  misc_feature (84)..(84): Xaa can be any naturally occurring amino acid
  misc_feature (86)..(86): Xaa can be any naturally occurring amino acid
  misc_feature (88)..(88): Xaa can be any naturally occurring amino acid
  misc_feature (92)..(92): Xaa can be any naturally occurring amino acid
  misc_feature (94)..(95): Xaa can be any naturally occurring amino acid
  misc_feature (98)..(98): Xaa can be any naturally occurring amino acid
  misc_feature (103)..(103): Xaa can be any naturally occurring amino acid
  misc_feature (106)..(106): Xaa can be any naturally occurring amino acid
  misc_feature (111)..(111): Xaa can be any naturally occurring amino acid
  misc_feature (113)..(114): Xaa can be any naturally occurring amino acid
  misc_feature (117)..(117): Xaa can be any naturally occurring amino acid
  misc_feature (121)..(122): Xaa can be any naturally occurring amino acid
  misc_feature (127)..(128): Xaa can be any naturally occurring amino acid
  misc_feature (135)..(136): Xaa can be any naturally occurring amino acid
  misc_feature (145)..(146): Xaa can be any naturally occurring amino acid
  misc_feature (156)..(156): Xaa can be any naturally occurring amino acid
  misc_feature (159)..(159): Xaa can be any naturally occurring amino acid
  misc_feature (163)..(163): Xaa can be any naturally occurring amino acid
  unsure (1)..(166): unsure at all Xaa locations
MSSSMLSSAAVXTSPXAHATMVAPFTXXKSSAAFPXTRTXDNDVTSIXSXGGXXSCMKVXXPVXKXKFETLSYLPDLTEXELGXEXDXLLRXKXXPCXEFEVXHGXFVYRXEXXSTXGHYXXRYWDXXEASPCSXXTDSAQVLKXXPRVAKREYPXAFXRTIXFRQ

SEQ ID NO: 25595 - protein, 285 aa, Gloeobacter violaceus PCC 7421
MSDSPAIRGTTRLLGLLGYPVGHSLSPVMHNAALARLGLDLVYVPLPVAPADLPQAVAGLRRAGFVGFNVTIPHKQAIVPLLDTLTPEAKGAGAVNTVRVETDGSLTGTNTDIEGFMGPIETVPFQGAATILGCGGSALAVALGCAQLGFTRIHVVGRDPAKLAAFKSHLHPAATVEIDLWEQLESLLPGTGLLINTTPVGMIPATEASPLEDLGALPLKACVYDLIYRPRPTRLLQLAVARSLQTFDGLGMLVGQAEAAFYFWTGCKPPTQLMLQTACKALAHD

SEQ ID NO: 25596 - protein, 222 aa, Synechococcus sp. WH 8102
MQPLSPAFIDQLRFNEAGLIPAIAQDWLDGAVLMVAWMNRESIQQTLNSGEAHYWSRSRQELWHKGATSGHTQTLRSIRYDCDADVLLLTIEQRGDIACHTGARSCFYEGGDQRSDGGSNALSPPADACTELFRVIESRRDNPEEGSYTNKLLEGGDNKILKKIGEESAEFVMACKDDNPEEIAGEAADILFHMQVALAHHGVSWRQVQEVLAARRGAPRRH

SEQ ID NO: 25597 - protein, 471 aa, Symbiobacterium thermophilum IAM 14863
MSHSFDVVVIGGGPGGYVAAIRGAQLGLRVALVEQDKVGGTCLHRGCIPTKAYLRSAEVLHTLRQSREYGVLTGGVDLDFAAVRSRKDKVVSNLHKGIQGLLKKNGVAVFQGRGALVPPSIFSPNGLVSVMVGDQQELLEFNKVIIATGSRPKTLGIPVDGAHVMTSDEALARPDLPASVIIIGAGVIGMEWASLYADFGVRVTVLEFLDRILPTEDEAVAAELHKLMTRRKVEIVTGAAVLPESVQAEGGQVRVQARVGEQVREFQAEALLIAVGREPVTRGFGLENRERVTYGPGGFIQVDGFGRTGDPAIYAIGDVAGGGLAHVASHQGIIAMEHIAGLNPEPFAPVRVPRCVYTRPEVASVGLTEAQAREQGREVRVGTFPWRGIGKALVHGSVDGFAKIVADAATGDVLGVHLIGPDATNLIAEAGLALTLNASAWELGQVIHPHPTLAEIFGEAALAVEGRAIHM

SEQ ID NO: 25598 - protein, 282 aa, Oryza sativa (japonica cultivar-group)
MDWAAAGYTAAALVCAAAATVIALVHIYRHLLHYAEPIYQRFIVRLIFMVPVYAVMSFLSLILPDNSIYFNSIREIYDAWVIYNFFSLCLAWVGGPGAVVGVLVFLAAKSRFIKNAEKAADLQNFVLCVEMLIAAIGHLFAFPYNEYAGPNGRPSGDFKGSLLHALKFNDFYHDTVHQFAPTYNEYVLYNHNEGDSTQRKYPSVSTVPSGRDVELSGISVMPANSAVTSSVSSNQADQEETMSTPIKDRVDNVGLYDLTDLLDVDLSNYPAKVPAISDVRKQ

SEQ ID NO: 25599 - protein, 341 aa, Thermobifida fusca YX
MRVGVLTGGGDCPGLNAVIRAVVRKGIKEYGYEFVGFRDGWRGPLEGDTMPLDIEAVRGILPRGGTILGSSRTNLMKIEGGVERVKDNMAALGVDALVAIGGEDTLGVARQLHDHGVNVVGVPKTIDNDLNATDYTFGFDTAVNIATEAIDRLHTTAESHHRALVVEVMGRHAGWIALHAGMAAGANVILIPERPFDIDEVVAYIESRFKTNYAPIIVVAEGAHPKEGQLTLASAERDSFGHVRLGGIGQRLAEEIEARTGKEARSVVLGHVQRGGTPSAFDRVLATRLGLHAITAVHDKDFGKMVALRGTEIVRVDLSEATDQLKTVPVERYEEAEVFFG

SEQ ID NO: 25600 - protein, 345 aa, Symbiobacterium thermophilum IAM 14863
MKANVAINGFGRIGRMVCRRLLRHPDLNLVAVNASYPAETLAHLLKYDTVHGRLDAQVVAGDGEIVVDGHVVRLVSERDASRLPWRELGIDIVIDATGKHKERERAALHLHSGARKVIITTATKDPDVTVVMGVNEGAYRPAEHHIIAAASCTTNCLAPVAKVLHETFGIRTGLMTTVHAYTNDQNMLDNPHRDLRRARAATASIIPTTTGAAKAVAQVLPELKGRLNGFALRVPTPDVSVVDLVVQLERPATREEINDALRSAAQGPLRGILAYSDEPLVSADFIGDPHSAIVDGTLTMVGPDNLAKVIAWYDNEWGYSCRVVDLAALVARQLALEPPLEGVAD

SEQ ID NO: 25601 - protein, 947 aa, Miscanthus x giganteus
MAASVSGATICLQKPGSKGRRARDATSFARRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVMDIPRSLFEEKLEHMKESKGVKNDTDLTAADLKELVGQYKEVYLTAKGEPFPSDPKKQLELAVRAVFNSWESPRAKKYRSINQITGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGTGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 25602 - protein, 507 aa, Arabidopsis thaliana
MGYEKFTWVIKNFSSLQSEYIKSDIFVIGGCKWRIRFRLTVVNQLSENLSRRGGDFVFLWSTEGKRWFDKKLPLCGYEEVLLLTKLNAKHGGFLVNNEVKIVAEVDVLEVIGKLDVSKESQEVIKPRKRMRLYGDGGAVSSHLHKETSSVDVNGFQVLPSQAESVKRIFERHPYMALEFRAKNQQLRASCINVLLSLIKTLCQSLQDISIDDLGQTEQVLTFLQNSGFKVDWLERKLEEVKEKKIQEHIGKSRMQGLEEDLKVFKKKCSDIEALLEKEKEELKGLKQKCSDIEALLEKEKGKVLAAAARTPLTLDRMNILIGYREMISLTKLNAKKGGFLVNNKVKIVVEVDVLQVVGGLDVSQEVTQPLKRIRLNDDGAASTHLQTIDVNGFLVLASQVESVKRIFESHPEMTLTFRANNQQLRTSCINVLLNLIETMCMSPQNLSIADLGQTEQALTYLKNSGFKVDWLERKLEEVTEKKIQEHIGKSRMQGLEEDLKVFKKNLI

SEQ ID NO: 25603 - protein, 947 aa, Miscanthus x giganteus
MAASVSGATICLQKPGSKGRRARDATSFPRRSVAAPRSPHAAKASVIRSDAGAGRGQHCSPLRAVVDAAPIATKKRVFYFGKGKSEGDKSMKELLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFAYDSFRRFLDMFGNVVLDIPRSLFEEKLEHMKESKGVKNDTDLTAADLKELVGQYKEVYLTAKGEPFPSDPKKQLELAVRAVFNSWESPRAKKYRSINQIIGLVGTAVNVQSMVFGNMGNTSGTGVLFTRNPNTGEKKLYGEFLINAQGEDVVAGIRTPEDLDAMKDVMPQAYEELVENCNILESHYKEMQDIEFTVQENRLWMLQCRTGKRTGAGAVKIAVDMVSEGLVERRQAIKMVEPGHLDQLLHPQFENPAAYKDQVIATGLPASPGAAVGQIVFTAEDAEAWHAQGKAAILVRAETSPEDVGGMHAAAGILTERGGMTSHAAVVARGWGKCCVSGCSAIRVNDAEKTVAIGDHVLSEGEWISLNGSTGEVILGKQPLSPPALSGDLGTFMSWVDEVRKLKVLANADTPEDALAARNNGAQGIGLCRTEHMFFASDERIKAVRQMIMAPTVELRQQALDRLLPYQRSDFEGIFRAMDGLSVTIRLLDPPLHEFLPEGNVEEIVRELCAETGANEEEALERVEKLAEVNPMLGFRGCRLGISYPELTEMQARAIFEAAIAMSNQGVEVFPEIMVPLVGTPQELGHQVNVIKQVAEKVFTSMGKTIGYKIGTMIEIPRAALVADQIAEQAEFFSFGTNDLTQMTFGYSRDDVGKFIPIYLAQGILQHDPFEVLDQRGVGELVKFATERGRQTRPNLKVGICGEHGGEPSSVAFFAKAGLDYVSCSPFRVPIARLAAAQVLV

SEQ ID NO: 25604 - protein, 130 aa, Hordeum vulgare
MGKSWALLTHLHSVAGPSITLLYPLYASVCAMESPSKVDDEQWLAYWILYSFITLLEMVAEPVLYWIPVWYPVKLLFVAWLALPQFKGASFIYDKVVREQLRKYRGRNRNGDADHKVHILKAEADHGRVH

SEQ ID NO: 25605 - protein, 187 aa, Miscanthus x giganteus
MAASVSGATICLQKPGSKGRRARDATSFARRSVAAPRSPHAAKASVIRSDAGAGRGQHCSPLRAVVDAAPIATKKLGGKGANLAEMSSIGLSVPPGFTVSTEACKQYQDAGSILPAGLWAEILDGLQFVEEYMGATLGDPQRPLLLSVRSGAAVSMPGMMDTVLNLGLNDEVAAGLAAKSGERFDYD

SEQ ID NO: 25606 - protein, 233 aa, Triticum aestivum
MKKLYQGKGRRVHPAPAPGPHAADAALAMLPATLLALVAALTAEEQEVLAYLLSGGAGGAAGGRRRRLNGPHQPEMGCGCFGCYKSFWARWDASPNRHLIHRIIDAVEEGSGGGGEGAAKGAGGPGGATRRGHRRRRRGRGGPCAIDAAAEEHGAAEVHVGVPDDHLQGCCASDGGEDGDYEGDEDDGADSLYDGEEALTDDSDCAGANSSAEKSAVGKLVRFIGEKVWAAWT

SEQ ID NO: 25607 - protein, 323 aa, Ruegeria sp. PR1b
MPTSSMTDAATLGEMSRVLTTEASALQQMAEALGVPHLEAVRILEAMQGRVIVSGVGKSGHIGNKIAATLASTGTPAQFVHATEASHGDLGMVTARDVCLVISNSGETRELADIITYSRRFGIPLIAITRVAESTLAQQADVTLLLPDAPEACGIGVAPTTSTTATLAIGDALAVALMARRGFQREDFQVFHPGGKLGAQLMLVDALMHAGEALPLVLPDTPMAEALLTMTAKGFGVAGLIEEDRLAGIITDGDLRRNMTGLMEKTAGAVATRDPQVIRSGALASEALHEMNSRKISSLFVLDQDDHVVGLLHIHDCLRAGIA

SEQ ID NO: 25608 - protein, 194 aa, Arabidopsis thaliana
MISLTELHAEEGLLRNGELTVVAKVEVLEVVGKLDVSEESSPVIETIDVNGFQVLPSQVEYAKSLFERHLDIASKFRPKNPYLKTAYMNVLLSLTQTICQSPQELSNDDLSDAGAALAYLREAGFELDWLEKKLNEVKEKKKKEEACLAEIQDMDEHVKPLKKKYLDLEAQIDKKKAELLAARAPLSLNDDNVV

SEQ ID NO: 25609 - protein, 246 aa, Ostreococcus tauri
MSSPERAFERLLDGHRAFRRAHFAASDGAADVPRALRALSERGQRPRALVVACSDSRADPAIVFDTAPGDVFTIRNVGSLVPAYAGLDGGHHGTCAATEYATVHLEVPVILVMGHTQCGGAAAGLRKYGNGPDADASVFGVNEATGEGFIGAWVALAEDAVRRVCERHDPGVRARMLEYELVRQSVQNLLTFPFVKRRVDRGELVVKGAVFNVWDGTLEVLRADGSFEQLDDDAEDGRGEAKRAKN

SEQ ID NO: 25610 - protein, 98 aa, Arabidopsis thaliana
  misc_feature (18)..(18): Xaa can be any naturally occurring amino acid
  misc_feature (29)..(29): Xaa can be any naturally occurring amino acid
  misc_feature (42)..(42): Xaa can be any naturally occurring amino acid
  misc_feature (82)..(83): Xaa can be any naturally occurring amino acid
  misc_feature (85)..(85): Xaa can be any naturally occurring amino acid
  misc_feature (87)..(88): Xaa can be any naturally occurring amino acid
  misc_feature (92)..(92): Xaa can be any naturally occurring amino acid
  unsure (1)..(98): unsure at all Xaa locations
PLQSEQLASVSLPATMVXSPAQATMVAPXNGLKSSAAFPATXKANNDITSITSNGGRVNCMQVWPPIGKKKFETLSYLPDLXXSXFXXREVXYLIRNK

SEQ ID NO: 25611 - protein, 448 aa, Xanthobacter autotrophicus Py2
MAKRYDLAIIGTGTAAIVTAHRVRAAGWSVAVADFRPFGGTCALRGCDPKKMMVGGAEAADHAWRMSGRGIEGDATLDWTGLMAFKRSFTDPVPQKREKAFADKGIHAFHGHVRFIGPNALEFGGERIEADRIVIAAGAEAVPLGIPGEQHLITNEGFLELESLPERIVLVGGGYIAAEFSHIAARAGAQVTILQHGKRMLKQFDPDLVGWLMDKFSERGINVRTQAGVTAIEKVSDGYRVRADCPDGELDMDADLVVHAAGRAPALATLDLDAGSVKHHNGRLALNGFLQSVSNPAVYAAGDAAGLGPPLTPVSSHDAKVVSANLLNGNTVRPEYTGVPSVAFTIPPIAAVGMSEAKAREKGLNVRVKTERVDGWFTARQQAETVYGFKTLVDADTDRILGAHLVGPHADEVINIFALAIRQGLTAEQLKTTMFAYPSGASDIGEML

SEQ ID NO: 25612 - protein, 397 aa, Pseudomonas fluorescens PfO-1
MGLNEFGEAQEGFAERPQEYEELMAKRDYYEVLGVERGSSEADLKKAYRRLAMKHHPDRNPGDKASEDLFKEANEAYEVLSDSSKRAAYDQYGHAGVDPSMGGGGAGFGGQNFSDIFGDVFSDFFGGGRGGSRGGAQRGSDLRYTLELNLEEAVRGTTVNIRVPTLVNCKPCDGSGAKKGSSPSTCPTCGGIGQVRMQQGFFSVQQTCPRCHGQGKIISDPCDSCHGDGRVEEYKTLSVKVPAGVDTGDRIRLSGEGEAGTQGGPTGDLYVVINVREHDIFQRDGKHLFCEVPISFVDAALGGELEIPTLDGRVKLKIPEGTQTGKQFRVRGKGVAPVRGGGAGDLMCRVAVETPVNLTRRQRELLEEFRSSLADDNSHSPKTTGWFDGVKRFFGDL

SEQ ID NO: 25613 - protein, 166 aa, Synechococcus sp. WH 8102
MSRSRKTQPSFLTVVDSAEREVARLLTLITGVVIFAALVQLVMSLGSKLLTGSEATWLGDDLIKVLGDLLTVLIALEVLQNITSYLRRHVVQIELVLVTALTAVARKVIVLPSGAENKPQLLVGLGIAVVSLSAAYWLVKRANAGSARAFPARDRSVPPDADDAGE

SEQ ID NO: 25614 - protein, 1073 aa, Pseudomonas fluorescens PfO-1
MPKRTDIKSILILGAGPIVIGQACEFDYSGAQACKALREEGYRVILVNSNPATIMTDPDMADATYIEPIKWQTVAKIIEKERPDAVLPTMGGQTALNCALDLEREGVLEKFGVEMIGANADTIDKAEDRSRFDKAMKAIGLECPRSGIAHSMEEANAVLERLGFPCIIRPSFTMGGTGGGIAYNREEFEEICARGLDLSPTKELLIDESLIGWKEYEMEVVRDKKDNCIIVCSIENFDPMGVHTGDSITVAPAQTLTDKEYQILRNASLAVLREIGVETGGSNVQFGICPDTGRMVVIEMNPRVSRSSALASKATGFPIAKIAAKLAVGYTLDELQNDITGGRTPASFEPSIDYVVTKLPRFAFEKFANADARLTTQMKSVGEVMAIGRTFQESLQKALRGLEVGVCGLDEKVDLSNPESMSVLKRELTVPGAERIWYVADAFRAGMTVEEIFGMNMIDPWFLVQIEDLVKDEEKVKTLGLSAIDRDLMYKLKRKGFSDQRLAKLLGVTEKNLRTHRHKLEVFPVYKRVDTCAAEFATDTAYLYSTYEEECEAAPSGRDKIIILGGGPNRIGQGIEFDYCCVHAALALRDDGYETIMVNCNPETVSTDYDTSDRLYFEPVTLEDVLEICRVEKPKGVIVQYGGQTPLKLARALEAAGVPIIGTSPDAIDRAEDRERFQQMVERLNLRQPPNATVRSEDEAVRAAAKIGYPLVVRPSYVLGGRAMEIVYKEEELKRYLRDAVQVSNDSPVLLDHFLNCAIEMDVDAVCDGKDVVIGAIMQHIEQAGVHSGDSACSLPPYSLPARIQDEMREQVKKMALELGVVGLMNVQLALQGEDIYVIEVNPRASRTVPFVSKCIGISLAMVAARVMAGKTLKEIGFTKEIIPNFYSVKEAVFPFAKFPGVDPILGPEMKSTGEVMGVGDTFGEAFAKAQMGASEVLPTGGTAFISVRDDDKPLVAGVARDLINLGFEVVATAGTAKLIEAAGLKVRRVNKVTEGRPHVVDMIKNDEVTLIINTTEGRQSIADSYSIRRNALQHKIYCTTTIAAGEAICEALKFGPEKTVRRLQDLHAGLKA

SEQ ID NO: 25615 - protein, 500 aa, Beta vulgaris subsp. vulgaris
MSMPIPSRQLFIDGEWREPIKKNRIPIINPSNEEIIGDIPAGSSEDIEVAVAAARRALKRNKGREWAATSGAHRARYLRAIAAKVTERKDHFVKLETIDSGKPFDEAVLDIDDVATCFEYFAGQAEAMDAKQKAPVTLPMERFKSHVLRQPIGVVGLITPWNYPLLMATWKIAPALAAGCTAVLKPSELASITCLEFGEVCNEVGLPPGVLNIVTGLGPDAGAPLAAHPDVDKVAFTGSSATGSKVMASAAQLVKPVTLELGGKSPIIVFEDVDIDQVVEWTMFGCFWTNGQICSATSRLLVHESIAAEFIDRLVKWTKNIKISDPFEEGCRLGPVISKGQYDKIMKFISTAKSEGATILCGGSRPEHLKKGYFIEPTIISDISTSMQIWREEVFGPVLCVKTFSSEDEALDLANDTEYGLASAVFSKDLERCERVSKLLESGAVWVNCSQPCFVHAPWGGIKRSGFGRELGEWGIENYLNIKQVTSDISNEPWGWYKSP

SEQ ID NO: 25616 - protein, 387 aa, Glycine max
METGIACYTRGPFLPSVSSKHSPPSISPSFGLRSLKSSSLFGESLRVASKSTLKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVSSPSAKAKLRLLFEVAPLGFLIEKAGGYSSDGHQSVLDKVISNIDDRTQVAYGSKNEIIRFEETLYGKSRLKGGVAVGAAA

SEQ ID NO: 25617 - protein, 867 aa, Ustilago maydis 521
MPPFTPAVRAENTFAAQSTSTKPFSSKFAPASHDGQPRRLAVMTSGGDSAGMNAAVRSVVKMAIFRGCEAFVIREGWEGLVRGNQTPENTPSATPSVSRSASTFFDSPNIQAKPSHLEANPEQSDFVPTYGEGELLREGVGEAQELGLRGRYIIRVGWDDVRGWMDQGGTLIGTARSKTFRTPEGREQAAYNLIINGIDALAVCGGDGSLTGADKLRAEWPDLVASLKAKSKITEEQATKFAHLNIVGLVGSIDNDMATTDITIGASTALQRICEAVDSISSTAASHSRAFVVEVMGRHCGWLALMAGIATGADYVFIPERPPQGEQWHSEMSAVLQKHRDLGKRKSIVIVAEGAIDRELNDISPEMIKQVLSNDLGLDTRVTTLGHTQRGGKPDANDRILATLQGIEAVDAVLEATPETPSYVIGISENKITRIPLMFAVEQTQKVAKLIESKDFDGALALRDPEFAEGLRAFKYISQITEDEMLPQNKRLRMGVINVGAPAGGMNAATRTAVRYCLAKGHEAVVIYNGFPGLLEDNVSVLNWLRVDNWATRGGSELGVNRHLPDIDIGAVAAKLQEHKIEGLLIVGGFEAFSSVKILNDNRDRYPAFRIPIVGLPATISNNVPMNEFSLGSDTSLNALVDACDAVKQSASASRNRVFVVETQGGKCGYIAVMGALAAGAVLVYTPEVGIGLQQLGKDVAFLKKRFLLDVKGKSEGRLVIRNEKSSDVFTTEVITKILKEEGNSLFDARSASLGHTLQGGVPSPLDRVRATRLALKCCEFLESQALKQRSGSSASSKTGSGSSSDKSYSDDTAVMITIQGSTICFTSATEMSRNADMKNRRGKTAWWHELKALVELLGGRTALAEL

SEQ ID NO: 25618 - protein, 289 aa, Ostreococcus tauri
MTRCDVTAARAVAIVTGANAGLGRETARALVKKGYAVVLATRDVERGERAAAEVRAAAAGAGAGGTAEAMRADLADFESIRRFARAFEAKYERLDALVCNAGVMALPNRETTVDGNETQMQVNHLGHFLLTSLLLPTMLKTPSNDKRIVNVSSVAHNFGTLDFHNINSEGFFGYPFLGWATYGRTKMANVLFTFELHRRLRASGIDDVCVNAVHPGVVDTELNRNLSLDFYPQLKRMGQLITPSKALGAKSGQYVSEMFNDGRPGLKTTEACGKLWNDIVRLNDAEWSI

SEQ ID NO: 25619 - protein, 929 aa, Ustilago maydis 521
MQAVTASRPNADSASASHRIPSQPNASNPPSASLRPPDQQMPTTAASLMREGPRDFTVIKDVGDGSFGTVCLADWKSPLPSGTMLSPMQHPTTRPEYIGKRLVAIKKMKKPFPSWQECMKLKELRSLLTIPPHPNIIPLYDAFLMPTTKELHFVFECMEGNLYQLTKSRKGRPLAAGLVASIYEQIVLGLDHIHQHGYFHRDMKPENLLITTTGLADYPNLQPALAAERDVLVIVKLADFGLARETLSKPPYTEYVSTRWYRAPEVLLRSRDYSNPVDMWALGTILAELVNLKPLFPGHSEVDQVLQICDILGDPSHSYGHDSRNRRNGGGPWDRGIRMARAVGFTFPIRKPAKFSRFFSDRVPQNLIDCIEDLLRYDPQARLTSKDCLQHDYMRLDAPRLRPPQAKPLVSATAPLRPQQNASRPLPSSHSTLLSSNHARPPFGAADSNLKPLAVLRQPDGSPIVRVNAAATSDPSLANGTTPASPMQEDATEVHWAPPVVSSSRDVSLSGYPAFPDSASLYAASSSTHPDGPPSGAPSSDATMVMSDAQLTDSTLKHTDPRHAQALQAHQYEQYQRQYRHDAGQSQSPGYDAHAAAAYDRDAALRGAAFVPFVASYPGSAATGQLAAATSSGELSQKNDSNASNETISSRDKERRRSKVWGLNISSKFGGSGSSGTLAGSSSGGAANATGTHLYAVGNAAAGRLPPNGPMQESRVSLEPTPAQRIAAEHSNATLATLPNGAPAKTADSKKARKEAEKAAREAEKAKREAQQKAARDRARAVMQKRNQLLASSNSKDPVEWLAGAIQSDEPYRSSPSEKARGKQPAIPGSQLSPSMPSFASGEFPRSPLQQPIHGLSPDYGMNANPAVMGSMAWRGVGAARYSRSNKARRREHDDDHSMASMQSYQTGDSDPGPGTAPSTTSSSPIWKG

SEQ ID NO: 25620 - protein, 154 aa, Arabidopsis thaliana
MASKALILLGLFSVLLVVSEVSAARQSGMVKPESEETVQPEGYGGGHGGHGGHGGGGGHGHGGHNGGGGHGLDGYGGGGGHYGGGGGHYGGGGGHYGGGGGHYGGGGGHYGGGGGGHGGGGHYGGGGGGYGGGGGHHGGGGHGLNEPVQTKPGV

SEQ ID NO: 25621 - protein, 382 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPDKCELGKKFGVTHFINPKELGEEKPVHQAIAEMTDGGADYCFECIGLAALMNDAFRSSRDGWGKTIILGVEMHGAPLCISPHEILHGKSVIGSMFGGVKPKQDIPILADKYMNKELELDKFITHEVGLKDINQAFDLLLQGKSLRCTIWMDK

SEQ ID NO: 25622 - protein, 510 aa, Trichodesmium erythraeum IMS101
MTETIQRKMKLNSFDKFKAEKDGLAVKTEIEHFAKIGWEAIDKTDRNHRLKWLGVFFRPVTPGKFMLRMRMPNGMLSSQQMRVLAGIVQRYGDDGNADITTRQNLQLRGIAIEDIPDIFNRLEKVGLTSVQSGMDNVRNITGSPVAGIDATELYDTRELIKQVQDMITDNNKGNFEFTNLPRKFNIAIAGCRDNSVHAEINDIAFIPAYKNDKFGFNVLVGGFFSAKRCEAAIPLNAWVEPNQVIALCRAILEVYRDYGLRENRQKSRLMWLIDEWGLTKFRSQVEKQIGLTLETEALKDEILWEKRDHIGIYKQKQPGLNYIGLNIPVGRLYAVDMFDLARLAEVYGNGEIRLTVEQNVIIPNVPDSRLETFRSEPLLKKFSFEPQPLTRAVVSCTGSQFCNFALIETKNRALAIAKELETELSIPKPVRIHWTGCPNSCGQPQVADIGLMGTKVRKNGKMVDGVNLYMGGKVGKDAQLGSCVQKSIPCEDLKPILRSLLIKNFAAQPK

SEQ ID NO: 25623 - protein, 405 aa, Oryza sativa (japonica cultivar-group)
MQRNGVVECSVCRSRLVVPSPRSVSRAYDKHRSKISSKFRALNVLLVVGDCILVGLQPILVFMSKVDGKFQFSPISVNFLTEVTKVVFAIVMLIIQSRKQKVGEKPLLARSTFIQAARNNALLAVPALLYAINNYLKFIMQLYFNPSTVKMLSNLKVLVIAVLLKFIMKRRFSVIQWEALALLLIGISINQLRTVPAGNTAFGLPVTAIAYIYTLIFVTVPSLASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKAKDDKPAELLELEDTQNHRSSESSFVNMTAGAAEDASHRIGTDERQPLLPT

SEQ ID NO: 25624 - protein, 334 aa, Zea mays
MESPISRTNLNCISLADPNVQKSVALLKQACLDSGFFYVVDHGISQEFMDEVFAQSKKFFDLPHSEKMKLLRDEKNRGYTPMLDEILDPENQVNGDYKEGCVVAAEVPADDPEANRPFYGPNQWPSKEVLPKWREVMEQYHREALRVAKSVARIIALALDLDVDFFDRPEMLGESIATLRLLHYEGGQETGKVSDPAKGVYGAGAHSDYGLITLLATDDVVGLQICKDKNAQPQLWEYVAPLKGGFIVNLGDMLERWSNGVFRSTLHRVVLDGRERYSIAYFVEPSHDCVVECLPTCKSESNPPKFPPITCSAYLSQRYKDTHADLKSYDDSKA

SEQ ID NO: 25625 - protein, 957 aa, Arabidopsis thaliana
MTATQMLLHLLLLPLLFLHFSNQVMAEITDELATLMEVKTELDPEDKHLASWSVNGDLCKDFEGVGCDWKGRVSNISLQGKGLSGKISPNIGKLKHLTGLFLHYNALVGDIPRELGNLSELTDLYLNVNNLSGEIPSNIGKMQGLQVLQLCYNNLTGSIPRELSSLRKLSVLALQSNKLTGAIPASLGDLSALERLDLSYNHLFGSVPGKLASPPLLRVLDIRNNSLTGNVPPVLKRLNEGFSFENNLGLCGAEFSPLKSCNGTAPEEPKPYGATVFGFPSRDIPESANLRSPCNGTNCNTPPKSHQGAILIGLVVSTIALSAISILLFTHYRRRKQKLSTTYEMSDNRLNTVGGGFRKNNGSPLASLEYTNGWDPLSDNRNLSVFAQEVIQSFRFNLEEVETATQYFSEVNLLGRSNFSATYKGILRDGSAVAIKRFSKTSCKSEEPEFLKGLNMLASLKHENLSKLRGFCCSRGRGECFLIYDFAPNGNLLSYLDLKDGDAHVLDWSTRVSIAKGIAKGIAYLHSYKGSKPALVHQNISAEKVLIDQRYSPLLSNSGLHTLLTNDIVFSALKDSAAMGYLAPEYTTTGRFTEKTDVYAFGILVFQIISGKQKVRHLVKLGTEACRFNDYIDPNLQGRFFEYEATKLARIAWLCTHESPIERPSVEAVVHELGGCIEQASVGVVERWGRFEHIAEPGCHFFNPLAGQWLAGVLSTRIKSLDVKIETKTKDNVFVQLVCSIQYRVVKASADDAFYELQNPKEQIQAYVFDVVRALVPMMTLDALFEQKGEVAKSVLEELEKVMGAYGYSIEHILMVDIIPDPSVRKAMNEINAAQRLQLASVYKGEAEKILQVKRAEAEAEAKYLGGVGVARQRQAITDGLRENILNFSDKVEGTSAKEVMDLIMITQYFDTIRDLGNSSKNTTVFLPHGPGHVRDISDQIRNGMMEAAASTQVNDV

SEQ ID NO: 25626 - protein, 459 aa, Rhizopus stolonifer
MSTLDRQSIFTIKELESISQRIHDGDEEAMKFIIIDKKVYDVTEFIEDHPGGAQVLLTHVGKDASDVFHAMHPESAYEVLNNYFVGDVQETVVTEKSSSAQFAVEMRQLRDQLKKEGYFHSSKLFYAYKVLSTLAICIAGLSLLYAYGRTSTLAVVASAITVGIFWQQCGWLAHDFGHHQCFEDRTWNDVLVVFLGNFCQGFSLSWWKNKHNTHHASTNVHGQDPDIDTAPVLLWDEYASAAYYASLDQEPTMVSRFLAEQVLPHQTRYFFFILAFARLSWALQSLSYSFKKESINKSRQLNLFERVCIVGHWALFAFCIYSWCSNVYHMVLFFLVSQATTGYTLALVFALNHNGMPVITEEKAESMEFFEIQVITGRDVTLSPLGDWFMGGLNYQIEHHVFPNMPRHNLPTVKPMVKSLCQKYDINYHDTGFLKGTLEVLQTLDITSKLSLQLSKKSF

SEQ ID NO: 25627 - protein, 504 aa, Pericallis cruenta
MSILTLICTFITGLMFYGLVNLLSRRASRLPPGPTPWPIIGNLMHLGKLPHHSLADLAKKYGPLIHVRLGSVDVVVASSASVAGQFLKVHDANFANRPPNSGAKHMAYNYHDMVFAPYGPRWRMLRKMCSMHLFSAKALADFRQVRQEEVMILTRVLAGTEQSAVKLDQQLNVCFANTLSRMMLDRRVFGDGDPKADDYKDMVVELMTLAGQFNIGDYIPWLDLLDLQGIVKRMKKVHSQFDSFLDTIIDEHTIGTGRHVDMLSTMISLKDNADGEGGKLSFIEIKALLLNLFSAGTDTSSSTVEWGIAELIRHPQLMKQAQEEMDIVIGKNRLVTEMDISQLTFLQAIVKETFRLHPATPLSLPRIASESCEVKGYHVPKGSILFVNVWAIARQSELWTDPLEFRPGRFLIPGEKPNVEVKPNDFEIVPFGGGRRICAGMSLGLRMVNLLIATLVQAFDWELANGLELEKLNMEEVFGISLQRVQPLLVHPRPRLARHVYGTG

SEQ ID NO: 25628 - protein, 316 aa, Zea mays
MAQPSVILATASYDHTIRFWEAKSGRCYRTIQYPDSQVNRLEITPDKRFLAAAGNPHIRLFDVNSNSPQPVISYDSHTSNVMAVGFHCDGNWMYSGSEDGTVRIWDLRTGTCQREYESRAAVNTVVLHPNQKELISGDQNGNIRVWDLAANSCSCELVPEVDTAVRSLTVMWDGSMVVAANNRGTCYVWRLLKGTQTITCFEPLHKLQAHDGYILKCLLSPEFCDPNRYLATASSDRTVKIWNVDGFKLERTLVGHQRWVWDCVFSVDGAYLITASSDTTARLWTMSTGEAIRVYQGHHKATVCCALHDGAESAPS

SEQ ID NO: 25629 - protein, 222 aa, Eupomatia bennettii
RNGLLKKAYELSVLCDAEVALIIFSNRGKLYEFCSSSSSMFKTLERYQKCNYGAPETVVTTREIQSSHQEYLKLKARVEALQRSQRNLLGEDLGPLSGKELDTLERQLDMSLKQIRSTRTQYMLDQLTDLQRREQMLSEANKTLKRRLEEGMEANPNHAWDHNPHAMGFVRQQGPPQDDGFFHPLDCEPTLQIGLCRYQTDQMQMTTAPGPSANNYMPGWLA

SEQ ID NO: 25630 - protein, 546 aa, Agaricus bisporus
MATAQLATFKIPPVSNEPMLSYAPGSPERAGLQAALAEMQSQLPFEVPCIINGQEVRTNNIQKQPMPHDHARHLCTFHEGSPELVEKATCGALQAKDGWETMPWNDRAAIFLKAADLASGKYRYKLMAATMLGQGKNTWQAEIDAAAELADFFRFGVSYVEELYAQQPPKNAPGCWNRTEYRPLEGFVLAVSPFNFTAIGGNLPGSPALVGNVVVWKPAPAATYSNYLVFKILSEAGVPPGVIQFIPGGAEIVQAAIQSPNFRSLHFTGSTNVFKSLWKDISSNLDKYKVYPRIVGETGGKNWHVIHKSAEVRNAVLQSVRGAFEYQGQKCSALSRLYVSRSVWENGFKTQYLEEIAKIKVGPCLDWNNYMGPVIGRRAYDNITGFIKKAKEEGGEVLIGGSGDDSKGFFIQPTVILTKVPRSTTMVGEIFGPVVTAYVFEDSDYEKTLELIDTTSIYGLTGAIFASERQALLTATNRSRNAAGNIYYNEKCTGAVVGQQPFGGARGSGTNDKAGSISIFYRFVSARSIKENFVGLEDFHYPSNLV

SEQ ID NO: 25631 - protein, 418 aa, Mycobacterium tuberculosis H37Rv
MSPAEREFDIVLYGATGFSGKLTAEHLAHSGSTARIALAGRSSERLRGVRMMLGPNAADWPLILADASQPLTLEAMAARAQVVLTTVGPYTRYGLPLVAACAKAGTDYADLTGELMFCRNSIDLYHKQAADTGARIILACGFDSIPSDLNVYQLYRRSVEDGTGELCDTDLVLRSFSQRWVSGGSVATYSEAMRTASSDPEARRLVTDPYTLTTDRGAEPELGAQPDFLRRPGRDLAPELAGFWTGGFVQAPFNTRIVRRSNALQEWAYGRRFRYSETMSLGKSMAAPILAAAVTGTVAGTIGLGNKYFDRLPRRLVERVTPKPGTGPSRKTQERGHYTFETYTTTTTGARYRATFAHNVDAYKSTAVLLAQSGLALALDRDRLAELRGVLTPAAAMGDALLARLPGAGVVMGTTRLS

SEQ ID NO: 25632 - protein, 228 aa, Magnolia grandiflora
KRRNGLLKKAYELSVLCDAEVALIIFSTRGKLYEFCSSPSMLQTLERYQKCSYSTLEVSAPTNETQSSYQEYLKLKARVEILQRTQRNLLGEDLGPLSTKELEQLENQLEMSLKQIRSTKTQFMLDQLSDLKRKEQMLVEANKALKRKLEESGRENLLQLSWDTGAQNMSSYNRQPSNYEGFFQPLDCQPTLQMGYHPVYEDQMTVATNHGQNNVHGFMPGWMTIDLT

SEQ ID NO: 25633 - protein, 1103 aa, Thermobifida fusca YX
MPRRTDLSSVLVIGSGPIVIGQACEFDYSGTQACRVLKAEGLRVILVNSNPATIMTDPEFADATYVEPITPEMVEKIIAKERPDALLPTLGGQTALNTAVALHEAGVLDKYGVELIGANIDAIQAGEDRDSFKRVVERVGGESARSVICHSIEECLAAAEELNYPVVVRPSFTLGGAGSGFAHNEEELRRIAGQGLALSPTTEVLLEESILGWKEYELELMRDANDNVIVVCSIENLDPMGVHTGDSITVAPAMTLTDREYQRLRDLGIAIIREVGVDTGGCNIQFAVHPETGRTIVIEMNPRVSRSSALASKATGFPIAKIAAKLAVGYTLDEITNDITAKTLASFEPTLDYVVVKVPRFAFEKFPGADSGLTTTMKSVGEVMAIGRSFPEALQKAMRSLEKKGSSFTWTGDPGDKEELLRAVRTPSEHRLRQVQQALRAGATVAELHEATKIDPWFLDQILRLDEKARELAAAPRLDADLLRSAKQLGFSDAQIGEITGRSEEVVRELRDALDVHPVYLAVDTCAAEFPATTPYLYSSYDEETEVPPSSKPKVIILGSGPNRIGQGVEFDYSCVHASFALSEAGYETVMVNCNPETVSTDYDTSDRLYFEPLTLEDVLEVVRAEQQTGEVVGVIVQLGGQTPLGLAKKLKEAGVPIVGTSPEAIDLAEDRGEFGRVLAKAGLPAPKHGTAQSFDEARAIAEEIGYPVLVRPSYVLGGRGMEIVYNEAMLADYIERNAEVSAEHPVLVDRFLDEAIEIDVDALYDGTELYLGGVMEHIEEAGIHSGDSACALPAITLGQEDIERIRYSTEAIAAGVGVRGLINVQYALSAGELYVLEANPRASRTVPFVSKATAVPLAKAAARIMLGATIQELRDEGLLPRHGDGGTLPPDAPVAVKEAVLPFNRFIDRHGQGVDTVLGPEMRSTGEVMGLDVDFGTAFAKSQLATYGTFPTSGTVFVSVANRDKRTMIFPVRRLADLGFEILATEGTALALRRHGVQARVVRKHSEGPGPDGEPTIVQRIHNGEVDLIVNTPFGGPGQSGPRLDGYEIRTAAVARGVPSVTTVQGLAAAVQAIESLVNGRIQVRSLQEHAQRLRDASQATA

SEQ ID NO: 25634 - protein, 496 aa, Nicotiana plumbaginifolia
MAGNGVFVDIIEGDVFKYYSEGEWKKSASGKSVAIINPTTRKTQYKVQACTQEEVNKVMEVAKTAQKSWAKTPLWKRAELLHKAAAILKEHKAPIAECLVKEIAKPAKDAVTEVVRSGDLVSYTAEEGVRILGEGKFLVSDSFPGNERTKYCLTSKIPLGVILAIPPFNYPVNLAVSKIAPALIAGNSLVLKPPTQGAVACLHMVHCFHLAGFPKGLISCVTGKGSEIGDFLTMHPGVHCISFTGGDTGVAISKKAGMIPLQMELGGKDACIVLEDADLDLAAGSIVKGGFSYSGQRCTAVKVVLVMESVADALVEKVNAKVAKLTVGPPEDDCDITPVVSESSANFIEGLVMDAKQKNATFCQQYKREGNLIWPLLLDNVRPDMRIAWEEPFGPVLPVIRINSVEEGIHHCNASNFGLQGCVFTKDINKAILISDAMETGTVQINSAPARGPDHFPFQGIKDSGIGSQGITNSINMMTKVKTTVINLPTPSYTMG

SEQ ID NO: 25635 - protein, 795 aa, Shigella flexneri 2a str. 301
MKFSELWLREWVNPAIDSDTLANQITMAGLEVDGVEPVAGSFHGVVVGEVVECAQHPNADKLRVTKVNVGGDRLLDIVCGAPNCRQGLRVAVATIGAVLPGDFKIKAAKLRGEPSEGMLCSFSELGISDDHSGIIELPADAPIGTDIREYLKLDDNTIEISVTPNRADCLGIIGVARDVAVLNQLPLVEPEIVPVGATIDDTLPITVEAPEACPRYLGRVVKGINVKAPTPLWMKEKLRRCGIRSIDAVVDVTNYVLLELGQPMHAFDKDRIEGGIVVRMAKEGETLVLLDGTEAKLNADTLVIADHNKALAMGGIFGGEHSGVNDETQNVLLECAFFSPLSITGRARRHGLHTDASHRYERGVDPVLQHKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQASLIMGTHREADLSLKRVKTLLNDKGYQEVITYSFVDPKVQQMIHPGVEALLLASPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAREISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 25636 - protein, 180 aa, Salmonella typhimurium
GSMQTIKCVVVGDGAVGKTCLLISYTTNKFPSEYVPTVFDNYAVTVMIGGEPYTLGLFDTAGQEDYDRLRPLSYPQTDVFLVCFSVVSPSSFENVKEKWVPEITHHCPKTPFLLVGTQIDLRDDPSTIEKLAKNKQKPITPETAEKLARDLKAVKYVECSALTQKGLKNVFDEAILAALE

SEQ ID NO: 25637 - protein, 203 aa, Brassica napus
  misc_feature (177)..(177): Xaa can be any naturally occurring amino acid
  misc_feature (194)..(194): Xaa can be any naturally occurring amino acid
  unsure (1)..(203): unsure at all Xaa locations
GGNESEGHFTLINQACSMFAHTNPLHIDVFQSVVRFESEVVAMTAALLGSKETVSGEQICGNMTSGGTESIVLAVKSSRDYMKYKKGIKRPEMIIPESGHSAYDKAAQYFNIKLWRVPVGKDFRADVKAMRRHINRNTIMIVGSAPGFPHGIIDPIEELGQLALSYGICFHVDLCLXGGFVLPFARKLGVPDPXFDFSVQGGH

SEQ ID NO: 25638 - protein, 849 aa, Photobacterium profundum SS9
MSKVRLAIIGNGMVGHRYIEELVDKADMENFEVTVFCEEPRIAYDRVHLSSYFSHHTADELSLVKEGFYEKHGINVLIGERAITINRAQKVIHSNTGREIRYDKLIMATGSYPWVPPIKGNEGKDCFVYRTIEDLKTIEATAKRSKSGVVVGGGLLGLEAAGALKALGVETHVIEFAPVLMAEQLDRQGGEQLRNKIEKLGVKVHTGKNTKEILAEGTEARNTMNFADGTSLEVDFIVFSTGIRPQDKLAMQCGLATGRRGGIAINNTCLTSDEDVYAIGECASWNEIFYGLVAPGYKMAQVAVSHLIGEDKTFEGADMSAKLKLLGVKVGSIGDANGRTPNCKSYVYLDENEEVYKRIIVSEDGKKLLGAVLVGDTSDYGNLLQLKLNDMDLPKHPDTLILPAHAGAEKPSMGADSLPETAVICSCFDVTKGKIATAVADGHTTLGEIKAVTGAGTGCGGCIPLITQVLNAELAKAGIEVKNHLCEHFEYSRQELFHLIRVEEIKSFDELLKKYGKGYGCEVCKPTVGSILASSWNDYVLTKDNTQLQDTNDIFLGNMQKDGTYSVIPRMAGGEVTPVALLAIAQVANDYNLYTKITGAQRIGLFGAHKDDLPAIWEKLIAAGFETGQAYAKALRMAKTCVGSTWCRFGVQDSTALGVALENRYKGIRTPHKMKFGVSGCTRECAEAQGKDLGIIATDAGWNMYVGGNGGMKPRHADLLAADLDKDTLIKYIDRYMMFYIRTADKVQRTSVWLDNLEGGIEYLRDVIINDKLGINAQLENDVEKLIASFQCEWTTTLEDDNQLKRFNHFINSSERDSNVTFVPEREQHRPATENEKAPIYTISLEEKV

SEQ ID NO: 25639 - protein, 734 aa, Trichodesmium erythraeum IMS101
MKTTKTACPYCGVGCGLEVSPPATPGKVTNRDSKGNPTWQVRGDRSHPSSQGKVCLKGATVGEALDKSRLKYPMMRNTLDEAFRRVTWEEAFRRIVNQIQKVRFSQGPDAICMYGSGQFQTEDYYVAQKLLKGCLGTNNFDANSRLCMSSAVSGYIQSFGSDGPPCCYDDLEKTDCAFLIGTNTAECHPIIFNRLRASKKRNKKVKMIVVDPRRTKTAEVADLHLAIRPGTDIDLLNGIANLLIQWGLLDAMFIDECTKGFPEYVNIIRQYPPGLVARHCGIRLDELETAARYWGKSERVLSLWSMGMNQSSEGTAKVRTLINLHLMTGDIGKPGTGPFSLTGQPNAMGGREAGGLAHLLPGYRMVKNSQHRAEVEKLWELTPGKISDVPGRSAWEMIMALERKEIGCLWIAATNPAVSMPDLKRTKAALLRSPFTIYQDAYYPTETAEYAHLLLPAAQWGEKTGTMTNSERVVTLCPAFREPLREAKADWEIFAEVGRRLGFTNHFNFADSEAVRAEFLELTRDRPCDMTGITYQRLQEKGPTQWPCPDSSGVSQERLYTDFRFNTPDGRARFAAYYSQGLAEPPNPDYPFILTTGRLYGHWHTQTRTGRIEKIRKMYPLPFMEIHPQDAQRLEISDNDWVEVRSRRGYSRFPAKITKAITPGTVFVPMHWGALWAHQAEANTLTHPQACPESGQPELKACAVQLQPVKFQAAPIALWASKKSTPLGEVKSSK

SEQ ID NO: 25640 - protein, 126 aa, Fusarium proliferatum
TKQTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 25641 - protein, 239 aa, Aeropyrum pernix K1
MLALILAGGYGKRLRPLTEHKPKPLLEVAGKPVLVHQIEWLRYYGVEEFVLLVGYLKERIIEEMGSGAKFGVKITYVVEDKPLGTAGALWNARHIIEKENLVLVVNGDIVTNIDPDPLVRLVREREAVAGIAAVPLRSPYGILELDDGNVTGFREKPFIYDYWINGGLYAVSKEIVKYLPQQGDIEKTTFPQLASDGKLVAARYEIPPFYWRSIDTFKDIEEASKEIEDMGGLVPPQKG

SEQ ID NO: 25642 - protein, 665 aa, Listeria monocytogenes str. 4b F2365
MSRIDEQMVNSIRVLSMDMIEKANSGHPGLPMGAAPMAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLDADWDAELPVFDENADKAVATREVSGIVLQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAQTGLAKGAYILADSPLDKLDIILLASGSEVHLMTAVRDNLAKKGFGARVVSMPSFDLFDKQSPEYKESVLPKAVKNRFAAEMGASYGWHKYLGDTGQILAIDSFGMSGPGDELARRFGFTVENLTELALKQL

SEQ ID NO: 25643 - protein, 245 aa, Caulobacter crescentus CB15
MSRDEVLTRMRRFGPLAVVAVLCAAAFASGLVEHISLEELRLRGTQLQAFAHENPLLCAAIYLAVYVGTVAISLPGALILSLTGGFLFGPIGGGLAAVTGATGGSTVTFLVFRTAFGEALPFKSSAFIARIAEGLKGDAFNYLLTLRLIPAFPLLAVNVAAGVMNVRVRTFLLASVLGMIPSSFVYAGIGAGLGHVFAKGGPVTVESLLSPRIYLPIIGMGVLAFLPPLWRHWRNGRDVASLDEK

SEQ ID NO: 25644 - protein, 168 aa, Escherichia coli B
VIVQHAVSGEVLMLGYMNPEALDKTLESGKVTFFSRTKQRLWTKGETSGNFLNVVSIAPDCDNDTLLVLANPIGPTCHKGTSSCFGDTAHQWLFLYQLEQLLAERKSADPETSYTAKLYASGTKRIAQKVGEEGVETALAATVHDRFELTNEASDLMYHLLVLLQDQG

SEQ ID NO: 25645 - protein, 438 aa, Alicyclobacillus vulcanalis
  misc_feature (238)..(238): Xaa can be any naturally occurring amino acid
  unsure (1)..(438): unsure at all Xaa locations
KVAMVERGTIGGTCVNIGCVPSKTLLRAGEINRLAMQHPFQGLATSAGRVDLGQLVNQKNELVERLRQNKYIDLIDEYGFMMIRGEARFVDPRTVEVNGNRISARFFLIATGASPDVPDIPGLRDVDYLVSTTALELREVPKRLAVIGSGYIAMELGQWLHNLGSEVVLMQRGQRVLKSYDSEISEAITRAFTEQGIEIITGATFQRVEQKGNVKRVYITVDGEEKVIEAEALLVATXRKPNTDSLNLQAANVQLGPRGEVLVDEYLQTSNPYIYAAGDVTMGPQFVYVAAYQGAIAAENALSGNRRRADLSVVPAVTFTHPSVATVGMTEEQAKRAGYEVLTSVLPLDAVPRALANRETNGVFKLVADATSRKLLGAHVVAENAGDVIYAALLAVKFGLTIEDLNSTLAPYLTMAEGLKLATLTFDKDVAKLSCCAG

SEQ ID NO: 25646 - protein, 249 aa, Porphyromonas gingivalis W83
MKKYGLIGYPLAHSLSAEFFNAKFKTEGINAVYELFPLESLSQLKSLLSLHPSLQGFNVTSPYKVEVMRYLDRIDEEAELTGAVNTIRVERARFRRPHLVGYNTDVKGFADSLELIRKPWHTQALVLGSGGAALAVMRALKKMGIVHRQVSRTPSAPGVYAYSDLTPEIIERHKLIVNATPVGMYPHIDQCPSIPFEGIGAEHLCYDLIYNPQETIFMHRAQAQGASVQNGLEMLLIQALCSWRIWNER

SEQ ID NO: 25647 - protein, 455 aa, Synechococcus sp. WH 8102
MAIESTFDLIVLGAGSGGLAAAKRAARHGAKVAIVEGDRVGGTCVIRGCVPKKLLVYGAQARHQLNDAPAYGLTLGSVESSVAELFRRVRAEVDRLNHLHLGFLEKAGVARIDGWGRFLSDQCIGIATERGGPIQRELSAAHYLVAVGGRPVRPDIPGIEHTWISDDMFNLEQLPKEVVVVGAGFIACEFACILRGLGVEVTQVVRGSGLLRGFDRELADAVLEGLREQGIHVLLERTVSAVSGQPGDLTVQMSDGLALPCGGVLMATGRRPWLEGLGLDAAGVAVEQGRINVDADSRTSVAHIYAVGDVTDRVNLTPVAIDEGRAFADSTFGTRPRQVNHDLLASAVFSDPELATVGLSEEAAIDRHGVDGVVIHRARFRSMSRALPATGPRCLLKLVVETSTDRVIGCHMVGEHAAEIIQMAAIAVGMGATKADFDRTMALHPSVSEEFVTMG

SEQ ID NO: 25648 - protein, 167 aa, Oryza sativa (japonica cultivar-group)
PHFPPSTQAFAKQKLRTPRIAATAALATTTAAMRTAAVLLMALALTLAAAGTGTGAELETAAIRRRQSRFLASAKNSPPLSYYDCKRKPPSVCLEPGSPGATCCKGACVDTGSSFAHCGSCNHVCKYGETCCGGHCVDLLSDRKNCGDCFVRCPSKKCSFGLCDYAG

SEQ ID NO: 25649 - protein, 377 aa, Coix lacryma-jobi
MISPRMTTNLLPARTISLVSNGGAATASPSSPSVAARPRRPSSGTGRGKVSAITLDDYLPMRSTEVKNRTSTDDITSLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSTEGMISHFESVLPMGPTIIYNVPSRSAQDIPPEVIVAISGYINMAGVKECIGHERIKHYADKGITIWSGNDDECHDSRWKYGATGVISVTSNLVPGLMHSLMYKGENAVLKEKLLPLMKWLFCQPNPIALNTALAQLGVARPVFRLPYVPLPLEKRAEFVRIVEAIGRENFVGQKETRVLDDDDFVLISRY

SEQ ID NO: 25650 - protein, 136 aa, Pseudomonas fluorescens Pf-5
MNVLRNSLAAIGLCGLSSLALAAGNPLSVHVLNLENGLPSPGVKVTLEQQVGQDWKPLSEGVTNEQGRIAELFPAGRALTAGEYRVVFKTGEYFRQAKRETFFPEIPVIFEVRQTEQHYHIPLLLSPYGFSTYRGS

SEQ ID NO: 25651 - protein, 544 aa, Trichodesmium erythraeum IMS101
MNVQTVVTKPFRDQKPGTSGLRKKVPIFKEPHYLENFIQSIFDSLEGFSGQTFVLGGDGRYYNRQAIQIILKMAAANGVGRMLVGQGGILSTPAASCIIRKNQAFGGIILSASHNPGGPEEDFGVKYNISNGGPAPEKVTSAIYERSKVIDSYKILEAKSINLDQLGSEKLGEMTVEVIDSVADYADLMESLFDFGKLSQLLSSGKFRMCMDSLHAVTGPYAKNIFEQRLGAPLGTVKNGMPLEDFGGGHPDPNLVYAHDLVEIMFGDNAPDFGAASDGDGDRNMILGKNFFVTPSDSLAILAANAKLVPGYSSGLTGIARSMPTSAAADRVAEKMGLDCYETPTGWKFFGNLLDADKATLCGEESFGTGSNHVREKDGLWAVLFWLNILAARQESVEDIVKEHWKTYGRNYYSRHDYEGIESDKASTLMENLRSLLPSLPGKQYGQYEVKYADDFRYTDPIDGSVSQKQGIRIGFSDGSRMVFRLSGTGTQGATLRLYVESYEPDTTKQDQDTQIALSPLISLADEIAQIKNITGQEKPTVIT

SEQ ID NO: 25652 - protein, 706 aa, Arabidopsis thaliana
MADTGEVQFMKPFISEKSSKSLEIPLGFNEYFPAPFPITVDLLDYSGRSWTVRMKKRGEKVFLTVGWENFVKDNNLEDGKYLQFIYDRDRTFYVIIYGHNMCSEYRDFPQVAVEVDDYENGEEEEDGDDQDKHQVLIQENERKCRRGHESKPSENILTVKSKCLLFGWLLAAETRIVAATQVIGIMKSNKFSCKTRAETLEWITAIIDFLKPFSFLINAHVVNFFKDKQWEAVNEEWMSCLKDEKPENILLIPSGGVQDHWPASLKKFVHTLRSLSFPREQADLQAILADVDMVPLSTVLSQGMNLKKKHEVEVLSSVVSSVVKSVGAPTVVDVGAGQGYLAQVLSFQYKHSVVAIDSSSHHGKVTDARAARIKKHFAAQMRKSGSGNKCPDVPMTITCRVLSTEMLKALTDVHLEKDETDSSGSALNEEGQSRSQSSSDANRSCSLVLAGLHACGDLSVTMLRTFMECEEVKALVSIGCCYNLLSEKSSEDSCSKCGYPMSAGLRSLGFSLGKNARDLACQSAERWSSLGEDAGLQNFELHSFRAAFQMVLSKHYPEVLATSPSIGRQGKAFRRQQQRKSLETPAAVDTTRKDTVDKKPMRQTSLNSDMCSSFEKFCLSAFSRLNLEHPRDLDLNATWNEADAFTELIGPYWSIRAALGPVLETLILLDRLMFLQEQGDSIKVVMLPIFDPTISPRNVAIIARRL

SEQ ID NO: 25653 - protein, 376 aa, Phytophthora infestans
MADDDVQALVVDNGSGMCKAGFAGDDAPRAVFPSIVGRPKHLGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVIVIGNERFRTPEVLFQPSLIGKEASGIHECTFQTIMKCDVDIRKDLYCNIVLSGGTTMYPGIGERMTKELTALAPSTMKIKVVAPPERKYSVWIGGSIQSSLSTFQQMWISKAEYDESGPSIVHRKCF

SEQ ID NO: 25654 - protein, 548 aa, Aeropyrum pernix K1
MPVIRVRRERLESLTGLSIGELEELLFRLKCEVEEPEEGVLEVEVNPDRPDMYIGEGIARAVKGIAGVEEGWDPPELADTPLSLRVERVPQRPYIAAAVVYGVNVDELFLEELIQFQEKLHDSLGRRRAKIAIGFHDLAKLPSASVEYRLMTLDTRMKPLGYGGSEMSFREFLLADEKGSLYGGLATKDNSHPFLLSGGEVIAAPPVINSEITRVEPGTRDLFIDVTGTSAELVAKTLDIIVASLAEREGARVGRVRLEGPGAVWASTPLLSEAAAKLDPGTVSKALGVDLTPEEAALHLRRMRHNASPAGGLVNVRVPPFRVDILGEVDLVEDIAISIGYEALGPRWPGKFHGGSLRWETHVYRAVKDLLVGLGFTEVLQLVLTSPRLVEAAGFSSMAVEVLNPVQQEYSVLRPTLLITLLQTLRENQHRRKPVKVFEAGNAVYLEDGEPRDEEKLALGVLDEEAGFEDVQAPLYAVLRIMGVDFEVEEASHPMFMEGRTAAVKVGGERLGYIGEVKPEVLEAFGLEYPVAAAEISLEVLARWTSRT

SEQ ID NO: 25655 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPIPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAAMETDGYFIKGGIVTVIKDALLPSGTVI

SEQ ID NO: 25656 - protein, 314 aa, Medicago truncatula
MEGSGVVTVYGNGALTETTSTTTKSSPFSVKVGLAQMLRGGVIMDVVNAEQARIAEEAGACAVMALERVPADIRAQGGVARMSDPQLIKEIKAAVTIPVMAKARIGHFVEAQILESLGIDYVDESEVLTLADEDNHINKHNFRIPFVCGCRNLGEALRRIREGAAMIRTKGEAGTGNIIEAVRHVRSVLGDIRVLRNMDEDEVFTFAKKIGAPYDLVMQTKQLGRLPVVQFAAGGVATPADAALMMQLGCDGVFVGSGVFKSGDPAKRARAIVQAVTHYSDPEILAEVSCGLGEAMVGLNLTDHNVERFANRSE

SEQ ID NO: 25657 - protein, 878 aa, Caulobacter crescentus CB15
MQKWPCQMVLKWNVVRSAGWTLAERGIQMSALVLTAPLQGWVSALEEAPDAVFAERMLGDGLAIDPLGSTLHAPCDGSVVSVHRARHAVTLRATNGAEILMHVGLETVALNGEGFEVFVEEGQTVKAGDRLIGLDLDLLAQRARSLITPVVITNGEAFQIVRRDQDRQIGVGQFLMELSPIAGASRAAASGAADQITRQIIVPLAHGIHARPAARIAQMAKTFASDLTLATGPRRANARSPVGLMSLAIRHGDTIQLLASGPDAQAAVTALAELIEGGMGEGAPVAAKTSSTKTAPTKTEPSEPPPPAPLPRDGVLKGVPAAPGLAIGKAVRLSTAEIVVREAGEGVAHEEAALAVALETVRARIGKAAETGDKARKAILAAHQAFLDDPELYAGAHRLIAEGKSAGFAWRRAVGGYVQALQALGDRRMAERVDDLIDLERQVLRALSGEEETGAALAPGSILLADELLPSQLMGADPAALAGFATARGGPTSHVAILAAAMGVPALVAVGGALSKVKDGATLILDADAGTLRVAPDAKALEAAQTALAQRQQRKAAAKAAAHEPAVTRDGVRIEVFANTGSVADAQAAVANGAEGSGLLRTEFLFLDRETPPDEDEQARQYQAIAEALDGRPLIIRTLDVGGDKAAPYLPIPAEENPALGLRGVRVSLWRPHLLKAQLRAILRVEPRGQCKIMVPMVASLDELRAVRAVLEEAKRELGITDRVQLGVMIETPAAAVTADLLAAEADFLSIGTNDLTQYVLAMDRGNPELAAGIDALHPAVLRMIDQTCQGAARHHRWVGVCGGLASDLDATPILLGLGVAELSTTASIAPDVKARVRALSLEACRALAAQALEQTSPQAVRALVQGQTNTPLGGLNP

SEQ ID NO: 25658 - protein, 319 aa, Geobacillus stearothermophilus
MKRIGVLTSGGDSPGMNAAIRSVVRKAIYHGVEVYGVYHGYAGLIAGNIKKLEVGDVGDIIHRGGTILYTARCPEFKTEEGQKKGIEQLKKHGIEGLVVIGGDGSYQGAKKLTEHGFPCVGVPGTIDNDIPGTDFTIGFDTALNTVIDAIDKIRDTATSHERTWVIEVMGRHAGDIALYSGLAGGAETILIPEADYDMNDVIARLKRGHERGKKHSIIIVAEGVGSGVDFGRQIQEATGFETRVTVLGHVQRGGSPTAFDRVLASRLGARAVELLLEGKGGRCVGIQNNQLVDHDIAEALANKHTIDQRMYALSKELSI

SEQ ID NO: 25659 - protein, 310 aa, Lotus japonicus
MEGSGVVTVYGNGAAITETKKSPFSVKVGLAQMLRGGVIMDVVNAQQARIAEEAGACAVMALERVPADIRAQGGVARMSDPQLIKEIKQAVTIPVMAKARIGHFVEAQILEAIGVDYVDESEVLTLADEDNHINKHNFRIPFVCGCRNLGEALRRVREGAAMIRTKGEAGTGNIVEAVRHVRSVMGDIRVLRNMDDDEVFTFAKKIAAPYDLVMQTKQLGRLPVVHFAAGGVATPADAALMMQLGCDGVFVGSGVFKSGDPAKRARAIVQAVTHYSDPGLLAEISCGLGEAMVGLNLNDSNVERFANRSE

SEQ ID NO: 25660 - protein, 311 aa, Glycine max
MEGSGSGVVTVYGNGAITETKKSPFSVKVGLAQMLRGGVIMDVVDAEQARIAEEAGACAVMALERVPADIRAQGGVARMSDPQLINDIKRAVTIPVMAKARIGHFVEAQILEAIGIDYVDESEVLTLADDANHINKHNFRIPFVCGCRNLGEALRRIREGAAMIRTKGEAGTGNIIEAVRHVRSVMSDIRVLRNMDDDEVFTFAKNIAAPYDLVMQTKQLGRLPVVHFAAGGVATPADAALMMQLGCDGVFVGSGVFKSGDPAKRARAIVQAVTHYSDPEILAEVSCGLGEAMVGINLTDDKVERFANRSE

SEQ ID NO: 25661 - protein, 377 aa, Absidia glauca
MSMEEDIAALVIDNASGMCKAGFAGDDAPRAVFPSIVGRPRHQGIMVGMGQKDSYVGDEAQSKRGILTLRYPIEHGIVTNWDDMEKIWHHTFYNELRVAPEEHPVLLTEAPLNPKSNREKMTQIMFETFNAPAFYVSIQAVLSLYASGRTTGIVLDSGDGVTHTVPIYEGYSLPHAILRLDMAGRDLTDYLMRILAERGHSFTTTAEREIVRDIKEKLCYTGLDFEQEMQTAAQSSALEKSYELPDGQVITVGNERFRAPEALFQPSFLGLESAGIHETTYNSIMKCDVDIRKDLYSNIVMSGGTTMYPGIADRMQKEITALAPSSMKIKIVAPPERKYSVWIGGSILASLSTFQQMWISKQEYDESGPSIVHRKCF

SEQ ID NO: 25662 - protein, 421 aa, Ostreococcus tauri
MNENATRGRNVPHGTKEGARERCDRVETMMSHFGARSGVFAPAGGRAALSNIGNMITGAQGVRQTRSKTTLNEAKEVPQQQQQQSFEWGRTSQRTSHGKPRRGSVMGGTMTTAGADVDMRESYSTYLERSSAADVMTDALPDIDLYDHDNPLAVTQYVNDIYQYWYKVEVSTPKATASRCAPDTRVSETYMLIQGDINYKMRAILIDWLVEVHLKFKLMPETLFLTTNLIDRFLELKTVTRRNLQLVGVTAMLVASKYEEIWAPEVRDFVYISDRAYTRQQILEMEKQMLNTLGFHLTVPTPYCFLNRFFKAAGGDRQFQLYASYAVECALPEYGMLKYSGSTLAAAGVYIAIRGLQTGSWNHTMEAHTRLSESEVYPCACDMAELMRKAPTATLTAVYKKYSSEKFMKIATLPVPHDLRL

SEQ ID NO: 25663 - protein, 414 aa, Synechocystis sp. PCC 6803
MTKPLPYDLIIVGATGFVGGIVCRYLLSHWETAAAKNWAIAGRSQAKLDRLVQSLGPQAAHLPTFVVDIKDEAAVTTLCSQTKVVVSTVGPYALYGETLVRVCAITGTDYCDLTGEVQWVQQMIQKYEAIAKQSGARIVHCCGFDSIPSDLGVYYLQQQSQRRWGEPCIRVKMGVKACQGGISGGTIASGINLIQEAIADPSTRQALRNPYILCFKPDHRSDHPPSLIPVQNDPIFSGWTAPFVMAGINTPIVLRSNTLQNEVYGEGFQYEEGILTGPGIIGWLAAQGIKWSLDLMALALAIGPSRWLLLQILPKPGEGPTEEAQQQGFYDLRFWGETASGQSTMVKVTGDQDPGYGSTAKILAQAALCLAKDRPKSSLQGGFWTPAASFGQDLIHRLIDYAGLTFTEENGSTL

SEQ ID NO: 25664 - protein, 1003 aa, Fulvimarina pelagi HTCC2506
MLKKKAATTARSARLASTLSEFTHGAVDRRTFLKRSGLTIGGAAAITSLSGGMVRKAKAADGAADGAVSVKKSVCTHCSVGCTVLAEVQNGVWTGQEPGFDSPFNLGAHCAKGASVREHAHGERRLKYPMKLVGGKWQRLSWDEAINEVGDKMLEVREAAGPDSVYWLGSAKHSNEQSYLLRKFAAYWGTNNVDHQARICHSTTVAGVANTWGYGAMTNSYNDIHNSKAIFLIGGNPAEAHPVSLLHLLKAKEENNAPLIVCDPRFTRTAAHADEFVRFRPGTDVALIWGILYHIFENGWEDQQFIESRVWGMDQIRAEVANWTPEKVENVTGVPGSQLQRVARTMAQNRPGTLIWCMGGTQHTNGNNNTRAYCILQLALGNMGKAGGGTNIFRGHDNVQGATDLGVLADTLPGYYGLTDGAWAHWLRVWEEDPKWMRDRFAVMVGKGDDGGDRPMINETGIPVSRWIDGVLEQKENLVQPENTKVMVFWGHAPNSQTRLPEMQKAMSQLDMLVVIDPYPTMTAVLQDRTDGVYLLPASTQFETYGSVTASNRSLQWREKVVEPLFESLPDHAIMLKFAEKFGFADRMFRNIAIENGEPLVEDITREFNRGMWTIGYTGQSPERMKSHMQNQHAFDRTTLRARGGPNDGDYYGLPWPSWGTPEMNHPGSANLYDVSIPVAEGGMGFRARFGVERDGDNLLAEGVYPVGSEIEDGYPEFTFAMLQELGWDGDLTAYERQMIEYVAGFRDERPTNTDIGETSQTGDIPSDNDDSRPSDYAEKMGAVNWKTDLSGGIQRVAIAHGCAPYGNAKARAVVWTFPDPVPIHREPLYTPRRDLVADYPTYEDKTFWRVPTAYASIQKDDYSKDFPMIMTSGRLVEYEGGGDETRSNPWLAELQQQMFVEINPSDANNLGVRDNDNVWLHSPEGGKILVAAMVTERVGQGVVFTPFHFGGYFQGNDLRAKYPDGADPYVLGEACNTAQTYGYDSVTQMQETKSTLCRIEAA

SEQ ID NO: 25665 - protein, 135 aa, Synechococcus sp. WH 8102
MTAQAVTTPAAPAPVGPYNQAVLAGGWLYCSGQIPLDPETGAMVGDGDVALETRQVLKNLSAVLEAAGATAAQVVRTTIFLADLGDFQTVNDIYAEMFGAGTSPARACVQVAALPKGARVEIDCVAWLGDDLQTG

SEQ ID NO: 25666 - protein, 388 aa, Triticum aestivum
MADQSLAAPIRCKAAVSRAKGAPLVIEDIVVDPPKAYEIRMKVLCTSLCHTDITFWRGKEDFPLPPVFPRILGHEAYGVVESVGERVEGFAAGDTVVPTFLGQCDSCGGCASAGSNMCSALPFVVGPGMRRDGTTRFRDSQGEPLHDFLAVSSFSQYTVVDVNQVVKVDPAVPPKLACLLGCGAGTGVGAAWRLAKVQPGSSVVIFGLGAVGLSVAQGAKMCGAAKIIGVDLNPDKEELGKKFGVTDFVNPSKLGESPLSQVIIEMTGGGADYCFECIGAASVMTEAFRSAKQGNGKTVILGLEKDGKPISLPSIEFLFGKCVMGSLFGGMKPKTDIPILAEKCMNKELELEKLITHEVGLQEINTAFDLLLQGKSLRCIIWMDKLEV

SEQ ID NO: 25667 - protein, 471 aa, Oryza sativa (indica cultivar-group)
MRRERDATQIPENPMEGIPQTAAAAAAAEASEPPRKRARVDGGGGGAGEEEDRLSDLPDCLLEDILAHLGSRQAVQTSVLSRRWRNLWRGVRVVVIDVGSFRLPGADGDPPRFRLDRIEDFADGVLSPSLHPGAARELDALRMRLDEDAVTTNFQRWIRRALWRRPATVDLYYLPRRSFSWPPAVPLTPVTAVSRLKTLRIFGLRPTVVFGADEFPALEDLHIERCSYAHGTIASPTLKRLALVSPINGCFVREQRLTAPGLTSLRLVLPYSREEGVRVITDAPLTSLVDASITIVDTDPGDPRNRRVNQFKVDFLVAISNLLGRLTSVRNLDLTGLNATALLDNKSQEFPMFPYLTTLLLNECDIGYKYHVLRSILQNAPNLEQLRLHNCKFVGKSRRKAGQTQSKEKTSKCSSSTLSSACSSLKSVEIKHPRGEPSHDLLHEFLKEIPHNQWRKRSIDEETISIELNRK

SEQ ID NO: 25668 - protein, 261 aa, Brassica napus
GRYRIVIQRTQHPPVFASMMTSKLLLLVCYVSLLCFVSSSSLSSELSGKSQPSSSKVSLGLYYESLCPYCSSFIVNHLTKLFEDGLISIVDLHLSPWGNSKLRSDNVTVLCQHGAYECFLDTVEACAIDVWPELRDHFPFIYCVESLVIEHKYKKWETCYEKLNLSSKPVADCLSSGHGKELQLQYAAETSALEPPHKYVPWVVVDGQPLYEDYENFISYICKAYKGNKVPSACAKYSSIRSLKVNRFPIVCRKGVNTMWE

SEQ ID NO: 25669 - protein, 146 aa, Triticum aestivum
  misc_feature (62)..(62): Xaa can be any naturally occurring amino acid
  misc_feature (76)..(76): Xaa can be any naturally occurring amino acid
  unsure (1)..(146): unsure at all Xaa locations
MAGRAVLSAVLLCMAAAMAAGQSASNVRATYNFYNPEKINWDLNTASAYCATWDAGMSFAWXRSKYGWTAFCGPAXGPTGQASCGKCLQVTNTATGAQITARIVDQCSNGGLDLDHDTVFSKIDTNGLGMQQGHLTVNYQFVDCGD

SEQ ID NO: 25670 - protein, 223 aa, Streptomyces coelicolor A3(2)
MKHQRVRDLMSDAVVRVQRGTPFKEIAHLLLEYDITAVPVVDEENRPVGVVSEADLLQKMWGGEPDGSAEHAEWSRASAGKADATDAAGLMTSPPLCALESWSVVDAARVMARHRIKRLLVVDGDGRLAGVVSRSDLLRVFLRTDRAIRTEIIEEALVKALGLAPSSVQVDVAHGHVVLSGRLPAHVSAPLLEEHCRSVDGVVAVEFRPAGEADAEGPAAVGS

SEQ ID NO: 25671 - protein, 232 aa, Bacillus megaterium
MSKKPVALIILDGFALRDEDKGNAVTHAKKPNFDRFWNEYPHATLQASGEAVGLPEGQMGNSEVGHLNIGAGRIVYQSLTRVNVAIREGEFEQNETLLAAVKHAKEKGTNLHLFGLLSDGGVHSHIEHLYALLRLAKSEGLEKVYIHGFLDGRDVAPQSAETYLKELNEKIEEYGVGEIATLSGRYYSMDRDKRWERVEKSYRAMVYGEGPSYTSAEECVKDSYENGIYDEF

SEQ ID NO: 25672 - protein, 343 aa, Gloeobacter violaceus PCC 7421
MSAVKIAINGFGRIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFKVVSWYDNEWGYSCRVNDLIVAMAHKEKPADS

SEQ ID NO: 25673 - protein, 260 aa, Synechococcus sp. WH 8102
MRSYQNSENVSKLVIAVSSIFFGGIAVLSSLFVVPAGEVGVVTTLGKVSDEPRQPGLNLKIPFLQSTHSFSVRTQVIPEKFSTLTKDLQVIEATATVKYAVKPSEAPRIYSTIATDDSAIYARVIQPSLLKSLKSVFSKYELDTIATDWNNISSLVQESVSQELSKFDYVVVRGLDITGLQIAEEYRAAIEQKQIAQQQLLRAKTEVQIAEQEAIKFETLSRSLNNSVLYKLFLDKWDGQTQVVPSFAGASTPPVIVGRN

SEQ ID NO: 25674 - protein, 183 aa, Glycine max
NLSNGYLFNSTIGRKLEKESKYKYLDADDFHSESNKEKMRMGIPLTDEDRMPWFESLRDAIKEYLNNKKGLILGCSALKKEYREILRSGDLSYKWGTYASAVNFILLDAPAEVLSVRVNKRAAEGKHYMPASLLQSQLDLLEIDESEGVLRVDATLRPQAIVNTILNMNQFQGCFNVDFVEPH

SEQ ID NO: 25675 - protein, 921 aa, Sorghum bicolor
MTTTAARALVALLLVAVAVADDGATLVEIKKSFRNVGNVLYDWAGDDYCSWRGVLCDNVTFAVAALNLSGLNLEGEISPAVGSLKSLVSIDLKSNGLSGQIPDEIGDCSSLRTLDFSFNNLDGDIPFSISKLKHLENLILKNNQLIGAIPSTLSQLPNLKILDLAQNKLTGEIPRLIYWNEVLQYLDVKNNSLTGVIPDTIGNCTSFQVLDLSYNRFTGPIPFNIGFLQVATLSLQGNKFTGPIPSVIGLMQALAVLDLSYNQLSGPIPSILGNLTYTEKLYIQGNKLTGSIPPELGNMSTLHYLELNDNQLTGSIPPELGRLTGLFDLNLANNHLEGPIPDNLSSCVNLNSFNAYGNKLNGTIPRSLRKLESMTYLNLSSNFISGSIPIELSRINNLDTLDLSCNMMTGPIPSSIGSLEHLLRLNLSKNGLVGFIPAEFGNLRSVMEIDLSYNHLGGLIPQELEMLQNLMLLNVSYNNLAGVVPADNNFTRFSPDSFLGNPGLCGYWLGSSCRSTGHHEKPPISKAAIIGVAVGGLVILLMILVAVCRPHRPPAFKDVTVSKPVRNAPPKLVILHMNMALHVYDDIMRMTENLSEKYIIGYGASSTVYKCVLKNCKPVAIKKLYAHYPQSLKEFETELETVGSIKHRNLVSLQGYSLSPVGNLLFYDYMECGSLWDVLHEGSSKKKKLDWETRLRIALGAAQGLAYLHHDCSPRIIHRDVKSKNILLDKDYEAHLTDFGIAKSLCVSKTHTSTYVMGTIGYIDPEYARTSRLNEKSDVYRLWHCSAGAADWQEASGQRILSKTASNEVMDTVDPDIGDTCKDLGEVKKLFQLALLCTKRQPSDRPTMHEVVRVLDCLVNPDPPPKPSAHQLPQPSPAVPSYINEYVSLRGTGALSCANSTSTSDAELFLKFGEAISQNME

SEQ ID NO: 25676 - protein, 375 aa, Phytophthora infestans
MDDDIQAVVIDNGSGMCKAGFAGDDAPRAVFPSIVGMPKHLGIMVGMNQKDAYIGDEAQAKRGVLTLRYPIEHGIVTNWDDMEKIWSHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYVAMDFDEEMEKSTRSSALDKTYELPDGNVIVIGNERFRTPEVLFNPSMIGRECSGVHECAFQTIMKCDVDIRRDLYSNVVLSGGSTMFPGIGERMTKEVIKLAPTAMKVKIITPPERKYSVWIGGSILASLATFQHMWISKTEYDESGPSIVHRKCF

SEQ ID NO: 25677 - protein, 337 aa, Volvariella volvacea
MVVNVGINGFGRIGRIVYRNAVENDQINVVAINDPFIDLAYMVYMFKYDSVHGRFKGTVESKDGKLVINGKSITVFSEKDPAAIPWGTAGADYIVESTGVFTTTEKASAHLKGGAKKVIISAPSADAPMFVVGVNLDAYDPKYTVISNASCTTNCLAPLAKVIHDEFGIVEGLMTTVHATTATQKTVDGPSHKDWRGGRSVANNIIPSSTGAAKAVGKVIPSLNGKLTGMSFRVPTLDVSVVDLVVRLEKPTEYSAIKAALKKAAEGEYKGIIDYTEDPVVSTDFIGNPASSIFDASAGIQLNPNFVKLISWYDNEWGYSKRVCDLVVYVAGKDGNL

SEQ ID NO: 25678 - protein, 139 aa, Prochlorococcus marinus str. MIT 9211
MESNQDNLFDQAMSRYQAGEDVKEVLKEFEKITSISPNQSAGWTCLAWLQLLCDLKEDALRSARMAVRLNGQDPQARVNLSLALLETNSKGVRDHIEFVKKALMFVPEVEKELKISIEDGLSRKPEWQSLKKIKTWLDF

SEQ ID NO: 25679 - protein, 300 aa, Brassica napus
RTRGRTRGIFLFLFYPIYLFIKLLNCVRKHLCVENVAGKVVLITGASSGIGEHVAYEYAKKGADLALVARREDRLQIVADTSRKLSSRDVIIIPGDVTKINDCMKFISETISHFGKVDHLINNAGVSRTVLFENFSQIQDANPIMDTNFWGSTYITYYAIPHLRKSKGKIVVIASAAAKIAIPVATIYSASKAALLGFYEALRIELNPDIKVTIVFLGLISTDMTTPEIIKRHGSDFIVSEPVSRCAKAIFQGVCRGEEYVETPSWTKWFFLVKSVCPEVINSIFNYFFLHFIKPYFRRE

SEQ ID NO: 25680 - protein, 282 aa, Ostreococcus tauri
MVRLLTPTPLRPIIKRLTAEAVEGAALALERVDDIHGGDRLSASVLGVGHGITDDVLEEHLEDASGLFVDETRDALDTTTASQASDRRLRDALNVVAKDLAVTLGAALSETLTTFTTARHCLVFERNSHIDELTANSPRLRQVTSAAARCRHKSTRSNTKQCLAVVKVVRVLRDNIQGITKPAIRRLARRGGVKRISGLIYEETRGVLKVFLENVIRDAVTYTEHARRKTVTAMDVVYALKRQGRTLYGFGDAKRFSSFVSSFLTLRNESFARVKIQGSRCP

SEQ ID NO: 25681 - protein, 508 aa, Oryza sativa (japonica cultivar-group)
MHSAISDSDVDQPSSARNVFRAETCGAQLFCSLQKEWFRGKLGCQGTSVMLVRSVVNELVPYEVRDVLFSGLGYLRSQISSQHTIIIEETEGWSHNHVYNAVRAYLATRINNNMQRLRVSSMDESSEKMVVTMEEGEELVDMHEGTEFKWCLISRSISADPNNGNGSGQREVRSYELSFHRKHKEKALKSYLPFIIATAKAIKDQERILQIYMNEYSDSWSPIDLHHPSTFDTLAMDQKLKQSIIDDLDRFIKRKDYYKRIGKAWKRGYLLYGPPGTGKSSLIAAMANHLKFDIYDLELTGVHSNSELRRLLVGMTSRSILVVEDIDCSIELKQREAGEERTKSNSTEEDKGEDKVTLSGLLNFVDGLWSTSGEERIIVFTTNYKERLDQALMRPGRMDMHIHMGYCTPEAFRILASNYHSIDYHVTYPEIEELIKEVMVTPAEVAEALMRNDDIDVALLGLLELLKSKIKDASETKAESKDANKQTEENKDSKAMENKNDSSTDECT

SEQ ID NO: 25682 - protein, 414 aa, Triticum aestivum
  misc_feature (49)..(49): Xaa can be any naturally occurring amino acid
  unsure (1)..(414): unsure at all Xaa locations
FCRHSVQSPIPPSLSSLSDEATCPFPLSRTFLSRHGLLLPPPPPAAPPXAPPPQQQQQQPAPLSFRNALPVPVDGQIPAPLAFFNAPPAFPDQAGQPQIVDAAGLTAAAGMGWRQPREQELLGENSQMSSIDFLQTGSAVSTGSAVSTGLALSLEDRRHGGGGAGAGNSSGDSPLLLLPMLDDDISREVQRLDADMDRFIRAQSERMRQSILEKVQAKQFEALASVEDKILRKIRDKESEVQNINKRNLELEDQIKQMAGEVGAWQQRAKYNESMISALKYNLEQVCAHQSKDFKEGCGDSEVNDTASCCNGGAVNLQLVPIGEQSPQGLTAPQGLKISGGLFFCLPCGHFGCFKRWKKSLSLCPPPSPPAIWVGNKLVVGKKFVGSARVLYPFQRVGKPQQFSSGGPRGRKDA

SEQ ID NO: 25683 - protein, 549 aa, Glycine max
PHQPEIPFGHPILLRSRGGLRSFPKQLLPCVPSFLAPKRHVFGRTRVDIAAGERTPQPSKHLSPENRSFDHMLGWMKRLNPAIDGVTGSESNPLSVSDPDSKRFFFRDRAHFVDPAPTHSPPPPPEQIFGSNDSSLDPPPMNGFVQQAYSMDNTSHMSENVMNGFDPDLVAVYKTLVSEFAVFDRWFASVPASTQPNRLFVHSATSGGATSNVAAKLTAGYPQQTIFDSLHDAGHDFGIYYQNIPATLFYRNLRKLKYVLKFHIYDVSFKQHAKEGKLPSYTVVEQRYMDTKLLPANDDHPSHDVYEGQVFVKEVYETLRASPQWNETLFLITYDEHGGFYDHVPTPARGVPSPDGIVGPEPFNFTFNRLGVRVPTIAISPWIEKGTVVHGPNGSPSPTSEYEHSSIPATVKKLFNLPSFLTNRDAWAGTFEGIVQTRTEPRTDCPEKLPTPEKIRKGEPNEDAKLSEFQQELIQLAAVIKGDNILTSFPGTIGKDMTVKQGKYYMDDAVRSFFEAGRYARKMGVNEEHIVQMKPSLTTRSSKSPNTNP

SEQ ID NO: 25684 - protein, 398 aa, Corynebacterium diphtheriae
MEMPMRKTLISLTGPAFVAAVAYVDPGNVAANISAGSHYGYLLVWVLVVANLMAMFIQYHSAKLGLVTHRSLPEIMGERLSRRARLGMWAQAELIAAATDLAEVIGGAIALQLLFNLPLFAGALIIGAVSIILLIFQKKNQWFEGLVIGLLLVICIGFLAGLAIAPPDPADVAGGLIPRLEGKDSILLAASMLGATVMPHAIYLHSSLTKQRYPDLEIPHVLAGTRADIAVALSIAGLVNVGLLVLAGSALYGVDGTETISGAHTAIASHLGPLAGVLFAIGLLASGLASTSVGAYAGSEIMDGLLHIKVPLLVRRLVTLIPALVIIGCGVDPTMALVVSQALLSLGIPFAIIPLFRYAGSRDVMGEFAAKPWSMAVGWTLAALVIALNLALVLLPLL

SEQ ID NO: 25685 - protein, 908 aa, Porphyromonas gingivalis W83
MEKKRVYTFGNGKAEGEAGMKNLLGGKGANLAEMNLIGVPVPPGFTITTEVCQEYYTLGRDKVVELLRGEVNDAIRNIEGLMKSKFGDTENPLLVSVRSGARASMPGMMDTILNLGLNDEVVAGIVRKTGNERFAWDSYRRFVQMYGDVVLGMKPTNKEDIDPFEEIIEKVKEENGVHLDNELSVENLKDLVSRFKAAVKAQTGKDFPFSAEEQLWGAIMAVFDSWMNERAILYRRMEGIPAEWGTAVNVQAMVFGNMGETSATGVCFSRDAGSGEDLFNGEYLINAQGEDVVAGIRTPQQITKIGSQRWAERAGIAEDVRVAQYPSMEEAMPEIYKELDTLQQKLEDHYRDMQDMEFTVQEGKLWFLQTRNGKRTGCAMVKIAMDLLRQGMISEEEALMRVEPNKLDELLHPIFDKSALLRARVLTKGLPASPGAATGQIVFFADDAAQWKEDGKRVVMVRIETSPEDLAGMSAAEGILTARGGMTSHAAVVARGMGKCCVSGAGALNIDYKARTVEIDGTLFKEGDYISINGSTGEIYEGQVETKAAEMDQDFADLMALADKYAKLKVRTNADTPHDAEIARSFGAVGIGLCRTEHMFFEGEKIKAMREMILSETAEGRVRALAKILPYQQEDFKGIFRAMNGFPVNVRLLDPPLHEFVPHDLKGQEEMARMMGVDVRIIQKRVEDLMEHNPMLGHRGCRLGNTYPEITEMQTRAILGACLELKKEGVVCLPEIMVPLTGILHEFKHQEEVIRATAAKLFEEKGDSVEFQVGTMIEVPRAALTADRIASSAEFFSFGTNDLTQMTFGYSRDDIASFLPIYLDKKILKVDPFQVLDQKGVGQLVRMATENGRKARPNLKCGICGEHGGEPSSVKFCHRVGLNYVSCSPFRVPIARLAAAQAVIEEGK

SEQ ID NO: 25686 - protein, 484 aa, Burkholderia sp. 383
MNAIAASTDVREIRREALRIDGERIHRDAVIEVRNPYDGSLVGTVPKATLDDVRRAFAVARAYRPTLTRHDRSAILRRAADIVRARTAEIAGLITAESGLCVKDSTYEAGRVADVLTFGAGEVLKDDGQIFSCDLTPHGKKRRVYTQRDPLLGVISAITPFNHPMNQVAHKIVPSVATNNRMVVKPSEKVPLSCYLFADILYEAGLPPQMLQVLTGDPKEIADELITNPAIDLITFTGGVSIGKSIASRMGYRRAVLELGGNDPIIVMEDADLDEASTLAVSGSYKNSGQRCTAIKRMLVHESVADRFTELVVEKTRAWSYGNPADPSVDMGTVIDEAAAKFCEQQVNDAIARGARLLVGNVRNGALYSPTVIDRVTPDMPLVKYETFGPVSPIMRFSDIDEAIRMSNSTDYALSSSVCTNRFDSITRFITELEVGSVNVREVPGYRLELTPFGGVKDSGLGYKEGVQEAMKSFTNTKTYSLPW

SEQ ID NO: 25687 - protein, 422 aa, Fulvimarina pelagi HTCC2506
MNHFEFKDGLLHAEDVPVTTIAKDIGTPFYCYSTATLLRHYDVFSSAFADIDAMVCYAMKANSNQAVLKTLADRGAGADVVSGGELLRALRVGIDPKKIMFSGVGKTIAEIDMAIASGIFCFNIESENELELISARAVDAGLTAHVSFRINPDVDAKTHAKISTGRKSDKFGIAYDRAESIYARARELPGVEVTGIDMHIGSQIIDLKPFDEAFDRLATLVHRLRAAGHEISHIDLGGGLGVPYKNADATPPEPHAYAEIVKRHVRDLGAKIVFEPGRMIVANAGILVARVLYVKKDEGKTFVIVDAAMNDLIRPTLYEAWHEIQPVERAANRKTITADIVGPICESGDFLGKDREIVEVAEGDLVFLSSAGAYGAVQSSTYNSRPLIAETLVKGGEYAVIRERQTIDELIGLDHIPEWLDA

SEQ ID NO: 25688 - protein, 204 aa, Oryza sativa
MDAVAGASVSSSSARLRPCPRPRRIGNVAPATVRRRSRRRAVTCAAAADADVVGLFDAAKLTVDRFVESGMVVGLGSGPASGLAIQYLGTRLRRGSLTGILGIPSSTISASEAVKAGIQVSSYEEGTQIDFAFTDADIIEEDTMTAVIGRRKTESGEPSFMVEKGIVKSADKLAFIIGHEKYVKGIEGSIPVLVKSVSHLLVLE

SEQ ID NO: 25689 - protein, 206 aa, Arabidopsis thaliana
  misc_feature (2)..(2): Xaa can be any naturally occurring amino acid
  unsure (1)..(206): unsure at all Xaa locations
HXSPPPPPKSVSKRAKEEEKQQEVVMASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 25690 - protein, 344 aa, Oryza sativa (indica cultivar-group)
MVRKLILALAVFLPALVYQQLQPPPPKICGSPGGPPVTGTRTQLKDGRHLAYLESGVPKDQAKYKIIFVHGFDSCRYDALPISPELAQELGIYQLSFDRPGYAESDPNPASTEKSIALDVEELADNLQLGPKFYLMGFSMGGEIMWSCLKHISHRLAGVAILGPVGNYWWSGLPSNVSWHAWNQQLPQDKWAVWVSHHLPWLTYWWNSQKLFPASSVIAYNPALLSEEDKLIMPKFAFRTYMPQIRQQGEYSCLHRDMTVGFGKWSWSPLELEDPFAGGEGKVHLWHGAEDLIVPVSLSRYLSEKLPWVVYHELPKSGHMFPLADGMADTIVKSLLLGDQPPQA

SEQ ID NO: 25691 - protein, 362 aa, Oryza sativa (indica cultivar-group)
MAASGVKRPPRPAPASSGVRKLILALAVFLPALLYSQLQPPPPKICGSPGGPPITGTRTRLKDGRYLAYLESGVPKEQAKYKIIFVHGFDSCRYDALPISPELAQELGIYQLSFDRPGYAESDPNLASTEKSIALDIEELADNLQLGPKFYLMGFSMGGEIMWSCLKHISHRLAGVAILAPVGNYWWSGLPSNVSWHVWNQQLPQDKWAVWVSHHLPWLTYWWNSQKLFPASSVIAYNPALFSEGDKLLLSKFAFRTYMPQIRQQGEYGCLHRDMTVGFGKWSWSPLELEDPFAGGEGKVHLWHGAEDLIVPVSLSRYLSEKVPWVVYHELPKSGHMFPLADGMADTIVKSLLLGDQPPQAS

SEQ ID NO: 25692 - protein, 479 aa, Streptomyces coelicolor A3(2)
MVTAAHRTASAPDAARTFPKGFLWGSATASYQVEGAAAEDGRTPSIWDTYARTPGRVRNGDTGDVATDHYHRRSEDVALMAELGLGAYRFSLAWPRIQPTGRGPAVQKGLDFYRRLVDELLEKGIQPVATLYHWDLPQELEDAGGWPERATAERFAEYAALAADALGDRVRTWTTLNEPWCSAFLGYGSGVHAPGRTDPVAALRAAHHLNLAHGLAVQALRERVRADAQVSVTLNIHHVRPLTGSEGDADAARRIDALANRVFTGPMLNGAYPEDLLKDTAELTDWSFVQDGDLRQAHQPLDFLGVNYYTPTVVSETDGSGAHTSDGHGNSSHSPWPGADRVAFHQPPGDTTAMGWAVDPTGLYDLLRRLSADFPRLPLVITENGAAFDDYADPEGQVNDPARIAYVRGHLAAVHQAILDGADVRGYFLWSLLDNFEWAHGYSKRFGAVYVDYPTGTRIPKASARWYSEVARTGVLPGA

SEQ ID NO: 25693 - protein, 169 aa, Ostreococcus tauri
  misc_feature (169)..(169): Xaa can be any naturally occurring amino acid
  unsure (1)..(169): unsure at all Xaa locations
MAIDANDLACALFDLDGTLCDSDPVHYDAFDALARARGRPREGLTWTYFREHIAGRANVDIFARLFPELTASERATLASAKERAFRDALETSTVTRTRGLTELLEALDARGVTTCVVTNAPRANAEAMLTRLGLREYFGDRLVIGEECVRMKPDPAPYVEGMRRCGTEX

SEQ ID NO: 25694 - protein, 176 aa, Triticum aestivum
MANQGSKKIVERNRKRMDLLWRIILVSNVIYIVVRMAVMYSSFTWKHWIGLVVTSAAYFLSYKQLASMTKPEYSDADNRELLSSGYDLATGGLSEYIEDVIYITAFVQLTSIISGKFWWTYLVIPAFGGYKIFFLLKGTFFGGGSEGEVEDEKSRKKREKMEKKASRGKMVKTRTR

SEQ ID NO: 25695 - protein, 470 aa, Frankia sp. EAN1pec
MRVVIIGAGIAGLSAASALTGRAEVTVVEAGDRIGGKLRTTPIEGLAVEEGAEAFLVRVPEALRLARHVGLGHDIVHPTTTKASLWVGGRRRPIPPNTMLGVPTDVLGLVRSRVLSPFGLLRAAADLVLPRTTLPTDPTVGGYVGARVGREIVDRLVDPLLGGVYAGRADALSLQATVPQLTPIATEDRSLLLGAHRVRARTGPAPAQTPVFASLRGGLGSFAEKVASTSGATVRTGLMARELRRVEGGWQVRCDPVGGGEVPPPLVADAVILAVPAGAARDLLSPIAPHAAAPLAGVPYASVGLVTLLYRGAVPPPGSGLLVPARAGLSIKAVTYLSVKWPHIARGGDLTVVRASVGRAGADDDLRRGDVELAGVAAAEVAQVTGISARPIANRVSRWGGALPQYLPGHLGRIAAVRRALPAGIALAGAGYDGVGIPACIRSGEAAAASVVGQLRPDGTQAAESEPAGA

SEQ ID NO: 25696 - protein, 394 aa, Synechocystis sp. PCC 6803
MTKIETRTEPMVLNMGPHHPSMHGVLRLIVTLDGEDVVDCEPVIGYLHRGMEKIAESRTNIMYVPYVSRWDYAAGMFNEAITVNAPEKLADIEVPKRAQYIRVIMLELNRIANHLLWLGPFMADVGAQTPFFYIFREREMIYDLWEAASGMRLINNNYFRVGGVAVDLPYGWNDKCEDFCDYFLPKVDEYEKLITNNPIFRRRVEGVGTVTREEAINWGLSGPMLRGSGVKWDLRKVDHYECYDELDWEVQYETAGDCFARYLVRIREMRESVKIIRQALKAMPGGPYENLEAKRLQEGKKSEWNDFQYQYIAKKVAPTFKIPAGEHYVRLESGKGELGIFIQGNDDVFPWRWKIRSADFNNLQILPHILKGVKVADIMAILGSIDIIMGSVDR

SEQ ID NO: 25697 - protein, 468 aa, Hordeum vulgare subsp. vulgare
MGAFILLLCLLVPLVLVCAVRARKGAGGRSSSGGGKKGRLPPGSMGWPYVGETTQLYSSKNPNVFFARKRNKYGPIFKTHILGCPCVMVSSPEAAKFVLVTQAHLFKPTFPASKERMLGRQAIFFQQGDYHTHLRRLVSRAFSPEAIRGSVSSIEAIALRSLGSWEGHEVNTFQEMKTYALNVALLSIFGEEEMQYIEELKQCYLTLEKGYNSMPVNLPGTLFHKAMKARKRLGAIVAHIISARRERERGSDLLGSFMDGREALTDDQIADNAIGVIFAARDTTASVLTWMVKFLGDNPAVLKAVTEEHAEIAREKALSGEPLSWADTRRMRVTGRVIQETMRVASILSFTFREAVEDVEYQGYLIPKGWKVLPLFRNIHHNPDHFPSPEKFDPSRFEVAPKPNTFMPFGNGTHSCPGNELAKLEMLVLCHHLATKYRWSTSKSESGVQFGPFALPINGLPMTFTRKA

SEQ ID NO: 25698 - protein, 385 aa, Oryza sativa (japonica cultivar-group)
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIEAVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYGCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 25699 - protein, 444 aa, Capsella bursa-pastoris
MATITVVKARQIFDSRGNPTVEVDIHTSNGVKVTAAVPSGASTGIYEALELRDGGSDYLGKGVSKAVGNVNNIIGPALIGKDPTQQTAIDNFMVHELDGTQNEWGWCKQKLGANAILAVSLAVCKAGAVVSGIPLYKHIANLAGNPKIVLPVPAFNVINGGSHAGNKLAMQEFMILPVGASSFKEAMKMGVEVYHHLKSVIEKKYGQDATNVGDEGGFAPNIQENKEGLELLKTAIEKAGYTGKVVIGMDVAASEFYSSDKTYDLNFKEENNNGSQKISGDALKDLYKSFVAEYPIVSIEDPFDQDDWEHYAKMTTECGKEVQIVGDDLLVTNPKRVAKAIAEKSCNALLLKVNQIGSVTESIEAVRMSKKAGWGVMTSHRSGETEDTFIADLAVGLSTGQIKTGAPCRSERLAKYNQLLRIEEELGSEAVYAGVNFRTPVEPY

SEQ ID NO: 25700 - protein, 376 aa, Photobacterium profundum SS9
MTEQFIKSKAAIAWGPNQPLSIEEVDVMLPKAGEVLVRIVATGVCHTDAFTMSGDDPEGIFPVILGHEGGGIVEMIGEGVTSVEVGDHVIPLYTPECGECKYCKSGKTNLCQKIRETQGKGLMPDGTTRFYKDGQPIFHYMGCSTFSEYTVLPEISLAKVNKEAPLEEVCLLGCGVTTGMGAVLNTAKVQEGDTVAVFGLGGIGLSAIIGAQMAKASRIIAIDINESKFDLARQLGATDCINPTKFDKPIQDVIVELTDGGVDYSFECIGNVNVMRSALECCHKGWGESVIIGVAGAGQEISTRPFQLVTGRVWRGSAFGGVKGRSELPEIVERYMAGEFKLNDFITHTMGLDDINKSFELMHKGESIRTVIHFNK

SEQ ID NO: 25701 - protein, 137 aa, Streptomyces coelicolor A3(2)
MSESNGKQAVHTDGAPRPAGAYSQGVVAGGFLFTAGFGPQDPVTGAVPKGVGAQTAQVLRNVGAVLAARGLSPRDVVKVTAHLQHLRRDFAAYDAAYREFFEEPHPVRTTVGSDLMDILVEIDVVVLLPGPGPDLPG

SEQ ID NO: 25702 - protein, 85 aa, Magnetococcus sp. MC-1
MADITIYSTTICPFCVRAKQLFKKKGVDFTEINLDKQPDRRDEMLAKSGGRRTVPQIFIGDRHVGGCDDLYELELDGELDPLLGL

SEQ ID NO: 25703 - protein, 1478 aa, Saccharomyces cerevisiae
MPFLRKIAGTAHTHSRSDSNSSVKFGHQPTSSVASTKSSSKSPRATSRKSIYDDIRSQIPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESPLSPTKSGPSKTDEKIFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRSTPKPRVITMTEVSNTNPTEELNYWNIKEVLSHEENAPKMVFKTSPKLELNLPDKGSKLNIPTPITENESKSSFQVLRKDEGTEIDFNHRREAPYTKPEVAPKRESPKPPANTSPQRTLSTSKQNKPIRLVRASTKISRSKRSKPLPPQLLSSPIEASSSSPDSLTSSYTPASTHVLIPQPYKGANDVMRRLKTDQDSTSNSPSLKMKQKVNRSNSNVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 25704 - protein, 290 aa, Debaryomyces hansenii CBS767
MSTVNKKVNYPFWYGGAASMVACLVTHPLDLAKVRLQTASKPGQSLGSMVYQIITKEGFLKIYSGLSASLLRQATYSTARFGIYEFLKETYTEKYHTTPSTGILLPMSMVAGALGGLIGNPSDVVNIRMQNDSSLPIEQRRNYRNAFDGIFRIIKEEKVSSLFRGLVPNLTRGVLMTASQVVTYDIAKNLLVDTLHLDPSKKATHFSASLLAGLVATTVCSPADVVKTRIMNAKGASNGSTISILTSAVKTEGVGFMFRGWLPSFIRLGPHTIVTFLALEQLRKFKVGMF

SEQ ID NO: 25705 - protein, 146 aa, Glycine max
KCKPNTPLNFKFFCFSDMQRKRRPMIDYMDKVQKQVTTTMRTILVDWLVEVAEEYKLLSDTLHLSVSYIDRFLSVNPVSKSRLQLLGVSSMLIAAKYEEVDPPRVDPFCNITDNTYHKAEVVKMEADMLTTLKFEMGNPTVNTFLR

SEQ ID NO: 25706 - protein, 195 aa, Brassica napus
MASIQFGSTCVAQWSIRPHFAVRVYHPSSGLQSSTRQQNSTRSRINCLGASRSSMFSHGSLPLLSMPGMSRNMQPRRGSRFTVRADADYYSVLGVSKNATKSEIKSAYRKLARNYHPDVNKEPGAEEKFKEISNAYEVLSDDEKKSLYDRFGEAGVKGAGGMGGMGDFSNPFDLFESLFEGMGGMGGGGGMGRGS

SEQ ID NO: 25707 - protein, 391 aa, Arabidopsis thaliana
MEQREEKTENIQRKRSRGKSSSSSLPLDLTSEIFSRLPAKSVVRFRCVSKLWSSITTAPYFTNSFETRPNLMFFFKEGDKFFVFTIPQHNQNPNESYSYSSSEIIDSYHTTYPKRCCVTTLTESVHGLICFRKAATPIIWNPTMRKFKPLRKLDERWKNIKVSLGYDPVDGKHKVVCMPYGNAFYECRVLTLGSDQEWRTVKTNHKNSPFTFHGGVCYRQSRCINGVIYYRADTNSGRVILSFDVRSERFDVIELPWDENFGLVMMMSYKGRLACLGFNHEKNSRSMWVLENVEQREWSCHTYLPISHYEPGLENYFNLTGITNDGELIYVPNTVLERFHVIYFDAIRETFRRVIYKGVADKGFRLRNGLEDKPIRRLHFFPNHIETLMSL

SEQ ID NO: 25708 - protein, 306 aa, marine gamma proteobacterium HTCC2143
MLVRNFIGSVDPGMRSILSGVDSYAQVLKPGSIISGATIGVVEDSHHPKFAIGDVVSGGFGWTELGVSDGRGLLKLTDRRVPYSCHIGVLGVPGLTAFFGLERIAQLKDNETLLVTSAAGTVGATAGQLAKLRGCHVTGIAGSDDKCSWLKNVCGFDEVINYKTVGDLDMAIAEACSGGIDVLFDNVGNTMIDRVIPRMKVGGRIVVSGQVADYNKAPEDVPGIHNTSAFITHRLRMEGLVVYDDFRDFSRAKEEMIGHIMKGDLHYREHVTEGVANMPEAFISLFTGESFGRRLVQLGDIPEQRQ

SEQ ID NO: 25709 - protein, 215 aa, Synechococcus sp. CC9605
MDEKEGSYIDSGWGLDDPSAIVEELKAGFQRFLEGHTAHPHASEARRHQLAGGQHPQVALLACSDSRVPVEVIFDAGFGDLFVIRNAGNTNTFGSAGSIEYAVLDLNVRVLVVMSHQGCGAVKAAYLKEASFSASLTELVTDIKTGLTSHGISTDDLSSYNDACLRHASITATSLMDTSAPIFDAVQNKRLMIQPAFLHIDPLAISWLPPLYGRG

SEQ ID NO: 25710 - protein, 443 aa, Synechococcus sp. CC9605
MATTDIFMPALSSTMTEGKIVEWLKQPGDKVARGESVLVVESDKADMDVESFQDGYLAAVLMPAGSTAPVGETIGLIVETEAEIADAQAKAPTAPAAAAAPAPAPAPAPTPAAVQAPAPTPAPAPAPVAAPAPSAPVVNDGRIVASPRAKKLASQMGVDLATVRGSGPHGRIQAEDVEQASGQPISVPRVAEGTAPAASAAGAAAAAAPAAPAGNSFGRPGETVAFNTLQGAVNKNMEASLAVPCFRVGYTITTDKLDAFYKQVKPKGVTMTALLAKAVAVTLARHPQVNAATTVAGMAYPVDVNVAVAVAMEDGGLITPVLRNADRTDLYEMSRQWGDLVKRSRSKQLQPEEYSTGTFTLSNLGMFGVDRFDAILPPGTGAILAVAASRPKVVANKDGSIAVKRQMQVNLTADHRVIYGADGAAFLKDLADLIENRPESLAL

SEQ ID NO: 25711 - protein, 494 aa, Yarrowia lipolytica CLIB122
MAIIVAVFVAFGGLLYGYDTGTIAGIMTMGYVKEHFTDFGKNDFTSGQSSLTTSILSVGTFTGAIVAPLAADTAGRRLGLLLYCLVFSVGAILQTVTTGRVLLIVGRVIAGLGVGGISSIVPLYQSEVSPKWIRGAVVSVYQFAITVGLLLAAIVNNATKDRPNTSSYRIPLGIQLIWALILSAGLVFLPETPRFWVKKNRPEKAAEALSRLRRLPTDSKPVKKELLELQKSFEMEMEVGNSSWKACFSPHGSQLKRLLTGVSIQALQQLTGINFIFYYGTNFFKTAGIKDPFVVSMITSAVNVAFTLPGILFVDKVGRRKLLLIGAVVMCVSELIVAAVGAALDSQVSSKVLIAFTCTFIAGFASTWGPIAWVVVAEIFPLRIRAKGVAISVAANWIFNFAIAFATPYLVDKKPGSAGLESKVFFIWGGCNFLAIAFVYLFVYETKGLSLEQVDEMYSEVKYAWQSDRFQTEIMSGKTEVSPDQSCDSGFDSD

SEQ ID NO: 25712 - protein, 341 aa, Bradyrhizobium japonicum USDA 110
MDLTELNRIATAMVAPGKGILAADESSGTIKKRFDAIGVESTESNRRDYREMLFRSREAMSQYISGVILYDETIWQDAKDGTPLVKLIESSGAIPGIKVDEGTQGLPMCPGELVTVGLDKLAERLKKYYERGARFAKWRAVIDIGSGIPSMTAISVNAHALARYAALCQAAQIVPIVEPEVLMDGDHDIDRCYEVTQRVLNKTFQELRVQRVALEGMVLKPNMAISGKKCAKQAPVEEVAEKTIRLLKACVPAAVPGIAFLSGGQSDEEATAHLNAMHKLGPLPWGLTFSYGRALQAAPQKAWSGKAENVAAGQRAFSHRARMNGLASKGEWQSSLEKKAA

SEQ ID NO: 25713 - protein, 399 aa, Ostreococcus tauri
MVIVILPNRVVCGPGCDLVNTSHTEHADRIGEASHGDDDRDAPNAPTTRIDRARARTDAHGVDREIERDMARDASRGALIVTAWYAANIGVLLLNKYILSVYGFKFPVFMTLCHMCMCSVLSATAREFKIVPKQFIRTRRHYGKVAVLAMTFALSVLGGNVSLRYIPVSFNQALGATTPFFTAIFAYLMLHKKESTATYMTLVPVVGGIALATWGEPSFNFFGFMACLVGVCCRALKSVLQGWLLSPVGEKEAEKLSHSSENKLDSMSLLYYMSPVAIMTLGVFTLIMEPNAISAFYEAAELDPWFIAILLGNCFVAYLVNLTNFLVTAHVGALTLQVLGNAKGVVCTVVSIMLFRNPVTFRGIVGYTVTMIGVWLYSSSKRKSARLANALMENAKTGV

SEQ ID NO: 25714 - protein, 551 aa, Oryza sativa
  misc_feature (407)..(407): Xaa can be any naturally occurring amino acid
  misc_feature (410)..(410): Xaa can be any naturally occurring amino acid
  unsure (1)..(551): unsure at all Xaa locations
MLTVAASALGNNKKSTPAACFSLARPFLLSSPTPPPPPHSSSLPRSPSPRPRLPLPPPRRAALVTAAQDPRWRRAMASLAVSASASASGEEVTHLAQREAAEIDEQLMGPLGFSVDQLMELAGLSVAAAVAEVYKLGEHTRVLVICGPGNNGGDGLVAARHLHHFGYKPSVCYPKRTPKPLYSGLCTQLESLTIPFVPVEDLPANLSEEFDIIIDAMFGFSFHGTPRPPFDDLINRLVSLSAIDNSAKRPAIVSVDIPSGWHVEEGDINGGGFKPDMLVSLTAPKLCAKKFTGPHHFLGGRFVPPPIVSKYKLHLPPYPGTSMCVRIGKAPSVDISSLRENYISPELLENQVMPDPFDQFVRWFDEAVTAGLREPNAMALTTADKEGKPSSRMVLLKGVDKQGFVWXYKXTNYGSQKAHDLSENPNAALLFYWNEMNRQVRVEGSVQKVPEEESEKYFHSRPRGSQLGAIVSKQSTIIPGREVLQQAYKELEQKYSDGSVIPKPDYWGGYRLTPKLFEFWQGQQSRLHDRLQYSLREVDRSTVWHIERLSP

SEQ ID NO: 25715 - protein, 398 aa, Bradyrhizobium japonicum USDA 110
MANKFRTLDDVDVKGKRVLLRVDLNVPMENGRVTDATRLERVAPTITELADKGGKVILLAHFGRPKGRDAKESLKPVTEALSKVLNKPVAFADDCIGEPAATAVAALKDGDILCLENTRFHKEEEKNDPAFVAELAKLGDIWVNDAFSAAHRAHASTEGLGHKLPAYAGRTMQAELDALEKALGSPTKPVIAIIGGAKVSTKIDLLENLVSKVDALVIGGGMANTFLHAQGVGIGKSLAEKDLAPTALRIIEKAEAANCAIILPVDATVAYHFAANAPSHAYGLDAIPADGMILDVGPQSVARVHAAIDDAATLVWNGPLGAFEMQPFDRGTVAAAKHAAERTKAKKLISIAGGGDTVAALNQAHVAGDFTYVSTAGGAFLEWMEGKPLPGVEVLRIK

SEQ ID NO: 25716 - protein, 317 aa, Vigna radiata
MANFPVVDMGKLNTEERGTAMEMIKDACENWGFFELVNHGISIELMDTVEKLTKEHYKKTMEQRFKEMVANKGLESVQSEINDLDWESTFFLRHLPVSNVSENTDLDQDYRKIMKQFAEELEKLAEHLLDLLCENLGLEKGYLKKVFYGSKGPNFGTKVSNYPPCPTPDLIKGLRAHTDAGGIILLFQDDKVSGLQLLKDDQWIDVPPMRHSIVINLGDQLEVITNGKYKSVMHRVIAQTDGTRMSLASFYNPGDDAVISPAPALVKESDETSQVYPKFVFNDYMKLYAGLKFQAKEPRFEAMKAVSSVDVGAIATV

SEQ ID NO: 25717 - protein, 335 aa, Bradyrhizobium japonicum USDA 110
MAVRVGINGFGRIGRNVLRAIAESGRKDIEVVGINDLGPVETNAHLLRFDSVHGRFPGTVTVDGDSISLGGGKIKVTAERDPSKLPWKDLGVDIALECTGIFTSKDKASAHLTAGAKRVLVSAPADGADATIVYGVNHDTLTKDHLVVSNGSCTTNCLAPVAKVLNDLVGIETGFMTTIHAYTGDQPTLDTMHKDLYRGRAAAMSMIPTSTGAAKAIGLVLPELKGKLDGVAIRVPTPNVSVVDLKIIAKRATDVKEINAAMKRASEQQLKGILGYTNAPNVSIDFNHDPHSSTFHEDQTKVQNGTLVRVMSWYDNEWGFSNRMADTAVAIAKVI

SEQ ID NO: 25718 - protein, 671 aa, Bradyrhizobium japonicum USDA 110
MMQLDASRMAHTQVDHSRMANAIRGLSMDAVEKAKSGHPGLPMGAADIATVLFTQFLKFDAAAPAWPDRDRFVLSAGHGSMLLYSLLYLTGNADMTLDQLKQFRQLGGLTPGHPENFHTKGIETTTGPLGQGISTAVGMALAEKMLAAEFGKKIVDHHTFVLASDGDLMEGVSQEAIAMAGHWKLNKLIVLYDDNGISIDGPTSIADSVDQVKRFKSAGWAAEKIDGHDQAAITAAITRAKKSNKPTLIACRTTIGFGAPHKAGTSKVHGEALGAEELKAAKENLGISLEPFSVPDDVLKAWRAAGSRGAAARQEWEGRLGELGSRKRAEFERRLRHERPASLAKAVRAYKKELLEKPLVAATRKSSEAVIEVIAGAMPMEFLAGSADLTGSNNNKAKSATAFSAKTPKGRFIHYGIREHGMAAAMNGIFLHGGFAPNGATFLVFTDYARPAMRLAALMGTGVVYVMTHDSIGLGEDGPTHQPVEHLAALRAIPNMRVFRPCDSIEVAECWELALNRIDGPTVLALTRQNLPQLRTTAPNDNPCAAGAYELVPAQGEAKATLFASGSEVEIAVAAQKQLAERGIPSRVVSVPSLELLLAQPEAKRAEIIGNAPVKVAIEAAVRWGWDAVIGQDGEFVGMHSFGASAPAKDLYKHFGITAEAAVNAVLKRVS

SEQ ID NO: 25719 - protein, 285 aa, Glycine max
MEAKKEYEVDHLTTLTGTSFSQLLFGDDDDDYDESALGLAVDQSYSYNYNNLTRSPLFSIHKAPQMLCFGNHQNEEGGVLLPETNVTPQKSVITSSDSSSASASSCNHTNTAFNSLPKSNNSLQKKRNGMGQESVTKVGVGSQRQTKKNKAENPTSTGHAKRKEKLGERIAALQQLVSPFSKTDTASVLHEAMGYIRFLHDQVQVLCSPYLQSLPSSYHQNQHGGGGNNEEEVNKDLRSKGLCLIPVGCTVHVAGSNGADFWSSAAIGNNVSFTISQAVKRNQDQ

SEQ ID NO: 25720 - protein, 593 aa, Schizosaccharomyces pombe 972h-
MSYSKSTIYRRQGTEPNSHFRRTVEEKSQLSGTNEESLGGHTLSSNAFKNNSSSISPSSSAKDPREQRKRTFPLNDTHSSRARQHERPFRSRKSRRRKGKKAFSPRPGSPPSPSFYRSGSQKRARNLTTKDYFAKRSESSSSASVSPISPSANRNDSKRQASSFRRSPPSSVHMKPSAFNGRKVSRRPSSSPPPIPSIPHETTSSDTQKKSSVSSGFPENKHGKFHFHIPNERRSRFDQPPSKRMALTSTARESVPAPLPSPPSGPIYTYTYPKPAYEKIDQIGEGTYGKVYKAINTVTGDLVALKRIRLEQEKDGFPITTVREVKILQRLRHKNIVRLLEIMVEKSSVYMVFEYMDHDLTGVLLNSQLHFTPGNIKHLSKQIFEALAYLHHRGVLHRDIKGSNILLNNNGDLKFADFGLARFNTSSKSANYTNRVITLWFRPPELLLGETAYDTAVDIWSAGCIVMELFTGKPFFQGRDEISQLEVIYDMMGTPDVHSWPEVKNLPWYELLKPVEEKKSRFVETFKEILSPAAIDLCQKLLALNPFCRPSAHETLMHEYFTSESPPPEPAVILKNMQGSWHEWESKKRKSKR

SEQ ID NO: 25721 - protein, 327 aa, Synechocystis sp. PCC 6803
MGIGVNSDPKVVHHQSIPKPNAMAIANYRAITTKQWQTWVEAARLQALNGKLPQYIPQLSLVDPGNFALDIGDQNGIIYEAGDTDLTFSLMSVVKPFLWLYILHHRGWQWAEQKVGDRPSHLPFNSVEQLEQDGGYPRNTMVNSGAICLAGHIPGATIEQRCENFLTWLNHTAQCQLWLDQELLASVHSLPNPRNLAIAHLLAAKGYVEDATLALETYNQLCCLSGCLKDLFKLGLMLQCPQPPLQPDTTARVKATMAKAGLYEMSEAFFRRTGFICKSGVSGLILACLPAPSPTIFACYSPPLNEEGNPVAPLALLEFLAEFTSRN

SEQ ID NO: 25722 - protein, 786 aa, Nicotiana tabacum
MEEPTRLVEEATINNMDGQQNEEERDPESNSLHQPLLKRNRTLSSSPFALVGAKVSHIESLDYEINENDLFKHDWRRRSRVQVLQYVFLKWTLAFLVGLLTGVTATLINLAIENMAGYKLRAVVNYIEDRRYLMGFAYFAGANFVLTLIAALLCVCFAPTAAGPGIPEIKAYLNGVDTPNMYGATTLFVKIIGSIAAVSASLDLGKEGPLVHIGACFASLLGQGGPDNYRLRWRWLRYFNNDRDRRDLITCGSSSGVCAAFRSPVGGVLFALEEVATWWRSALLWRTFFSTAVVVVILRAFIEYCKSGNCGLFGRGGLIMFDVSGVSVSYHVVDIIPVVVIGIIGGLLGSLYNHVLHKILRLYNLINEKGKLHKVLLALSVSLFTSICMYGLPFLAKCKPCDPSLPGSCPGTGGTGNFKQFNCPDGYYNDLATLLLTTNDDAVRNIFSINTPGEFQVMSLISYFVLYCILGLITFGIAVPSGLFLPIILMGSAYGRLLAIAMGSYTKIDPGLYAVLGAASLMAGSMRMTVSLCVIFLELTNNLLLLPITMLVLLIAKSVGDCFNLSIYEIILELKGLPFLDANPEPWMRNITAGELADVKPPVVTLCGVEKVGRIVEALKNTTYNGFPVVDEGVVPPVGLPVGATELHGLVLRTHLLLVLKKKWFLHERRRTEEWEVREKFTWIDLAERGGKIEDVLVTKDEMEMYVDLHPLTNTTPYTVVESLSVAKAMVLFRQVGLRHMLIVPKYQAAGVSPVVGILTRQDLRAHNILSVFPHLEKSKSGKKGN

SEQ ID NO: 25723 - protein, 549 aa, Photobacterium profundum SS9
MAVDNRKADATLESLHRIFTVPEAPESTLGLIEQKISQNLNEFLGTHIAAREKPLIEIEKDFSSAEIPENPSFVSDHTQFLLTKLVAQSVHTSAPSFIGHMTSALPYFLMPLSKIMIGLNQNLVKIETSKAFTPLERQVLGMMHNLIFNEETSFYQQWMHSADHSLGAFCSGGTIANITALWVARNNVLKPDGEFKGVANEGLFRAMKHYGYDDLAILVSERGHYSLKKAADVLGIGRDCLIPIKTDDNNRIRVDDLTATLQSLKEKNIKPFAIIGVAGTTETGNIDPLDELADIAQAHDCHFHVDAAWGGATLMSNKYRSLLKGIERADSITIDAHKQLYVPMGAGMVIFKNPALMTSIEHHAEYILRKGSKDLGSHTLEGSRSGMAMLLFASLNIISRQGYEMLINNSIDKAKHFANMVKQDPDFELVTEPELCLLTYRYVPAETQQALTIANAEDKHLLHDALNDLTKFIQKRQRESGKSFVSRTRLTPEKWDHKITTVFRVVLANPLTTDNILQDVLIEQKELAKESVHSLPRLFTLTKRILANN

SEQ ID NO: 25724 - protein, 120 aa, Glycine max
DNQWQDGKWDHGPTGTLSDATTLVPCVTRKLMPGGIKHTLNSKLMPTIDWILHPPNPFVLNTAHALLVNTTPALMVPFVPLPVLTMIHLADYKKKNVPNHFNENELDHVLEDNDFYVLNH

SEQ ID NO: 25725 - protein, 428 aa, Staphylococcus aureus
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFETANKSDLKLFAEMYREMAKEGVFLPPSQFEGTFLSTAHTKEDIEKTIQAFDTALSRIVK

SEQ ID NO: 25726 - protein, 285 aa, Pseudomonas fluorescens Pf-5
MAWLTVATPAVGTVVALVLAWHQGIGWLEIGALASMYLLTALGVEVGMHRFFSHHAFKAGPVITAFFGIAGSMAAQGPILFWAATHRQHHAFTDKEGDPHSPRPLKAGFIGNIQGWWHAHLGWLFSLRKQNWSQFVPDLLRDRLIMQINQRYYLWIILGLLLPSLACGLITRSWEGALSGLLWGGFVRIFLVDHATWCINSFAHRVGGRDHKTRDTSRNVFWLAIPTVGGGWHNNHHAFPALAHAGLKPWQLDIGGLFIELLALCGLAWDVKRPGPTVAAEPSES

SEQ ID NO: 25727 - protein, 318 aa, Pseudomonas fluorescens Pf-5
MDEILTNTATPEVGGVAQLSPSAARTKARIALAVMLVPLFGTLEAIRLWFTGQVHALDFILFAVFYAVQMFGVSMGYHRYLAHRAFKTSRLMSSLMLIAGCMAAQGPILFWVTTHRRHHTYSDQHGDPHSPNLMGQSRWQRAKGLWHAHMPWMLAPDMSSWNFFAPDILRDRRLFFYNQTYLFWVALGVILPGVIGGLVSQSWSGAWSGLIFGGLARIFVANQAAWCVGSICHRYGARPFVTHDQSTNNWIVAFLTFGEGLQNNHHAFPAWYRHGVHWWEPDLSGWTLALMGKLRLVSDLRSPSQAMIDKVRKRQASS

SEQ ID NO: 25728 - protein, 500 aa, Arabidopsis thaliana
MATIWFLSLLFLCCILLAAFKHKKRRTNQQQPPSPPGFPIIGNLHQLGELPHQSLWSLSKTYGPVMLLKLGSVPTVVVSSSETAKQVLKINDLHCCSRPSLAGAKELSYNYLDIAFSPFDDYWKELRRICVQELFSAKRVHSIQPIKEEEVRKLIVSATESASQKSPVNLSEKFLDLTVSVICKAAFSLDFHTSVLNNDGFDKLIHDAFLFLGSFSASNFFPNGGWIIDWLTGLQRRREKSVKDLDVFYQQMFDLHKQENKQGVEDFVDLLLKLEKEETVLGYGKLTRNHVKAILMNVLLGAINTSAMTMTWAMAELIRNARVMKKVQSEIRNQMINKSVITLDDIDHLPYLKMVIKETWRLHPPVPLLLPREVMSEFEINGYKIQPKTLLYVNVWAIGRDPDSWKDADMFYPERFMDNNIDAKGQNFELLPFGSGRRICPGMYMGTTMVEFGLANMLYQFDWEVPDGMVVEDIDMEESPGLAVGKKNELLLVPVKYLGH

SEQ ID NO: 25729 - protein, 266 aa, Methanosarcina acetivorans C2A
MLTFIGLGLFDEYDISLKGLEAVREADLVYAEFYTSCLMGTNPEKMEKLYGKKVHLLSREDVEQQPDWLDKAKDKNVAFLTGGDTMVSTTHVDLRLRAEKLGIETHLIHGASIASAVSGLTGLQNYRFGKSASIPYPYESRRGAIIISETPYDTIKQNSELGLHTMIFLDIDKDKGYMTANHALELLLEVEKRRGEGIMERAVAVGIARAGSEKPVVKADYAESLKDFDFGNPLHILVVPGKLHFLEAEALVKLAAGPGKIMEETE

SEQ ID NO: 25730 - protein, 376 aa, Achlya bisexualis
MADDDVQALVVDNGSGMCKAGFAGDDAPRAVFPSIVGRPKHPGIMVGMDQKDAYVGDEAQSKRGVLTLKYPIEHGIVTNWDDMEKIWHHTFYNELRVAPEEHPVLLTEAPLNPKANRERMTQIMFETFNVPAMYVNIQAVLSLYASGRTTGCVLDSGDGVSHTVPIYEGYALPHAIVRLDLAGRDLTDYMMKILTERGYSFTTTAEREIVRDIKEKLTYIALDFDQEMKTAAESSGLEKSYELPDGNVLVIGNERFRTPEVLFQPALIGKEASGIHDCTFQTIMKCDVDIRKDLYCNIVLSGGTTMYPGISERMTKELTALAPSTMKIKVVAPPERKYSVWIGGSILSSLSTFQQMWISKAEYDESGPSIVHRKCF

SEQ ID NO: 25731 - protein, 1342 aa, Oryza sativa
MRFGTYEASYDNLPRLLGVIEGRNPGSSYAVKKFPSIEHPGKSVLQRVFLALHACKMAFVNCRPVLCIDGTFLTGKYRGQILTAIGVDGNNQVLLLAFAFVESENTDSWYWFLKLVKTKVISMRPNVCLIHDRHAGILRAIEELQFGSMERGYPGEWEDVQSRWCMRHMGANFFKQFKNKELMNMFKRLCNQNQEKKFNEFWKRLDELTAKCSDQRAAAPSTAVADPPQALGPLPMDSPTLVRRTGVEIRKFSQWILHEPKEKWAKAYDTSGARYGIMTTNLAEVYNWVMRGVHGLPLVGIVEFILHGTCRYFRDRFQAVLPSMLNNSILFGTFMQKKLEELRIKAMKHRALVQGTQQHRFEILCQDKAGRGIYRKRVKQECVLKADGTCHCSCAKPKLLHRPCTHVIAVATKCGIPDAVYVSQYFSKQAVYHTWSGKIYGFGIAGEFTETNDEGAQLGTFQARTCGDLLTVHDSFVERLREAGLLPMCRLVEDDAGNADPARRWNVDRSLLADLVDRWRPETHTFHLPCGEVEQLQAEADEYSYSRCLEAYLLCLFGWVYTKTDPSATFGGCPLFLSIWAAERIAIGRPEVDQHAYEESLCAERPEVDYPTMGTLWCRRQVKRSYPEFVMEFDRLQPTDVVWEPYSATATQARVPLGMSTLCTRDQAYWMTTVPMVFDICVEPHAPFRVMRQFGFRQPFPVPFPTTVPAAVHRYSRKGQQSAGNWPAKLVTFVEDWLLATEEVVDHEGEPHTEEAYQGYLRWYQPRTRTRVTFAPLEQQAHVASTRELYARHRDQDFARAVDDINRVVVDGSMTIQRLGAGIPTTLLGQTQLYSGYPYRLVPVQLRTFLGRLPLRMEGFVHHSAPRLPRLGLLLCPPQVLRSIKPTTLGRRFFVCPNILDDDFMEPPRRCQYREWIDTIRVLTPPSRVVQLELPEQYRWGGKGPKCKKYEPQALYGLLKLHLAPCCPRDAAKIVRRPKITTVVAQQPPGIRRALADVSNLVNGRAALPVVNRQKAPAAADKCRKPIKQRNENNKAKPEVIVISSDSEKQKKSPAQRAASRRAPIQTLTSILTKCSRASGGVISPKKELIYDIDASDAHNELAVIDYVEDIYRFYRSTENTYRPLCTYMVSQTEINERMRAILTDWLIEVHYRLMLMPETLYLTVYIIDQYLSLENVARNELQLVGVSAMLIACKYEETWAPLLAIVFSAAQFAYDVQLAIMFNAVQFAHDFKDFLVISDNSFSRQQVLSTEKSILNKLQWNLTVPTMYMFILRYLKAALGDKELEHMTSVIAAAAVYAARCTLGPCPEPTMERSSGVPHRLSRATIAVCLLLHDLIFAHEI

SEQ ID NO: 25732 - protein, 553 aa, Prochlorococcus marinus str. MIT 9211
MSSQSNLNEVIPLRVKLGHSFTDQKPGTSGLRKSTKQFQENHYLESFIESIFRTLPGVKGGILILGGDGRFGNRKAIDVIIRMAAAHGVRKVITTVDGILSTPAASHLIRINNSIGGIILSASHNSGGKDGDFGVKINGSNGGPASESLTNSIYACSQNLKEYQIIQNQEISLSVPGEYEIFSMKVEVIDGLKDYIDLMQTIFDFDRIGAFLTKDFPIAFDALNAVTGPYAKKILEDILGACKGTVKNGVPLEDFGGCHPDPNLTYAKELADALLLGNKYFFGAACDGDGDRNMILGKGCFVNPSDSLAVLAANADCVPAYSSGLLGIARSMPTSSAVDIVAKDLGVKCYETPTGWKFFGNLLDSGQITLCGEESFGTGSNHVREKDGLWAVLFWLQILADKKCSVHELMHRHWSKYGRHYYSRHDYEEISSEIAKDLYQRVELMLPSLSGKQFGRRVVKLADNFSYKDPIDSSITTNQGLRILLDDGSRVILRLSGTGTRGATLRVYLESYVASDGNLNQDPQSALCELIRDIDYLAEITKRTGMTSPTVIT

SEQ ID NO: 25733 - protein, 299 aa, Methanosarcina acetivorans C2A
MDRIISVVGHTALDYIIDVENIAGKNESSPVIDYEEYPGGGAANIAVAIAKLGGKSQLMSPVGMDFSSSGYEQLLKDAHVDLSRLYSIEALKLSKAFIFTDREDNQTTYFYWGASSKFKELEPEPVDFAHLATADCIYNAKIAQIAGFVSFDPGQDLVTYSQEKLETILAHTDILFANRHEIKRVSEMTGKSFSELRAMIEVIVITYDAEGSRIYTGNEEWKIPVVSVKAVDPTGAGDAYRAGFLLAYTREYSLPTCGKIGSTVASFAVQSRGCQTSLPTWEEMKSRYEASFGKLEVES

SEQ ID NO: 25734 - protein, 2040 aa, Saccharomyces cerevisiae
SSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 25735 - protein, 533 aa, Frankia sp. EAN1pec
MTLVHPRRVAAVIGGRQHDLYAAAGPAGIAPETARVVSSTNPARLSDVVAEVVLDGAEAIVAAAAAARAAQREWADVPAPVRGEVIGAFGRLVEDNAETLARLVTREIGKPLAEARGEVREIIDTCALFRGEGRRPHGQTVPSEMPDRELFTYREPLGVVMVITAGNFPVAVPSWYLVPALLTGNAVVWKPAEYAAACAAALMDLLTAAGVPPGVANLVLADGPATSLGLERALDAGLVDKVGFTGSTSVGRFVGALCGRHLQSPCLELGGKNPMVLAPDADLDAAVAAALFAGFGTAGQRCTSLGTVIAHESVHGAFRRRLDAAVSGAVLGDPTRDVLYGPLLDARFAAGFEDHLACVRDHHEPFGSTALGRIGPASPRRGFVGDPETGLYYHPVVVDRVRPEDELFTAETFGPIVGLTTYRHLEEAVELANLPGYGLSSSIFTGDPVSVRRFRRGVRAGMVSVNTSTSGAEAHLPFGGNGRSGNGARQSGQWVLDQMTRWQSLTWELSGRLQKAQLDVSVPPADLGFRLPR

SEQ ID NO: 25736 - protein, 374 aa, Debaryomyces hansenii CBS767
MLQLKPRRIIFNISQNFQVIQVVGEGAYGVVCLAIHKPTGIKVAIKKLEPFEKPLFCLRALREIKLLTYFKKHENIISIFDVQKPLNFENFNEIYLIQEYMPSDLHKTIATQNLTDDHIQYFIYQILRGLKLIHSANVIHRDLKPSNILVNENCDLKICDFGLARLDILKEGYDKRLAINSGISMLTEYVATRWYRAPEIMLTSSQYSTAIDMWSVGCILAELFTCTPLFPGNDYRHQLILIFQLLGTPTDADLTCIKSQRAKNYIKTLPYCSPLSLDQVFNRHPNRAKRFGGQPINPLGLDLLKKLLVFDPKERLTVEEALEHPYVSTYHDPEDEPTIMPIPHEDFEFDKSKDKLSILELKRQLYNDIIKCNR

SEQ ID NO: 25737 - protein, 297 aa, Dehalococcoides ethenogenes 195
MKELGRLITAMVTPFKKDGTVDYAQAQKLALGLLDSGSDGLVVVGTTGESPTVTWEEEHALFAAVKSAVGNRGKVIAGTGANSTQEALENTLKAEKIGVDACLLVVPYYNKPTQEGLYLHFKTIAEATKLPCILYNVPSRTITHMSPETVIRLSQIPNIVGVKEASGKLDDIAQIINNVRPDFTVWSGNDSDTLPMLAMGAYGVISVASHIVGKQIKEMITSFVSGNTDNAAAIHRHLTPLIRSLFVVSNPIPIKYALNYLGFEVGGLRLPMTEADEKTAALIRESLKGYTIDLPIK

SEQ ID NO: 25738 - protein, 293 aa, Leuconostoc mesenteroides subsp. mesenteroides ATCC 8293
MTLRELLNIPSSTNKPIIAVPLTLGPTDKISPFAQKLQQQNPDIVEWRADYIADDFSQAVMWQQVKAGAQSELAQKDVSAMTEAKMLSEIDNAKQEFMANWPQINVQIIKELTGTVFNSIGGFPVLLTYRTVAQGGRGEMSPTEYATFMITALHSGFPFAAVDVEYTLDEPLRQSIMDAANKANIPVLLSYHDFESTPKNLPALISDMADTSADIIKLAVMPESEKDVDYLLQTTKNVNISQPLITMSMGEIGKSSRIEGYEYGSEMTFAVLDGTQGSAPGQLTINELLQAWQ

SEQ ID NO: 25739 - protein, 429 aa, Xylella fastidiosa Ann-1
MSDLDKVTLNAGETSLVLPVLKPTLGNGCVDIAKLTKETGLFTYDSGFTATASCKSAITYIDGEKGVLLYRGYPIEQLAEHSSFLEVAYLLMNGELPRKDEFAKFDDEITHHTMMHESLKNFLGGFHYDAHPMAMLAASVASLSAFYHDTLDLNDLEQRRLAAIRLIAKVPTLAAAAHRYSIGWPIRYPRNNLGYVERFLHMMFEVPSEPLQLNPVVTKALDLLFILHADHEQNASTSTVRLVGSTGANPYASVAAGITALWGPAHGGANEAVLKMLEEIGDAKNVDLVIAKAKTKDKNSPFRLMGFGHRVYKHFDPRAKIIREMAHTVLGELGVNDPLLEVALKLEEAALKDDYFVQRKLYPNVDFYSGIIYKAINIPLEMFTVMFAIARTAGWVSHWLEQQVDPEMKISRPRQIYTGHRERDYKDAR

SEQ ID NO: 25740 - protein, 273 aa, Prochlorococcus marinus str. AS9601
MLIKFLQDAAGKGELDPWDIDVISVIDSFLEQYTYTFNQSSNSQISYQKDLAETSEAFFAASVLVNLKAEVLEADVFKENSSDFEDEFDLDDQDWIDKEFDVPKYPEKYLRRRSIAQPILKRTTTLGELVSQLESIAEVIETQDLLLMKRKRNKKYSDKALISQVKSLAHREKLPETTKALGKFIDGWEKALQWTDFEYLVKKWQTVVKNDLDKDRLGVFWALLFLSSENKIEIKQINSLYGPIQIKRIIPDGGLAQLPIENLEVSNVSSSAA

SEQ ID NO: 25741 - protein, 392 aa, Prochlorococcus marinus str. AS9601
MKAMILAAGKGTRVQPITHVIPKPMIPILQKPVMEFLLELLREHNFKEIMVNVSHLAEEIENYFRDGQRFGVEIAYSFEGRIEDGELIGDALGSAGGLKKIQDFQNFFDETFVVLCGDALVDLDLTQAVKKHKQKGAIASLITKKVTKDQVSSYGVVVSDENGRIKAFQEKPTVDQALSDSINTGIYLFEPEIFNYIPSAEKFDIGADLFPKLVEMDLPFFALPMDFEWVDIGKVPDYWTAIRNVLLGKVRQVQIPGKEIKPGVFTGLNVAANWEKVNITGPVYIGGMTRIEDGATIIGPSMIGPSCCICEGATIDNSIIFDYSKIGKGVRLMDKLVFGKYCVGKNGDHFDLQDASLDWLIADSRRSDLTEPSPQQKAMAELLGTDLINIPD

SEQ ID NO: 25742 - protein, 721 aa, Oryza sativa
MAMDAAPALKRKDADPPELWMGGGAAAAASGFPVSSRATKIRRLDAEVPPVVPGVCVPPAPPTQQQPVAGLGAGDVRVFGDQVPVGMAPAAAAAAAAKRKGEDAPELWLDDGGAASGFPVSSRATKIRRLDADVPPPVVPELCAPPPPPQPVAEVQMRGEEVPVIAVPAPNEERAIVLYKPDDAARNLLLGPLRPEFPLRVSPDWIHGLKSTALREASEHRALFEELAMDETSNLAMVPWVPVPSNSQEASTSAAATATTTTEMMDAEDTSMEVEQDGGSGGSHLAAAGEAPYYQWPQHCMAPPPQPPLPAFFLVLAAQWRLSRSWSENRDEILWPCQMEAERSRPYEPTAKDRIDETTPVCATHLSRLGPVNYIFARSRRELRPPFAPLLYRCCQAHHRKSCKKPMGNSKTPQPSKKSRIMLSDTDGHQLDNDEFSSESASNQMVLFNPETVAKGQDELGENHSPSLQKSANNPNRGMPSIGAFTVQCAKCFKWRLIPTKEKYEEIRECIIQEPFECERAREWRPDVTCNDPEDISQDGSRLWAIDKPNIALPPPGWERQIRIRGEGGTKFADVYYTSPTGRKLRSLVEIDRYLLENPDYVAQGVTLTQFSFQIPRPLRQDYVKKRPKIVNPNDEASVVTTKSVKPEEVSPIAWAAPSVHQEGEAGERASHADEPPEAEELELTRKRKAESPLFEEAHSNHVSDEPKTKLEDTQNGGPSA

SEQ ID NO: 25743 - protein, 375 aa, Oryza sativa (indica cultivar-group)
MPASDPALAAAAAAYDRTAELRALDATLSGVRGLVASGATHLPRIFHNVVHGDQEPPEATAPSSAATTTTTVPVIDISGSRAAVVDAVRRAAAEWGFFQVTGHGVPLAAMDAAAGAARAFHESGGGEGSDKARLYSREPGRAVKYHCNFDLYQSPVANWRDTLYLRMAPDPPPAADLPEICRDALFEYAKQVKNLGNTLFELLSEGLGLKPSYLTDIECNQGQIILCHYYPPCPQPELAIGTSRHSDSGFLTILLQDDIGGLQILHEDRWVDVTPTPGAFIVNVADLLQLISNDNYKSVEHRVVAKNTEPRVSIACFFSTHFHPISTRMYGPIKELLSDENPPLYREALVRDYTARYYSVGLDGKFKTTLSEFRL

SEQ ID NO: 25744 - protein, 539 aa, Schizosaccharomyces pombe 972h-
MLRKGICRLIHQVSESSKKPYFLTTPIFYVNAAPHLGHLYSLVLTDAIARFQNLKPDVSVISSTGTDEHGLKVQTVAQTEGVSPLQLCDRNSKRFADLAVAANTKFTHFIRTTNPKHQASVQEFWKTIQKAGMISFERHEGWYCVSDETFYPESAIQKVVDPATKQEKRVSMETGKEVQWSSEMNYHFLLSKFQSRLIEHYNKNPNFVQPSIFHTQVLEELKTGISDLSISRPKQRLSWGIPVPGNSQQTIYVWLDALINYISVIGYPWLNEKSSLSAGWPANMHVIGKDIIRFHCIYWPAFLMAAGLPLPEKILVHSHWTMNKVKMSKSLGNVVDPFWLIEKYGVDTIRYYLLKRGRLTSDSNFDIEELEKDEEHDLRRSLGVLLSRLQSKKLFISNEIQKQWHKKDDFTEYEDIVHELIELPVVCAQSIDGGCVYEVINLVQSVLRRVTKLFQLKEPWKLSDDSQEKIDTLMLVAHSLRISGILLQPIMPTKSTELLDQLGIPKNQRSLQNATNVFEPTEFTFHSGNNSHLFDKRTQ

SEQ ID NO: 25745 - protein, 466 aa, Oryza sativa (japonica cultivar-group)
MAGEGSGGEGGAGAFEDEAEPTVTIGEYIEGIEAEELEADLVLGGDDGKECTYGGGYLKRQAVFSCLTCVPAGVAGVCTACSLACHDGHELGLVSMFIWVRRMSATRVILGVALAVAKLSIAIFCIKYLYDWVMRTQLMLGWFFLLKVVELWTKRKFRCDCGNSKFGSHVCKLCPEKDPENPVNSYNHNFKGSYCTCGRPYPDPEAEKQVEMIQCCICEDWFHEDHIGLNSIEEIPRDEEGEPLYEDFICPKCSPKCYFLKLYPDTIWASNKQSSAPQAETTNSTVMNGNSSLGDIEKSENGALINHLNCEKTSDNENCPKDSVAPEKASLDDSSDGKCKLGMNICSNTPSADSEKKMPFFMSKSWREVICRCETCTDFYAQQGVAYLIDKEDSIEEYEKVAKQKREKKLEQQEGVEANFLNSLDHVQKIEILSGINDMKNELQSFLSISQINGDTSHVSVSGFEF

SEQ ID NO: 25746 - protein, 88 aa, Glycine max
AHRHRKVLRHNIQGITKPPIIRLPTSGGLKSISGLICKKTLGVHKIFLENVICDAVANTEHAPRNTVTAMNVVYALNRQGSPLSGFGG

SEQ ID NO: 25747 - protein, 274 aa, Leuconostoc mesenteroides subsp. mesenteroides ATCC 8293
MTLYGLIAHPAGHSRSPQMQNMMIAEYGIDAHYHAFNILPEKLEEAIVGLKALHVGGFNVSTPFKNEIIQYLDELSPISQRLHAVNTVKSVKGHLIGTNTDGDGFWQSINSRQPKEMVIVLGTGGAARSVIATAKLYGVRELIVFNRVHEDWHERKAEISYLSEGNGHLEDLADNQMLTKALKRADMLINATTVGMNDLRTLLTDLQIALLPQHALVVDMIYRNQQTTLLKSANQRGLATLNGLPMLVNQGALSFEYWFDRPADRNLMKKAIEE

SEQ ID NO: 25748 - protein, 640 aa, Leuconostoc mesenteroides subsp. mesenteroides ATCC 8293
MKTSSLSTETIQSLRLLSNQMISKAGSGHPGIALGAAPILYELYANQLNVDPENPNMINRDRFVLSAGHGAALLYATLHAAGFDLSAQDLSEFRQPHSKTPGHPEVGVTPGVEATTGPLGQGLGMAVGMAMAEAKLNNQFPSVIDHFTFALVGDGDLMEGVSHEVASLAGQQKLGKLVVLYDDNAVSLDGLKKRSDISNNLARFASYGWDIREVADGNDLEAIHDAIENAKMSPEPTLIAVKTIIGDFGPFAGTNKAHGTPLDSQQLQDLSSALDVDIQNFELPSNLLEDLRAKISNRLLHQKQPLNDELTDYLQFSTKNTVTIPELPTDLKVQAGRKISKYVLQNFATQLPQLWGGSADLVASTNAEVVASPLFNADDRSGRNIAFGVREFGMGAVMNGIALHGGTKVFGATFLAFSDYMKAAIRLSALQHVPSIYVFTHDSITVGEDGPTHQPVEQLMGLRLIPGVDVLRPGTAEEIASAWQRALTSTDRPTILILSRGEIGAQGSTDQAKQSFENGAVQIRHHDEAKINLIATGSEVQIAQKVSELLSLPSNVVSMPNLSRFLALDDDKKQQIIPETGTKNVIIEAGTTLGWQGIAGNDGVIFGIDEFGMSAAAQIALDEFGFNAEDIVDKITQELQ

SEQ ID NO: 25749 - protein, 376 aa, Glycine max
MATGVTRKISAASARAHTRRAKKTNSLPLPSGILGTALAVLFIGFLAWAYQVIQPPPPKICGTPDGPPITAPRIKLRDGRHLAYKEHGVPKDAAKYKIISVHGFNSCRHDAVIADTLSPDVVEELGIYIVSFDRPGYGESDPDPNRTLKSIALDIQELADQLGLGSKFYVVGVSMGGQVVWNCLKYIPHRLTGAVLVAPVVNYWWPGLPANLTTEAYDQQKLQDQWALRVAHYVPWLTYWWNTQRWFPGSSVIAHSPHIFSHQDKELLPKLLSDRKSYAAQVIQQGDYETIHRDINIGFGNWEYSPLDLENPFPNNEGSVHLWQGDEDMMVPVTLQRYIAQNLPWINYHELQGSGHIFAHADGMSDTIIKSLLRAK

SEQ ID NO: 25750 - protein, 484 aa, Pseudomonas fluorescens Pf-5
MSESYDVIVIGAGPGGYVAAIRAAQLGLKTVCIERYKGKDGKTALGGTCLNVGCIPSKALLDSSHHYYEARNGFEVHGIAISNPQMDVPAMLARKDNVVRNFNGGIASLFKANGVALLEGHGKLLANKEVEVTAADGSTQRISAGNIILAPGSRPIDIPAAPLAGEVIVDSTGALEFTQVPKRLGVIGAGVIGLELGSVWARLGAQVTVLEALDSFLPAVDAQIAKEAQKILGKQGLDIRLGARVTACEVQGDSVKVSLSEAGEDKQQVFDRLIVAVGRRPLTTDLLAADSGVHLDERGFIHVDGQCCTSVPGVFAIGDVVRGPMLAHKASEEGVMVAEGIAGHRHPLNYDLIPSVIYTHPEIAWVGQTEQALKAEGVELNIGTFPFAASSRAMAANDTAGLVKVIADAGTDRVLGVHVIGPGAAELVQEGAIGMEFGTSAEDLGMMVFSHPTLSEALHEAALAVNGQAIHIGNRKKKAPAGVK

SEQ ID NO: 25751 - protein, 376 aa, Candida albicans
MDGEEVAALIIDNGSGMCKAGFAGDDAPRAVFPSLVGRPRHQGIMVGMGQKDSYVGDEAQSKRGILTLRYPIEHGIVSNWDDMEKIWHHTFYNELRVAPEEHPVLLTEAPMNPKSNREKMTQIMFETFNVPAFYVSIQAVLSLYSSGRTTGIVLDSGDGVTHVVPIYAGFSLPHGILRIDLAGRDLTNHLSKILSERGYSFTTSAEREIVRDIKERLCYVALDFEQEMQTSSQSSAIEKSYELPDGQVITIGNERFRAPEALFRPADLGLEAAGIDQTTFNSIMKCDMDVRKELYGNIVMSGGTTMFPGIAERMQKEITALAPSSMKVKIIAPPERKYSVWIGGSILASLSTFQQMWISKQEYDESGPSIVHHKCF

SEQ ID NO: 25752 - protein, 372 aa, Polaromonas sp. JS666
MSITTTNQASKKRIAVIAGDGIGKETMPEGVRVLDAAARKFGIDLHFDHFDFSSWDYYEKHGQMMPDNWKDQIGGHDAIYFGAVGWPEKIADHVSLWGSLLLFRREFDQYINLRPARLMPGIIAPVVRRDGSPRQPGEIDFYIVRENTEGEYSSIGGRAFPGTDREFVLQESVFTRVGVDRVLKFAFELAQSRPKKHLTSATKSNGISISMPYWDERVAEMAKSYPAIRLDKFHIDILTAHFVQRPDFFDVVVASNLFGDILSDLGPACTGTIGIAPSANLNPERKFPSLFEPVHGSAPDIAGRNLANPIGQIWCGAMMMEFLGHKEAHDAILAAIEKVLRPDSGAPRTPDLGGKAGTADVGKAVAAALAEV

SEQ ID NO: 25753 - protein, 375 aa, Gibberella zeae PH-1
MSPSAVEGNGVVDVKTTLKPNVGVYTNPNHDLWVAPAEPSAEAVKSGSDLKQGEVSVAIRSTGICGSDVHFWHAGCIGPMIVEGDHILGHESAGEVIAVHPSVSHLKVGDRVAIEPNIPCGTCEPCLTGRYNGCETVQFLSTPPVPGMLRRYINHPAVWCHKIGNMSYENGALLEPLSVALAGMQRAEVRLGDPVLICGAGPIGLITLQCCAAAGASPIVITDISESRLAFAKELCPRVITHKVERLSAEDSAKAIVKSFGGVEPTVAMECTGVESSIAAAVWSVKFGGKVFIIGVGKNEINIPFMRASVREVDIQLQYRYCNTWPRAIRLVENNVVDLSKLVTHKFKLEDAIKAFETSADPKTGAIKVMIQSLE

SEQ ID NO: 25754 - protein, 112 aa, Triticum aestivum
MADVDMTDAPPVGKKKGSEAEAKKRFEVKKWNAVALWAWDIVVDNCAICRNHIMDLCIECQANQASATSEECTVAWGICNHAFHFHCISRWLKTRQVCPLDNRDWEFQKYGR

SEQ ID NO: 25755 - protein, 434 aa, Burkholderia pseudomallei K96243
MSSQSQSPSVAQSIPSYLHADDLGPWGNYLQQVDRVAPYLGSLSRWIETLKRPKRILIVDVPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQIMAWMMDTYSMNQGQTATGVVTGKPISLGGSLGRKEATGRGVFVVGCEAAKKKGLEIEGARIAVQGFGNVGGIAAKLFQEAGAKVIAVQDHTGTIHQPAGVDTVKLLEHVGRTGGVAGFEGAEPMPNDEFWTVETDILIPAALENQITEKNASKIRTKIIVEGANGPTTTAADDILSANGVLVIPDVIANAGGVTVSYFEWVQDFSSFFWTEDEINHRLERVMREAFAGVWAVAEEHNVSVRTAAFIVACKRILMAREMRGLYP

SEQ ID NO: 25756 - protein, 274 aa, Oryza sativa (indica cultivar-group)
MYEWRWTEAVSPEILALILRGRVDADEVARGAARVCRAWREAAAAPDVWGDVDIEAWCRRVNCRPRADAAVRRLVALARGTLRQLSAYRVGDAALAYVAASGKLLNVLQIPMSEISDQAVKKYAEFLPALRVLDISNCLKISSSGIEALGRHCKLLVQLKRNMPPPDVPHGYNAVPNVVNDEALAIANTMPVLEHLELAYGLFSDTGLGAILTRCPRLQTLDILGCWNVRLEGDIELRCCALESFREPWEPMYSDCSSTGSDNDDDDEDNDSDN

SEQ ID NO: 25757 - protein, 343 aa, Vibrio cholerae O1 biovar eltor str. N16961
MKIKALSKLKPEQGIWMNEVDMPELGHNDLLIKIKKTAICGTDVHIYNWDEWSQKTIPVPMVVGHEYVGEVVGIGQEVRGFQIGDRVSGEGHITCGHCRNCRGGRTHLCRNTIGVGVNRTGCFSEYLVIPAFNAFKIPDGISDDLASIFDPFGNAVHTALSFDLVGEDVLITGAGPIGIMAAAVAKHVGARHVVITDVNEYRLDLARKMGVTRAVNVAEQNLEDVMKELGMTEGFDVGLEMSGVPSAFSAMLKTMNHGGRIALLGIPPSSMAIDWNQVIFKGLVIKGIYGREMFETWYKMASLIQSGLDISPIITHHFKVDDFQKGFDIMRSGASGKVILDWQ

SEQ ID NO: 25758 - protein, 172 aa, Burkholderia pseudomallei K96243
MILIAMGVSGAGKSRIGEMLAQRLSCSYTDGDAFHSAANKEKMHHGIALTDEDRWPWLRSIREAIEARQRAGETAVFTCSSLKRAYRDILRGNDRDVRFVYLKGSFDVLRERLKTRTGHFFDPSLLQSQLDTLEEPGPDEAIEVSIELTPDEIVERVMRELDRERQQQQQQQ

SEQ ID NO: 25759 - protein, 151 aa, Arabidopsis thaliana
  misc_feature (78)..(78): Xaa can be any naturally occurring amino acid
  misc_feature (144)..(144): Xaa can be any naturally occurring amino acid
  unsure (1)..(151): unsure at all Xaa locations
MVSLRRRRLLGLCCGPNGYVTPLPFLTAEEMITGIPNPNARAAYNPGPAETVTTVIVEKKAIEERSRRTRSKHMHFRXPPKRRKQHRRKRVHNQEPCLMRGVYYKNMKWQAAIKVEKKQIHLGTFSSQEEAARLYDRAAFMCGXEPNFELS

SEQ ID NO: 25760 - protein, 409 aa, Zea mays
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQSHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 25761 - protein, 452 aa, Polaromonas sp. JS666
MRFTDLEQPTTAAGPRMDAAWLDAHWMPYTANRSFKANPRMVVEASGAYLTDAGGRKIFDGLSGLWCSGLGHCRREITEAVSRQVSKLDYAPAFQFGHPLAFELANKIKELTPQGLDYVFFTGSGSEAADTSLKMARAYWRAKGQAGKTRLIGREKGYHGVNFGGISVGGIAANRKLFGQGVEADHLPHTQPPTGSFHRGMPPTGAELADRLLDVIALHDASNIAAVIVEPFSGSAGVVIPPQGYLQRLREICTAHNILLIFDEVITGFGRCGAWTGAEAFGVVPDIMNIAKQVTNGAQPLGAVVATKDIYDTFMDAGGPEYMIEFPHGYTYSAHPVACAAGVAALDVLQKEDMIGRVKALAPHFENAVHSLKGSKHVADIRNYGLAAGFTIAALPGEPARRPYEIAMNCWKKGFYVRYGGDTIQLAPPFISEKAEIDRLINALGDALAETA

SEQ ID NO: 25762 - protein, 237 aa, Triticum aestivum
  misc_feature (138)..(138): Xaa can be any naturally occurring amino acid
  unsure (1)..(237): unsure at all Xaa locations
MAARLLLLSFDCPAVAGGRRSRLSAVPRMSSGAPLVRPPASSVRAFAVTAARGKLPHRTSVAVEGGGVYTVGDFMTKREQLHVVKPSTSVDEALERLVEHRITGFPVTDDHWNLVGVVSDYDLLALDSISGIVWNCCXNGQAEADIFPEVDSTWKTFHHIQKLLSKTNGKVVSDVMTSAPLVVRETTNLEDAARLLLVSKYRRLPVVDSSGKLVGIITRGNVVRAALEFKKNVEGSL

SEQ ID NO: 25763 - protein, 428 aa, Sulfolobus acidocaldarius
MEKIRWVIEESEKYLANTTRDPESQPLVIDRGEGVWVYDIEGNKYLDFTSGIGVNNLGWPSHPDVIKVAQIQMTRLAHAPANDFYNIPQMELAKRLVQLSPGNFSKKVFFSNSGTESVEASIKLVKGTGRKYLIAFLGSFHGRTLGSLALTASKPVQRYSAGPFSIGVFHVPYPNPFRNPWKINGYEKPDELINAVIEYIDFWLFQHVVDPEEVAGIIFEPIQGEGGYVVPPHNFFAELRKLAQKYNIPLIDDEVQMGLGRTGKMFAIEHFNIEPDIITLAKALGGGLVPVGATIFRSDLDFKKKGIHSNTFGGNALSMSIGLKVVELIKELMPHVNEIGKIFGEELCQMKVDDCRGLGLAWGIEFVKSDKTPDPKVRDRVVTEAFKEGLIVISAGKSSIRIIPPLVISEEAKIGLSKLKTAINRVRG

SEQ ID NO: 25764 - protein, 208 aa, Prochlorococcus marinus str. AS9601
MKNFLQQINSYIKEAFNAGKYLYNGLSVTFDHLRRRPVTVQYPYEKLIPSERYRGRIHYEFDKCIACEVCVRVCPINLPVVDWVMNKETKKKELRNYSIDFGVCIFCGNCVEYCPTNCLSMTEEYELATFDRHNLNFDNVALGRLPTNVTTDPSVKPLRELAYLPKGVMDPHEIPASDTRVGKLPEEVYDWMRPESNKNKDKVSNSNN

SEQ ID NO: 25765 - protein, 142 aa, Synechocystis sp. PCC 6803
MTESVISPEDAFNQAIARYNGGEGPETLIPVFKDIADSSPKNATVWACLAWLYLLDDKPTLAFKAAQRSVKIDGYHPQARINYALAMLANKKTGVREQVELAAQMMSFDQEIAAGVMESLDDGLERKPDWRDIERIKKWLTE

SEQ ID NO: 25766 - protein, 381 aa, Prochlorococcus marinus str. AS9601
MDSNKLILKPGLEGVPVTNSSICDIDGNKGKLLYRGFSIEELSKKSSFLETAYLLIWGELPTAIQLRDFEQEVQMHRRLSFRVRDMMKCFPATGHPMDALQSSAASLGLFYSRRAIDDPNYIYNAVIRLIAKIPTMIAAFQLIRKGQDPIQPRDDLTYSSNFLYMLTEKEQDPIAAKVFDRCLILHAEHSLNASTFSARVTASTLTDPYAVIASAVGTLAGPLHGGANEDVIAMLEEIKTPENAGSFLDNAIKNKSKIMGFGHREYKVKDPRAIILQKLAEELFIRFGADEMYEVAKSLEAEAIPRLGPKGIFPNVDFYSGLVYRKLGIPRDLFTPIFAISRVAGWLAHWREQLGANRIFRPSQIYTGSAPRDWISLENRE

SEQ ID NO: 25767 - protein, 133 aa, Zea mays
HASGIVSLVAALLILLALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 25768 - protein, 169 aa, Triticum aestivum
  misc_feature (69)..(69): Xaa can be any naturally occurring amino acid
  unsure (1)..(169): unsure at all Xaa locations
MAPTVMASSATSVAPFQGLKSTAGLPVSRRSNGASLGSVSNGGRIRCMQVWPIEGIKKFETLSYLPPLXAREALLKQVDYLIRSKWVPCLEFNKVGVHLPVEQQRISLGTTNGRYWAMWESCPMFGVATDPNKRWIKQGEGGSRKGVTPGAVLSGNPSGSNQCGQGGVA

SEQ ID NO: 25769 - protein, 110 aa, Arabidopsis thaliana
MEIESVRCECCGLMEDCTQDYISEVKSNFDNKWLCGLCSEAVRDEVSRRKMTTVDEAVKAHVSFCGKFKKDNPAVHVADGMRQMLRRRSGELTNSSTSKKFGRSNTTKLY

SEQ ID NO: 25770 - protein, 108 aa, Haemophilus somnus 2336
METLDKIKKQISENPILIYMKGSPKFPSCGFSARAVEVLINCNVPFGYVDILQHPDIRAALPNYANWPTFPQLWVEGELIGGCDIMLEMFQQGELQPLLSEVAARYPQ

SEQ ID NO: 25771 - protein, 229 aa, Medicago truncatula
MDFFMSSFSDYSDTSSSETASSNRTSSSEVILAPARPKKRAGRRVFKETRHPVYRGVRRRKNNKWVCEMRVPNNIVNKNNKSRIWLGTYPTPEMAARAHDVAALTLKGKSACLNFADSAWRLRLPESNDATEIRRAAMEAAQLFAVEDKQCCVTVEDGVFMDMEDSKNMLEAQVPVVSSEFEDMHHLLLSIANEPLRSAPPSPTNYGSYNWGDMEIFDTQLVSLWNFSI

SEQ ID NO: 25772 - protein, 513 aa, Staphylococcus epidermidis RP62A
MEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGDQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 25773 - protein, 113 aa, Prochlorococcus marinus str. MIT 9211
MTEETIFHRILRGEIPCDEVYSDSLCLAFRDIQPAAPVHILVIPRKSLPSLMEAQKEDSNLLGHLLLVAKKVAIKEGLSNWRTVINTGAEAGQTVFHLHIHVIGGRTLTWPPG

SEQ ID NO: 25774 - protein, 153 aa, Arabidopsis thaliana
GSGFPGRTTRVQEEVRASFMFSFAVGVTSPVKATMVVQLTGWKQSVFFRVTRKANNTFTSITGIGGGVSCLKVGPPIGRKKLGTLFYLPDLTDVEWAKEVDYLLRTKGIPGVEFEWEHGFGSREPGTTPGSYIGRSWPMGKLPLFGCTDSVQG

SEQ ID NO: 25775 - protein, 272 aa, Brassica napus
MALTRNLIRDEELGAMSDDDDSPSGKRSKLDRFPLSRWELAVSLGVFLVFSSGLFCIYMTMPAAEFVKLKLPRSISDLRLLKDNLADYANEYPAQFVLGYCATYIFMQTFMIPGTIFMSLLAGALFGVIKGVVLVVFNATAGATSCFFLSKLIGRPLITWLWPDKLRFFQAEIGKRRDKLLNYMLFLRITPTLPNLFINLASPIVDVPFHVFFLATLVGLIPAAYITVRAGLAIGDLKSVKDLYDFKTLSVLFLIGFISILPTILKRKKIYE

SEQ ID NO: 25776 - protein, 368 aa, Thermoplasma volcanium GSS1
MPIKDRFDDHAHSLSFPVFFTSSYDSRKDRKYRYSRELNPTVEELSRQLSLLENTERSICFSSGMGAITGTILALAKPGDKLVMPTDVFGRTYLFAKNFLTKFGINVKFVEPGTDSLLGAVEEHADIVFFESLSNPLLRLYDVDRICRKASDIGAITIVDNTLATPILLKPSLYGCDIIIESLSKFIGGHNNAIGGSASGSLMMDTIDENRRSLGSSMDPMSAYLFILGLKTIDLRIKRSSETAKAIARFLNENNFVSKVYYPGLSDNSDNISAKTLLNGSPPIVSFLLDEGKDVQKFMESLRIITPANTMGGSNSTISNPYTMSHRNLSEDEKLRLGITKNLMRLSVGLEDLDQIIQDLEQAIKYAQ

SEQ ID NO: 25777 - protein, 585 aa, Yarrowia lipolytica CLIB122
MAKGKLSSGGVKSSVADKTTAAAIHTLPRIQGDDTVYVPDKVNRHNMNPTYFLPRAAEIEPNAKAYIHKGADGVRVERTYGEMADRVLGLATYFKSKEFKRVAICGPNTPAHLETMFGAVAAGAYVLGLNYRLTMGEITYKMELGDADCVVVDREFVHLISPEIRAKCQVIVDDDVSGASKPQQPGEILYSNVVQQGMQLAKEQKTTWDNLHVQNEDEDEILGLFYTSGTTGKPKAVEYTHRSVYLCAMSNIIEAGLNCETVDGHNRCHYLWTLPLFHAAGWTFPYSVTAVRGTHVLLRKIEPDYIWDLLVDDRITHFNAAPTVNNMLVNNPKARRLPQTVRVTVAASPPSAALFNKMFDMNLHPVHMYGLTESYGPFVRNYFLQDWHGATGDERYALMARQGFAFVGSQSVQVIANNDINQPVPRNGQEIGEIVCRGNAVMARYHKDPEATAKAFEQGWFHTGDLAVVNPDGSIKILDRKKDIIISGGENISSVAVEGIICKYDNVLEVAVVGIPDEKYGEVPKAFLILKDKSKPFDTDKMIAWMRERMGAYQIPRQVSVVDDLPRTSTGKIKKNVLRDSVQAA

SEQ ID NO: 25778 - protein, 275 aa, Mycoplasma gallisepticum R
MQARKLQDFLISTVTLLRDTIKNKKAIIPLNGGVFSFVLAKITKIALNKNLICIYIDNGMMRHNEVANKINFFREKLDLEVWHIDAKELFLNNLKGHISYADKKKAIDDTFLEVVIQTIVDIGEKIDFALLGTCFDDLNQGLNISMALTNDVYIFEPLKQLTIQQVIELGELLSIDPNFLKEPTLPLSGFGLMVEDEVTEEKIVILKKVYYLINTILNQGLQNKFEISIRDDYKDKSAYNLYIEFNQPISDLLVKKVKDQINGLLSNIKKIFIKV

SEQ ID NO: 25779 - protein, 924 aa, Synechococcus sp. CC9605
MNQSTPATPRSEPDVDRSAPLNPSEIFPFPLDDFQLEAMDALNQGHSVVVSAPTGSGKTLIGEYAIHRALAHDQKVFYTTPLKALSNQKLRDFRDQFGAENVGLMTGDLSVNREASIVVMTTEIFRNMLYAEADEHDDPLTDVEAVVLDECHYMNDSQRGTVWEESIIHSPPTVQLVALSATVANAGQLTDWIDKVHGPTTLVMSDHRPVPLQFSFCSAKGLHPLLNDAGTGLHPNCKVWRAPKGHKRKGRSQRPTQPEPPPITFVVAQMAERQMLPGIYFIFSRRGCDKAVRDLGVQCLVSKQEQARIKARLTAYSNDNPEAVRDGIHADALLRGIAAHHAGVLPAWKELIEELFQQGLVKVVFATETLAAGINMPARSTVIAAMSKRTERGHRPLMGSEFLQMAGRAGRRGLDSQGYVVTVQSRFEGVREAGQLATSPSDPLVSQFTPSYGMVLNLLQRHDLAKARELVERSFGRYLAGLDLVEDEDNLSQLRLQLSQLEGVAGDIPWEDFEDYEKMRGRLREERRLLRILQQQAEETLANELTMALQFASTGTLVSLKSPQLRGRVAPAVIVEKVKGPGQFPLLLCLTDENVWILVPCQAVVSIHAELSCLQVDGLEVPELSRSGELRHGDQASGGLALAVAHMARRHDMTTPQYDLAGEVLTQARLVRDLEQEQEQHPAHRWGDRKQLKKHRRRMEDLELEIAERQQQLHQRANRHWETFLALMDILQHFGCLDELDPTEIGRTVAALRGDNELWLGLALMSGHLDDLSPPDLAAVFEAISTEVNRPDLWSGFPPPAAAEEALQDLSGLRRELLRAQERAGVVVPAWWEPELMGLVDAWARGTSWSDLIANTSLDEGDVVRIMRRTVDLLAQVPYCEAISEQLRSHARQALKAINRFPVAEAEDLVPASAALNPATERAA

SEQ ID NO: 25780 - protein, 319 aa, Glycine max
MPKERRDRSLSHESSRASPYPSSSSRVGRSSLKESEENVKEWEEARCPVCMEHPHNAVLLICSSHEKGCRPYMCNTSYRHSNCLDQFCKSFADTSSTIPQVEGQISDTFESRIDVPEDRNEGTVQSRIDVPEDRSEGLVTMQALSCENDAKSKLVCPLCRGKIKEWKVVEAARHFMNEKSRNCSCETCNFSGTYPDLRNHARLEHPLERPSAVDPERQRSWRRLERQRDLGDLLSTLQTSFGVDDPIDDGGLLAVFFLILQPASMSRGTTLQMRIRRPTTTLWGENYDGQSGSDDANESSDGGSDNRPRRVRRRRTPPP

SEQ ID NO: 25781 - protein, 308 aa, Zea mays
MRPPARGGRGGRGGRFDGGGRGGGGGGRGFGGGRGGRGDRGGRGGRTPRGGRGGGGRGGRGGGMKGGSKAVVVAHKHAGVFISKSKEDALCTKNMVPGESVYGEKRVSVQNEDGTKVEYRVWNPFRSKLAAAVLGGVDNIWIAPGTRVLYLGAASGTTVSHVSDIVGPDGLVYAVEFSHRSGRDLVNMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRVPKKQKATS

SEQ ID NO: 25782 - protein, 104 aa, Methanosarcina acetivorans C2A
MPEADLSILNRVYDIILDRKENYDENSYVCKLLNHRKGMNKILEKVGEESIETILAVRNEDHKEIVSESSDLIFHLLVLLAANNVTLDEIAGELSARHEKMKRD

SEQ ID NO: 25783 - protein, 217 aa, Triticum aestivum
MGVSPVSPGGSAGYECSFKILLIGDSGVGKSSLLVSFVAAANLDDDIAPTIGVDFKIKFLTVGGKKLKLTIWDTAGQERFRTITSSYYRGAQGIILVYDVAKRESFTNLGDVWTKEIDSNSSNKDCIKMLVGNKVDKDDERTVTREEGLAFAQESGCLFLESSAKTRENVENCFEELVLKILEVPSLLEEGSSSVVKRNILKKQQESHAKYGGRCCQ

SEQ ID NO: 25784 - protein, 572 aa, Oryza sativa (indica cultivar-group)
MSDSELSQSTVVFGLRMWVLVGVAVGAAFVLFLVLLSVLCLLASRRRRRRRGPNTSPVQQLPVSAPPKNPQKVKAPKDIQEVPAQATAAAAAAAAKTPLAQVLQMPAPPPPPMAAAAPPPETVQIATGKEHRITYPEPPHRSGSSSHGSGEAPSVPEVSHLGWGHWYTLKELEAATEMFADENVIGEGGYGIVYHGVLENGTQVAVKNLLNNRYPTTNSSQLRCTEITAATQLDCLRVIAMGIDHPRTVDRGQAEKEFKVEVEAIGRVRHKNLVRLLGYCAEGNQRMLVYEYVDNGNLEQWLHGEVGPVSPLSWDSRVKIILGTAKGLMYLHEGLEPKVVHRDVKSSNILLDKHWNAKLSDFGLAKLLGSERSYVTTRVMGTFGLDSAHYEHTPRIPDECSWLLIFSTLYRYVAPEYAGTGMLNETSDVYSFGILIMEIISGRVPVDYNRPPGEVNLVDWLKTMVSTRNSEGVVDPKMPQKPTSRALKKALLVALRCVDPDARKRPKIGHVIHMLEVDDFPYRDERRGARAPVQARVADKPVAIEAGDRESDSSGKEKEQLAVGNAFVMILN

SEQ ID NO: 25785 - protein, 256 aa, Frankia sp. EAN1pec
MRDRFALDGQVAVITGGGTGIGRGAALALAEYGADVVLAARRVEPLESTAKEVQAAGRRALSLPTDVTSAQQCQQLVDTTVAEFGRFDILVNCAGGAETKSIRRWTEEEWHQVLALNLGSVWFLSRAASVPMLQQGRGAIVNISSGASLLAMPQAAPYGAAKAGVNSLTRSMAAAWTGKGIRVNAIAVGAVRAATLTDDAARYGLDPEAIGLTNASGRLGEPDEIGNAVLFFASDAASFCSGQTLYVHGGPGPAGV

SEQ ID NO: 25786 - protein, 409 aa, Zea mays
MQFALALDTNSGPHQIRSCEGDGIDRLEKLSIGGRKQEKALRNRCFGGRVATTTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 25787 - protein, 160 aa, Oryza sativa (indica cultivar-group)
MAVLVARQGRELQRYTSAGGRIVVGCIPYRVRSGGEMEVLVITSQKGHGMMFPKGGWELDESMDEAARREALEEAGVRGNTETSLGCWYYKSRRYDTTYEGFMFPLRVTDELLQWPEMSSRKRTWATVQQAMDGCQHGWMREALERLVSRHATNKLQSAL

SEQ ID NO: 25788 - protein, 581 aa, Triticum aestivum
  misc_feature (57)..(57): Xaa can be any naturally occurring amino acid
  misc_feature (179)..(179): Xaa can be any naturally occurring amino acid
  misc_feature (209)..(209): Xaa can be any naturally occurring amino acid
  misc_feature (306)..(306): Xaa can be any naturally occurring amino acid
  misc_feature (372)..(372): Xaa can be any naturally occurring amino acid
  unsure (1)..(581): unsure at all Xaa locations
PIEQVCTKKQAGTGPEFPGYRRPTSPGKTTLMDVLAGRKTSGSIEGSITVSGYPKKXQETFARVSGYCEQTDIHSPNVTVYESILYSAWLRLSSDVDENTRKMFVEEVMTLVELDVLRNAMVGLPGVDGLSTEQRKRLTIAVELVANPSIIFMDEPTSGLDARAAAIVMRAVRNTVNTXGRTVVCTIHQPSIDIFESFDELLLMKRGGXVIYAGELGRHSHKIVEYFEAIPGVEKITEGYNPATWMLEVSSPSAEARLNINFADIYANSDLYRKNQQLIKELSVPPPGYEDLSFPTKYSQNFYNQXVANFWKQYKSYWKNPPHNAMRFLMTMINGLVFGTVFWQKGTKIGSQQDLFNLLGATYAAVFFLGAXANCITVQPVVSIERTVFYREKAAGMYSPLSYAFAQTCVEVMYNIVQGIEYTVIIYAMIGYEWKAAKFFYFLFFIVSSFNYFTLFGMMLVSLTPSSMLANILISFVLPLWNLFAGFLVVRPLIPIWWRWYYWANPVSWTIYGVVASQFGDNKSPLKVPGGSDTFVKQFLEDNLGIKHDFLGYVVLAHFAFIIAFFFVFGYSIKVLNFQKR

SEQ ID NO: 25789 - protein, 683 aa, Debaryomyces hansenii
MSDAKDTEDNLSPRFENLNIRTPKAANPENMQSPQRLSHSQINGDIQARILAFQQKRTKPVNGGHGGLNSIPASSNHLSEAPDKPLPPLPPLPSLPKLPNVQAQQRSYSLGDANDLGVIPSPMETENIHTTNQTMNQTMNRGINQSIGQGMSRASSIKKQDSQQLPFELLKKPSLSQRRGMKLNLSEMSSPNSASSPDDTSPIGDDKKNPVFLNAPKGNDIESGAMNTTGDLSRMLSDRKKKPNFKLNLGNTGVPGVNGMQNSQSNSNTNSTASSLDSSGSSSTAGTNNETNQSKKPQLQGLFANYSKYVDIKSGSLNFAGKASLHSKGIDFLSGLLFRISLEELEFLEELGHGNYGVVLKVLHKPTGVLMAMKEVRLELDETKFTQILMELEILHKCDSPYIVDFYGAFFVEGAVYMCMEYMDGGSLDKIYGKDDGVKDEACLAYITECVISGLKELKDEHNIIHRDVKPTNILVNSLGKVKLCDFGVSGNLVASLAKTNIGCQSYMAPERIKSLSPTDNTYSVQSDIWSLGLSILEIAAGHYPYPAETYGNIFSQLSAIVDGDPPKLDPKIFSKDAQLFIKSCLNKNPDLRPSYATLLKHPWLVKYRNIDPHMGEFVTKKIQELEEEKNKKNLSRSNSTSSSAATAKPPKENVRSLLKGKVQAPALHRGGLMNSSRNNANR

SEQ ID NO: 25790 - protein, 395 aa, Prochlorococcus marinus str. AS9601
MAQLETRTEPMVVNFGPHHPSMHGVLRLVVTLDGENVIDCEPVIGYLHRGMEKIAENRTNVMYVPYVSRMDYAAGMFYEAIVVNAPERLANIPVPKRASYIRVLMLELNRIANHLLWLGPFLADVGAQTPFFYIFREREMIYDLWEAATGQRLINNNFFRIGGVACDLPYGWLEKCIDFCDWFGPKIDEYEKLITNNPIFKKRIEGLGTIQRDQAINWSLSGPMLRASGVSWDLRKVDSYECYDDFDWQIASEKEGDCYARYRVRVEEMRQSLSIIRQACKMIPGGPTENLEAQRMVTEDKKSEIFGIDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 25791 - protein, 115 aa, Glycine max
MAGLQRSAVSFRRQGSSGFVWDDRFLSEELNKVKEDQNNNNDGGPEIKELHQVQTTPPPERTRSNGGARGYRTGKVSPAIEPPSPRLSACGFCAAFGKAGDNKPQRTTPAKHRPR

SEQ ID NO: 25792 - protein, 427 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPILLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDIKEKLCYIALDYEQELETAKTSSSVEKNYELPDGQVITIGSERFRCPEVLYQPSMIGMENAGIHETTYNSIMKCDVDIRKDLYGNIVLSGGTTMFPGIADRMSKEITALAPSSMKIKVVAPPERKYSVWIGGSILASLSTFQQNMMSQARRLFTGNAFELEVKSASGEALGVFQFVLTGFLSSFSALLCFSSSIFSDSGLRHFEEFTLSVCSVG

SEQ ID NO: 25793 - protein, 294 aa, Rhodobacter sphaeroides 2.4.1
MTRNAHVALVTCFHEDETVNYAATRAQVRRQLAAGNDLMVCGTNGDFSALTHDEKIRLVGEVMEEVAGRAKVIANVGCPATFETLQLARAVDGMGLHGIAVIAPYFISCTQDGLIRHFSTVADAVTTPVYLYDIPARTQNHIEPATVGTLARHGNIAGIKDSGGSTDTVRAYLDVARDVEGFEVYCAPDHLVLWGLEEGCAGVVSGLGNVAPGLLAQIIAGFNAGDMEAARAAQENFAGLRKDLYALGFPPALVKRALYLNDPSVGLSRQPALLPDAAQDAQILAILTARGLKE

SEQ ID NO: 25794 - protein, 332 aa, Neurospora crassa
MTDSLHNAPIVLDNGSGTIRAGFAGDDVPKCHFPSFVGRPKHLRVLAGALEGEVFIGQKAASELRGLLKIRYPLEHGIVTDWDDMEKIWAYVYDEGLKTLSEEHPVLLTEPPLNPRANRDTAAQILFETFNVPALYTSIQAVLSLYASGRTTGVVLDSGDGVSHAVPVYQGFTVPNSIRRIDVAGRDVTEYLQTLLRKSGYVFHTSAEKEVVRLIKESVTYVAHDPRKEEKEWAAAKMDPAKIAEYVLPDGNKLKIGAERFRAPEILFDPEIIGLEYPGVHQIVVDSINRTDLDLRRDLYSNIVLSGAARSQRVSAIACSRKCRSSRLRTCG

SEQ ID NO: 25795 - protein, 115 aa, Polaromonas sp. JS666
MTTTSSGLQYEDTVLGTGAIAKAGQHVKVHYTGWLYNGGTQGAKFDSSKDRGQPFEFSLGAGQVIRGWDEGVQGMSVGGTRRLIIPAELGYGARGAGGVIPPNATLLFEVDLLAT

SEQ ID NO: 25796 - protein, 388 aa, Dehalococcoides sp. BAV1
MKLSKRIENLPPYLFVQISKKIAEKRAKGEDVISFAIGDPDLPTPKHILAELCKAAEDPSNHRYPETEGLPVLRKAMAEWYQKRFGVKLNPDTEVLPLIGSKEGIGHAAWCFLDPGDIALVPNPAYPVYAISSQLAGAEVFNLPLNKGNNFLPNLEAIPQNILSKAKVLWINYPNNPTGAVAGLSFFQEVANFAAKHNLAVCHDGPYSEIAFDGYKPVSFLEADGAKDVGIEFHSLSKSYNMTGWRIGMAVGNAKMIDALRRFKSNLDSGIPQAIQLMAIAALNGSQEIINQNCAIYQRRRDRLVEALRNIGMEVTAPKASLYIWAPVPESYTSASFATELLDKTGVVVTPGTGYGTAGEGYIRLSLTVPDEQIEKGIAKLAGYKKSS

SEQ ID NO: 25797 - protein, 253 aa, Dehalococcoides sp. BAV1
MRQIIIAGNWKMNTTLSEACTLVQSMKCELERIEGIEKIICPPFISLYPIKTMLENSSIKLGAQNLFYQEKGAYTGEISPLMLKELCQYVIIGHSERRAYFGETGQVVNQKIKAALQAGLLPIVCVGEKPEENENGQTRQVLETQLKEALDGLNLSCIIIAYEPIWAIGTGKAATASEANSAIGYIRRVLGDTLGNAAAQTSPILYGGSVNEKNITEILSQTNIDGALVGGASLKAESFVSICRQAAVIQNKH

SEQ ID NO: 25798 - protein, 397 aa, Dehalococcoides sp. BAV1
MENLTIRDLNFSGKKALVRVDFNVPINEETGTINDSSRIRAAIPTIDYLLDHQAKVILCSHLGRPDGMIVESMRLAPVAKRLSEILRQEVFTASDCIGDEVAAKVDALEDSQVLLLENLRFHPEEEANDPIFAKKLADLADIYVDDAFGTAHRKHASIVGVAKYLPAVAGLLLEKELNALGKVLEHPPRPFMILLGGAKVSDKVGMLENVMDKVDTILIGGGMAATFLKAQGLEIGDSLIDDSLDTAKMLMDKAKSKNVKIILPDDVLVTFDKIGPEARAENVSVENIPHTAKIVDIGLLTITHFTKHLEKCKTVFWNGPMGIYEIPQFSEGTRAMVNTMTRLHATTIIGGGSTAEIVTELNIASKMSFVSTGGGASLKFLSGEKLPGVEVLAKKNE

SEQ ID NO: 25799 - protein, 464 aa, Magnetococcus sp. MC-1
MMATIWDLIVIGAGPGGYPAAIRAAQLGLSVLCIEKSPHPGGTCLNAGCIPTKALLASTHLYTQIRDQADLHGIEITTMQVNLARMQGRKERVVSQLRSGILGLFKKYGVTLLHDEAIVSGPGQITLAASGETLQAKAILLATGGQPRRPASMPVDGQVVITSEQAIALTRVPEHLIVIGSGAVGLELASIWVRLGAQVSVIEAQPEILPGWDATVARTAKRSLRQQGITFLTDHRVETVVRSGSRAAVTCLNSKGETLMLDGDQVLVAVGRQAQLCVAGIQNLELQQDEQGRLWVDAHYATSLAGLYAVGDLIAGPQLAHRATAEGLRVADYLAGRPLSPMGPIPSVVYTDPELAMVGLTEQQAKVAGYAVKCGQFPFMASGRARAQEQTEGLIKLVMDQTTGQLLGAHVVGGAGAEHLQLAMAAMLTQDRGQLLERLVMPHPSFGEALHEAWLVATQKPIHI

SEQ ID NO: 25800 - protein, 219 aa, Burkholderia pseudomallei K96243
MQDIIEGFLKFRRDAFAPRTALFKRLAASQQPRALFISCSDSRLVPELVTQREPGELFVIRNAGNIVPSFGPELGGVSASVEYAVAVLEVADVVVCGHSDCGAMRAIASCACLDHLPAVRSWLRYADAAKRVNEAREHAGEQARVDSMVRENVVAQLANLNTHPSVRLALEQGRLTLHGWVYDIETGSIDALDGATGRFVALAEHPRVHATPPRVQRAA

SEQ ID NO: 25801 - protein, 666 aa, Mycoplasma gallisepticum R
MCFNMNIQQQTINTIRVLGIEMINNAKSGHPGMVMSAAPMMYALFHDHLNYDVSDPNYLNRDRFILSAGHGSALLYATMYVAGYKTLSTKDLKNFRKFSSKTPGHPESTMLAGVDFGTGPLGQGAATSVGFAIAEANLSARFDKIINHYTYCLIGDGDLQEGVCQEALAVAGRYKLNKLIWLYDSNDVQLDGRVENSTNFDVEMLLKSYRWNYILIKDGNDYQAISNAIAQAKKSDKPTFIEVKTKLGFASSVENTNKAHGSPFSDEEIKNIKAKFDYKNKPFTLSTEVKNHFESAISRGLKAAEEFNQRLAKAKPELKEKFISQIKEEKINFPKSLINEFNVDQYDSTRNLFGKVFKELTKINDNILVVNCDLSSSTKVVTHNNARFDHGHYQNQFVDVGVREFLAGCIVNGVVAHKGLKAVSSTFMAFSDYNKPALRLGAINKLSSLYVYSHDSFNVGEDGPTHQPIEQLSALRLIPDVLVYRPANFYELYIALKTAFDKKNHKPVVISTSRSEFDLTKVNPKTFDEGYYYLNKTKSPKLRLIATGSDAGTALKLAKIFKQEGIDIDVISVASFKKLKEKLADLEVLKEFKKYKNIVIESGVSNIWFQFVSLVIGVNDFGLSGNPNEVATYFSMDLESLVKSLASILHKNYTQQKIEELIKNAN

SEQ ID NO: 25802 - protein, 494 aa, Oryza sativa (indica cultivar-group)
MYSPGGGLRSLVGTPASSALHSFEPHPIVGDAWEALRRSLVFFRGQPLGTIAAFDHASEEVLNYDQVFVRDFVPSALAFLMNGEPEIVRHFLLKTLLLQGWEKKVDRFKLGEGAMPASFKVLHDSKKGVDTLHADFGESAIGRVAPVDSGFWWIILLRAYTKSTGDLTLAETPECQKGMRLILSLCLSEGFDTFPTLLCADGCCMIDRRMGVYGYPIEIQALFFMALRCALQLLKHDNEGKEFVERIATRLHALSYHMRSYYWLDFQQLNDIYRYKTEEYSHTAVNKFNVIPDSIPDWLFDFMPCQGGFFIGNVSPARMDFRWFALGNMIAILSSLATPEQSTAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDKAMKPVLKRSASWTN

SEQ ID NO: 25803 - protein, 257 aa, Brassica napus
  misc_feature (209)..(209): Xaa can be any naturally occurring amino acid
  unsure (1)..(257): unsure at all Xaa locations
AKTALDGRNIPSYLLPEEVGQCSLKITYSAHTDLTVKFQSHRSRDYTNPYLPVAPSAIDSTGQVIVGVDGKKMEPESNVLLASIENMQYAVTLDVLHTVFVAFGAVQKIAMFDKNGGVQALIQYPDVQTAVVAKGALEGHCIYEGGFCKLHITYSRHTDLSIKVNNDRSRDYTMPDAAVAMAPQPSHNPYPGNSQQYHAAGASHYQQQXHQQPQGGWGQQSGGQGHDPYMAAPSMHQGPGGHMPPHHYGGGPSGPMH

SEQ ID NO: 25804 - protein, 449 aa, Bacillus circulans
SIHMFPSDFKWGVATAAYQIEGAYNEDGRGMSIWDTFAHTPGKVKNGDNGNVACDSYHRVEEDVQLLKDLGVKVYRFSISWPRVLPQGTGEVNRAGLDYYHRLVDELLANGIEPFCTLYHWDLPQALQDQGGWGSRITIDAFAEYAELMFKELGGKIKQWITFNEPWCMAFLSNYLGVHAPGNKDLQLAIDVSHHLLVAHGRAVTLFRELGISGEIGIAPNTSWAVPYRRTKEDMEACLRVNGWSGDWYLDPIYFGEYPKFMLDWYENLGYKPPIVDGDMELIHQPIDFIGINYYTSSMNRYNPGEAGGMLSSEAISMGAPKTDIGWEIYAEGLYDLLRYTADKYGNPTLYITENGACYNDGLSLDGRIHDQRRIDYLAMHLIQASRAIEDGINLKGYMEWSLMDNFEWAEGYGMRFGLVHVDYDTLVRTPKDSFYWYKGVISRGWLDL

SEQ ID NO: 25805 - protein, 348 aa, Triticum aestivum
  misc_feature (138)..(138): Xaa can be any naturally occurring amino acid
  misc_feature (162)..(162): Xaa can be any naturally occurring amino acid
  misc_feature (194)..(194): Xaa can be any naturally occurring amino acid
  misc_feature (333)..(333): Xaa can be any naturally occurring amino acid
  unsure (1)..(348): unsure at all Xaa locations
MVRTTVQDLAAAVEEPPRQYVVHERDRDHLLAADEMPDPIPLIDLGRLMAADEAHKLREALQTWGLFLVTNHGIEESLMDAMMSASRDFFRQPPEEKNKCSNLIDDGEHLEMEGYGNDKVVTPQDQGLSWNDRLHLRXVEPQDERNFAKWPTHPESFRDVLXEYASRTKRIRDLIFAINSPRSWTWMKDYFVNXISNTARGFARFNYYPPCSRPELVLGMRPHSDVGLLTILFVDHDVGGLQVQRNGKWYNVPVKPYTLVINLADCMEIMCNGIFMSPVHRVVTNAKKERLSLGVFYVVDGETVLEPAPGLLDDKRPPRYGKFKAKDFGFSFXEHFRQGKRFIETLKI

SEQ ID NO: 25806 - protein, 172 aa, Synechocystis sp. PCC 6803
MDLKALIRDIPDFPKPGIMFRDITTLLNSPEGLRYTIDSLVEQCESQELVPDHVVGMESRGFLFGMPLAYQMNAGFIPVRKPGKLPAPVHRVEYDLEYGKDSLEIHQDAVAPHHRVLIVDDLIATGGTAKATAELLTKLGCEVLGFAFIIELAALNGRQCLPDLPIISLVEY

SEQ ID NO: 25807 - protein, 423 aa, Triticum aestivum
  misc_feature (116)..(116): Xaa can be any naturally occurring amino acid
  misc_feature (118)..(118): Xaa can be any naturally occurring amino acid
  misc_feature (120)..(120): Xaa can be any naturally occurring amino acid
  misc_feature (410)..(410): Xaa can be any naturally occurring amino acid
  unsure (1)..(423): unsure at all Xaa locations
RGGAMRWLKSFVGLRKVERQQHQQRRKEDGDAGRTKRDAVDQFHFQDQHSQDHASLVGPEEFPDGNVPSEDDCSTPSCSGPGFSTLSVPLPQTEEELKEIWAATIIQTAYRALLAXRXRXVRGHIVRKQAAITLRCMQALVRVQARVRARRVRVSLENQMDVRPRFREEQTGEAHVREVEDGWCDSIGSVEDIQAKLLKRQEAAAKRERAMAYALSHQWQAGSRQQAAITASELDRNSWSWNWLERWMAVRPWESRFLGMYAADGIAIDTGAQHAEGNATKAPYRKPVKKQLSAPHSNVLIQKARPSNSEGGGSSSNPSAGSASAKPKRKLPPKEGADEVSSRLSGLGARSSSNPKERPGQLQPRANKRFSLPGTGPEAGKRQVNKPAVNRSPKAVEDSPALEGKHRRAXSVDLLLRRRELQA

SEQ ID NO: 25808 - protein, 267 aa, Saccharomyces cerevisiae
MSTSREDSVYLAKLAEQAERYEEMVENMKTVASSGQELSVEERNLLSVAYKNVIGARRASWRIVSSIEQKEESKEKSEHQVELICSYRSKIETELTKISDDILSVLDSHLIPSATTGESKVFYYKMKGDYHRYLAEFSSGDAREKATNASLEAYKTASEIATTELPPTHPIRLGLALNFSVFYYEIQNSPDKACHLRKQAFDDAIAELDTLSEESYKDSTLIMQLLRDNLTLWTSDMSESGQAEDQQQQQQHQQQQPPAAAEGEAPK

SEQ ID NO: 25809 - protein, 188 aa, Schizosaccharomyces pombe 972h-
MSDDRINYLKNKLVQYPDFPKKGILFEDIMPIFQDPRAFGILIDLLLEAVETEFNNIDVIVGLEARGFLFGPTLALRANCAFVPVRKPNKLPGDLVVVSYNKEYSTDSFAIQKGTIKPGQRVLIVDDILATGGTALAADELVTRLGGELVGHLFLLELTFLQGRKRLMAPTYTLLTGQDEAPDGSEFA

SEQ ID NO: 25810 - protein, 722 aa, Arabidopsis thaliana
MASSVTGDAETAISADSSTKRRGGGWITFPFMIATLLGLTIAAWGWLLNLIVYLIEEFNVKSIAAAQIANIVSGCICMVPAVAAIASDSFFGTIPVISVSAFISLMGVALLTLTASLDTLRPRPCETASILCQSPSKTQLGVLYTAITLASIGTGGTRFTLATAGANQYEKTKDQGSFFNWFFFTTYLAGAISATAIVYTEDNISWTLGFGNVALCYQEFPESMRSTATSITSVVIGICFYTSTALIDLIQRTTAWLPDDINHGRVDNVYWILVIGGVLNLGYFLVCSWLYRYRNLKDDDHKQLGVLYTAITLGCVGAGGLRFTLATAGANQYEKTKDQGSFFNWFFFTWYLAASISATAIVYAEENISWSFGFGLCVAANLLGLIVFISGKKFYKHDKPLGSPFTSLLRVIFAAIRKRKAVVSTNEKDYHSESKKTPTKSFRFFNRAALKQDDEVNSDGTIHNQWRLCSVQQVEDFKAVIRIIPLVLAILFLSTPIAMQLGLTVLQGLVMDRRLGPHFKIPAGSLQVITLLSTCLFIIVNDRFLYPFYQKLTGKFPTPIQRVGIGHVFNILSMAVTAIVEAKRLKIVQKGHFLGSSSVADMSVLWLFPPLVIVGIGEAFHFPGNVALCYQEFPESMRSTATSITSVLIGICFYTSTALIDLIQKTTAWLPDDINHGRVDNVYWILVIGGVLNLGYFLVCSWFYKYRNLENADHEQDANVSH

SEQ ID NO: 25811 - protein, 979 aa, Arabidopsis thaliana
MALITLLEVSISLLFFSFLYGYFLISKKPHRSFLTNWPFLGMLPGLLVEIPRVYDFVTELLEASNLTYPFKGPCFGGLDMLITVDPANIHHIMSSNFANYPKGTEFKKIFDVLGDGIFNADSELWKDLRKSAQSMMTHQDFQRFTLRTIMSKLEKGLVPLLDYVAEKKQVVDLQDVFQRFTFDTSFVLATGVDPGCLSTEMPQIEFARALDEAEEAIFFRHVKPEIVWKMQRFIGFGDELKMKKAHSTFDRVCSKCIASKRDEITNGVINIDSSSKDLLMCYMNVDTICHTTKYKLLNPSDDKFLRDMILSFMLAGRDTTSSALTWFFWLLSKNPKAITKIRQEINTQLSPRTNDFDSFNAQELNKLVYVHGALCEALRLYPPVPFQHKSPTKSDVLPSGHRVDASSKIVFCLYSLGRMKSVWGEDASEFKPERWISESGRLIHVPSFKFLSFNAGPRTCLGKEVAMTQMKTVAVKIIQNYEIKVVEGHKIEPVPSIILHMKHGLKVTFNLPPSPARPLPFIGHLHLLKQPLHRTFLSFSQSLGDAPIFSLRLGNHLTVVVSSYSIAEECFTKNDIVLANRPKFILGKHIEYNFTTMTSAPYGDHWRNLRRIGTLEIFSSHKLNGFLSVRKDEIRHLLLRLSKNSQHGFAKVEMRQLFYDLTINNILRMVAGKRFYGEGTEQDEVARRVTQLIDEIVYRAGVGNAADYIPILRWITDFEKGVKELASRVDEFLQSLVDERRVHKQKGNTMMDHLLSLQETQPDYYTDVTLKGIIIVMILAGTETLAGTLEWAMLNLLNHPEVLEKARTEIDTEVGFDRLMDEADTKNLPYLQWIVLETLRLYPVAPTNIPHMTSDDCILAGYDVPRGSMLLVNVWSMHRDPSIWEAPEMFKPERFKNEKLNQKLLSFGFGRRACPGVGLAHRLMSLALGSMVQCFEWQRIGEEYVDTREEPMAMMRPATPLLAMCKARPIVHKFLDAFA

SEQ ID NO: 25812 - protein, 43 aa, Arabidopsis thaliana
  misc_feature (26)..(26): Xaa can be any naturally occurring amino acid
  unsure (1)..(43): unsure at all Xaa locations
SRYPDYSNALRKLPYMLHPWEHVVGXGLGAVFANQLVKWDVKA

SEQ ID NO: 25813 - protein, 840 aa, Oryza sativa (japonica cultivar-group)
MASRRQWGAGAGAVDVPAQERKGEAAKIARRPKTTTVVAQQPPRIRRALADVSNLVNGRAALPVVNRQKAAAAAADKCRKPIKQRNENNKAAKPEVIVISSDSEKHKKNPAQRAASRRAPIQTLTSILTKCSRASDGVISPKKELIYDIDASDSHNELAVVDYVEDIYRFYRNTENTYRPLCTYMVSQTEINERMRAILTDWLIEVHYRLMLMPETLYLTVYIIDQYLSLENVPRKELQLVGVSAMLIACKYEETWAPLVKDFLVISDNSFSRQQVLSTEKSILNKLQWNLTVPTMYMFILRYLKAALGDEELEHMTFFYAELALVQYSMLFFAPSVIAAAAVYAARCTLGLSPLWSDLLEYHTGLAEPQLLECARRLVSLHAAAPESRQKVVYKKYASPKLGAVSLHSPAKKLLPPPSPVCVLQFLVCCCCYGHIQFVFFSSWFVVVMACTMSSMACHSLPESGSNLSAADELFQNQRSEQGIYWTLWDSRLSDDLNTTTVYSDNHGSNGGGTQSFDTSEHCSTVPSDSDEQPGYPSQFEPLHMEQTNDMFLSQFSDEEVRRMDAPFQALDMFPDSMHRLMSYEHILNGALVSDSKNQEVNMDQDDMDTCGFPLYFSHGLQDDGGLPSFAKGMVAADTSSMDKAGASATERGDPGSSPPGFEEAVLEELEEVMVQMARTTRICLRDAFYRLAEGSRSPRSAAAAADGATVAEATRYHAQAAVDLSRSLLEILQLVILMLSVSSSPLAAANPLQCVDDAAAPSPRRDRQDGGEPHLQAAAVLAGSRGGDDAAHACLRRPSSPSPDHRRTGGDSLGFSFQCDLARRIASSLACLTKDTLCM

SEQ ID NO: 25814 - protein, 233 aa, Crocosphaera watsonii WH 8501
MSDPVVMMKQEVGKAAAARVKSDSIVGLGTGSTTAYAIQYIGERLQSGDLKNIIGVTTSFQAEVLARKYNIPLSTLDVVDRIDIAIDGADEVDPQKNLIKGGGAAHTQEKIVDSLAEQFIVVVDGGKLVDKLGSTFLLPVEVIPKAVVPVMRKLEQLGGKPDLRMGVKKAGPVVTDQGNLVVDVKFDSIDDPATLEKTINNIPGVLENGLFVGVTDVVLVGEIIDNKPVVREI

SEQ ID NO: 25815 - protein, 77 aa, Triticum aestivum
  misc_feature (8)..(9): Xaa can be any naturally occurring amino acid
  misc_feature (12)..(14): Xaa can be any naturally occurring amino acid
  misc_feature (16)..(16): Xaa can be any naturally occurring amino acid
  misc_feature (22)..(22): Xaa can be any naturally occurring amino acid
  misc_feature (24)..(24): Xaa can be any naturally occurring amino acid
  misc_feature (26)..(26): Xaa can be any naturally occurring amino acid
  misc_feature (30)..(30): Xaa can be any naturally occurring amino acid
  unsure (1)..(77): unsure at all Xaa locations
PAWHLEKXXLEXXXPXVPHGEXSXPXTQHXANHFISQARKSPNRPPADKVLDNLIYNYSPTFTGKKSKSFEEVYIFS

SEQ ID NO: 25816 - protein, 336 aa, Burkholderia pseudomallei K96243
MTIRVAINGYGRIGRNTLRAFYENGKKHDLEIVAINDLGDAKTNAHLTQYDTAHGKFPGEVSVDGDYLVVNGDRIRVLANRNPAELPWGELGVDVVMECTGFFTSKEKASAHLKGGAKKVIISAPGGKDVDATIVYGVNHDVLKAEHTVISNASCTTNCLAPLVKPLNDKIGLETGLMTTIHAYTNDQVLTDVYHEDLRRARSATHSQIPTKTGAAAAVGLVLPELNGKLDGYAIRVPTINVSIVDLSFIAKRDTTAAEVNAIMKEASEGALKGILGYNEAPLVSIDFNHNPASSTFDATLTKVSGRLVKVSSWYDNEWGFSNRMLDTAIALANAK

SEQ ID NO: 25817 - protein, 675 aa, Burkholderia pseudomallei K96243
MTTSSPASTTLMANAIRALAMDAVQQANSGHPGMPMGMAEIGVALWSRHLKHNPTNPHWADRDRFVLSNGHGSMLLYSLLHLTGYDLPIEELKNFRQLHSKTPGHPEYGITPGVETTTGPLGQGLANAVGMALGEALLAAEFNRDDAKIVDHHTYVFVGDGCLMEGISHEACSLAGTLKLNKLIAFYDDNGISIDGDVVNWFHDDTPKRFEAYGWNVIPNVNGHDVDAVDAAIAKAKSADKPTLICCKTVIGKGAATKAGGHDVHGAALGAEEIAKTRDALGWKWAPFVIPQEVYAAWDAKEAGKRREGDWNAAFAQYRAKYPAEAAEFERRMAGKLPADWAEKAAAIVAGANERGETVATRKASQQTIEGLAAVLPELLGGSADLTGSNLTNWKASKAVRANAHGAGIQWGNHINYGVREFGMSAAINGLVLHGGYKPFGGTFLTFSDYSRNALRVAALMKVPSIFVFTHDSIGLGEDGPTHQSVEHVASLRLIPNLDVWRPADTVETAVAWTHAVSHQHPSCLVFSRQNLAFNARTDAQLANIEKGGYVLRDWDEEIVARKIILIATGSEVELAMKAVEPLAQQGIAARVVSMPSTDVFDRQDAEYRERVLPHGVRRVAIEAGVTDFWRKYVGLEGGVVGIDTFGESAPAGVLFKHFGFTIEHVVETAKAVLA

SEQ ID NO: 25818 - protein, 691 aa, Oryza sativa (indica cultivar-group)
MDAAAAGGGGAAKRKRSFSVGRRLPHPAQEMGKQVGAGKGIDWRALVRRTSTGITSAREYQMLWRHLAYGHEFVESVEPASLPLDDGSDLECEIEIVPAPGNEALAEATSFAKTIITGSSREQTSGQRVNSEAAALNTPNEKIVRVPSDKQLVPGHRLTNGTGPVSSSKQPSHTGSSPDPLDPNGHPKKKKKPKPWSREEDMELGAGVQKHGEGNWMEILHKYKFDSSRTHLQLQQRWALICKRQGSTKPATPKIPNVMSEELKAAQKAFSLAIGTTRSSTLRPGGVPHHNPMVTTTTPEVKSVTAPSPLPVPVHVVPVPVPVQPVQVQLPPPQLHQAPAQSAPPPPKVSNASNKSRNNSKKQVAQSIPVNGPLSIQEAALAAGGRIAEPSVATNFLKAAQSTKAVHIRSRGTGSSKSSTGSKTPTVAGEPGTQLGSDQHLELQSTGGPSQVLTAHATEQVHNVSEVAGVNPLGQSTGVHLSETKKALNTTPVSGSSDKMEIDDNSNYFAVTMEDLFPEDVKQEDVQDPKIEEAIDPKDADMLEFDRFVAQGCLNKDNVDKSKAAKIAPEAQSVIGSQKKQLKTLPTVGKSNPVFAGPPATAKKTKAPVPQGGMSSGIVGVLNRSLGGKAPAPATTGTQSTVQKQQSMSSKGNLLVPKNVAPGTVTPANNRANTAVNGASKVNPPASQKPA

SEQ ID NO: 25819 - protein, 351 aa, Synechococcus sp. CC9605
MTQALLGRSAAELQDWAVAQGQKPFRGRQLHDWIYAKGARSLADITVFPKTWRAALVEAGVDVGRLKEVHHSVATDATTKLLLSTEDGETIETVGIPTDQRLTVCVSSQVGCPMACRFCATGKGGLQRSLQTHEIVDQVLSVREAMDRRPSHIVFMGMGEPLLNSSAVLEAIRCLNDDLGIGQRRITVSTVGVPKTLPQLAELAMQRLGRAQFTLAVSLHAPNQRLREELIPTAHAYPYDALLEDCRHYLDVTGRRVSFEYILLGGLNDQPEHAAELADRVGGFQSHVNLIAYNPIEEEEFKRPTPQRIEAFRRVLERRGVAVSLRASRGLDQNAACGQLRRQQMAPNTPS

SEQ ID NO: 25820 - protein, 434 aa, Streptomyces coelicolor A3(2) [sequence omitted]

SEQ ID NO: 25821 - protein, 604 aa, Oryza sativa (japonica cultivar-group)
MASISGAAAPPSSSAACRLRLRRQLLLRPSHLRLRAPHSIADLSRSSSSSSEQQPSSTPAAPLASRPGQNGSTRGAVEKDPIKLWERYVEWLYQHKELGLFVDVSRMGFTEEFLRRMEPRMQRAFAAMRELEKGAIANPDEGRMVGHYWLRDPGLAPNSFLRTKIETTLDRILAFSQDVVSGKIKPPSSPAGRFTQILSIGIGGSALGPQFVSEALAPDNPPLKIRFIDNTDPAGIDHQIAQLGPELASTLVIVISKSGGTPETRNGLLEVQKAFRDAGLDFSKQGVAVTQENSLLDNTARIEGWLARFPMFDWVGGRTSEMSAVGLLPAALQGIDIKEMLVGAALMDEETRNTVVKENPAALLALCWYWASEGIGNKDMVVLPYKDSLLLLSRYLQQLVMESLGKEFDLDGNRVNQGLTVYGNKGSTDQHAYIQQLREGVHNFFVTFIEVLRDRPPGHDWELEPGVTCGDYLFGMLQGTRSALYSNDRESISVTVQEVTPRAVGALVALYERAVGIYASLVNINAYHQPGVEAGKKAAGEVLALQKRVLTVLNEARHIEMIYKIIQHMAANDRALIAEGSCGSPRSIKVYLGECNVDEDMLAA

SEQ ID NO: 25822 - protein, 409 aa, Kluyveromyces lactis NRRL Y-1140
MSYLRNTTSSSYAETEPIEIPVNRTETEPYSSSLQGSQVNSEAITTSTRLIDSSSSSIDKYGSGGLTPQDMNHGVTSSYFDSNYNNNIASNNHTDTNFNKHAGISSSFIDNTSGVSSSLDSGSNLRHSNLSGNFLPNDTQSNSNVLIPVKAVSELRIDDEQTGSSSTSQPDHHSNDETQHSLNNNNHHMDIATFPTYKLLDMLTGLLTKIIKSNDSLGSTPNFETSQGKNIPLMREILSFRGKQVPGITLKQYFQRIQKYCPTTNDVLLSLLVHFDRIAKKCNAIAQEYMVSVVSTPDKTTASLAHQSSPQLFVMDSHNIHRLIIAAITVSTKFISDFFYSNSRYARVGGISLQELNHLELQFLILCDFRLIISVEELQRYADLLYKFWDKEKHLYQSVSQPTNSSLIA

SEQ ID NO: 25823 - protein, 435 aa, Bradyrhizobium sp. BTAi1
MSSTKKSVRTLPSPVVGTSKPRLLDTLGPGLITGASDDDPSGIATYSQAGAQFGYTLSWTMLLTYPLMAAVQMISGRIGRTTGRGLAGNLRQHYPNWLLQTFVALLAAANIINIGADLGAMADSTSLVLGGSKTFYVALFGVVCIGLQVLLQYTRYVSYLKWLTLALLAYVATLFMVDVHWGEALRQFVWPSITWKTEYIQTIVAVFGTTISPYLLFWQASQEAEDIRAVPERQVLKRAPEQGPDAIKRIELDTLIGMGVSNLIALAIILTTAATLNVSGVTDIETSAQAAEALRPIADNYAATMFALGVLGTGLLAIPVLAGSAAYAIGEARKWPIGLTRQPKEAKAFYATIVMATLVGILLNFAPINPIKALYWCAVINGIVAVPVMGLMMLMVANAKIMGEFTIGGWLTGLGWIATAVMAAAAVAMGVTYFM

SEQ ID NO: 25824 - protein, 333 aa, Herbaspirillum seropedicae
MKRISLTQHLIEQQRLHNKIPSELRLLIEVVGRACKSISHAVGKGALGEVLGSAGSENVQGEVQKKLDVISNEILLEANEWGGHLAAMASEEMETIHRIPNRYPKGEYLLMFDPLDGSSNIDVNVSIGTIFSVLKAPEGMTEPTEQDFMQPGTRQVAAGYAVYGPQTVLVLTTGDGVHCFTLDREMGAWVLTQKDIKIPEDTKEFAINASNQRHWFPPVKRYVDEMLAGSTGVRGKDFNMRWIASMVADVHRILNRGGIFMYPADAREPNKPGKLRLMYEANPMAFIVEQAGGAATDGTRRILDIQPEKLHQRVAVFLGSKNEVDLVTSYHQQ

SEQ ID NO: 25825 - protein, 140 aa, Kluyveromyces lactis NRRL Y-1140
MFRQALKSTVRRMNTLTPVKTQLAPPPAASYSQAIKVNNLIFVSGQIPYTAENKPVEGSIADKAEQVIQNVKNILVEANSDLDKIVKVNIFLADINSFAEFNSVYAKYFNVHKPARSCVAAKALPLNVDLEMEVIAVEKD

SEQ ID NO: 25826 - protein, 589 aa, Schizosaccharomyces pombe 972h-
MPTISCDKEELYKALGREYTTQEFDELCFQFGIELDEDTTNDPERSPSERPSLKIDIPANRYDMLCLEGIAQALNVFNRRMATPQYKLLPSTTSLTISPETSEIRPYAAAAILRGVKLDPIRYQSFIALQDKLHANLCRNRTLVAIGTHDFSVMEGPFTYEALKPEEINFVPLNQTQEINGSNLLEFYKDSKHLSRYLHIIANSPRYPVILDAKRRVCSLPPIINSEFSKISVDTRDIFIDVTATDKTKLEIVVNMMTTMFSCYCEEPFTIEPVNIISEHNGCTRVTPNLNPTCFKADIDYLNEACGLSLPEDEICHLLTRMMLTAKPNPNDSKTLLVYVPPLRADILHQCDIMEDLGIAYGYDNLKHTYPAHSVTFGKPFEVNRLADIIRNEVAYAGWSEVMPFILCSHDENYAWLRKTDDSKAVQLANPKTLEFQVVRSSLLPGILKTVRENKNHALPIKIFEVSDVAFCDYSRERMTRNERHLCAIFAGLNSGFEQIHGLLDRVMLMLNTKRIMNPKDSDAVGYWIEAEDDSTFFPGRCAAVYYRKDFGTAGIRVGVFGVLHPLVLEKFELTSAASAVEIDLTLWV

SEQ ID NO: 25827 - protein, 154 aa, Zea mays
  misc_feature (87)..(87): Xaa can be any naturally occurring amino acid
  misc_feature (107)..(107): Xaa can be any naturally occurring amino acid
  misc_feature (129)..(129): Xaa can be any naturally occurring amino acid
  unsure (1)..(154): unsure at all Xaa locations
AGARPRDSVVELFILDPAHLDMDVTPDKAEEALAENHQLRALILSLRINEDLLTIDVAYSSYEPVDVRTVSSTIPYEYLHKIEWYLXSLLERCPHLEMILLWSKELXKDYGHYIQQSYSTVLPSLRSLXKSITRLLEDLEHTCSSNESCPGGRS

SEQ ID NO: 25828 - protein, 407 aa, Haemophilus somnus 2336
MSNFDIITPDLPESVADATVVTWHKNVGDAVKCDEVLVEIETDKIVLEIPALSDGVLETILQPEGSTVVSKQLLGKVSASAGIGEVTKSTVQNVEKTPADRHSANLNTDASSDVLSPAVRRLLAEHELNADEIKGTGVGGRITREDIALVVKQKAQQTETAQASQSIVTGLKIDHRNEKRVPMTRLRKRIAERLLEAKNTTAMLTTFNEVDMQPIMNLRKRYAEKFEKQHGARLGFMSFYIKAVVEALKRYPEINASIDGDDIVYHNYFDISIAVSTPRGLVTPVVRNCDKLSMADIEKEIKLLAEKGRDGKLTVEDLTGGNFTITNGGVFGSLMSTPIINPPQSAILGMHAIKDRPVAVNGEVVIRPMMYLALSYDHRLIDGRESVGFLVTVKDLLEDPTRLLLEI

SEQ ID NO: 25829 - protein, 164 aa, Brassica napus
ITIGILVASVLNFFFSKIPGGWGWRLSLGGAVVPALIITVGSLILPDTPNSMIERGRFKQAETKLRKIRGVDNVEDEMDDLIAASEASKLVEHPWRNLLQRKYRPHLTMAILIPSFQQLTGINVIMFYAPVLFQTIGFGNDAALMSAVVTGLVNVGATVVSIYG

SEQ ID NO: 25830 - protein, 279 aa, Coccidioides immitis RS
MTSERENKTFLARLCEQAERYDEMVTYMKEVASLGGELTVDERNLLSVAYKNVVGTRRASWRIISSIEQKEESKGSDKHVATIREYREKIEEELERVCQDVLEVLDNNLIPKAETGESKVFYYKMKGDYYRYLAEFASGNKRKVAATNAHEAYKNATDVAQSELTPTHPIRLGLALNLSVFYYEIVNSPDRACHLAKQAFDDAIAELDSLSEESYRDSTLIMQLLRDNLTLWTSSDGGEAEPTTTDAASEEKPAETSATTDEPAAPASTEDKKETAAES

SEQ ID NO: 25831 - protein, 63 aa, Brassica rapa
MRGILVDWLVEVAEEYTLVPDTLYLTVYLIDWFLNGNYVERNRLQLLGVTCMLIASKYEEIYP

SEQ ID NO: 25832 - protein, 239 aa, Synechococcus sp. CC9605
MADLQTQMKQAVADAAVEQIKDGMVLGLGSGSTAALMIQGLGAKLASGELKDIVGVTTSFQGEVLAAELNIPLLSLNAVSRIDLAIDGADEVDPGFQLIKGGGACHVQEKLVAARADRFVVVVDSTKLVDRLNLGFLLPVEVLPGAWRQVKQQLEALGGSAELRMAQRKAGPVVTDQGNLVLDAKLDGGISDPVALEQTINNIPGVLENGLFVNITDEVLVGEITDGVAGVRSLQKRLS

SEQ ID NO: 25833 - protein, 123 aa, Yarrowia lipolytica CLIB122
LYARLSARELRPLTTHSHYHTNLGFLYVSGQVPLKPDGSKHEGSLQEQTVQVLENLKNIIVEAGSSWDKIVKVTIYVTDMGKFGEINEVYAKYFDQHRAARTTIGVAALPLGFQVEMDAVVLE

SEQ ID NO: 25834 - protein, 241 aa, Oryza sativa (japonica cultivar-group)
MAADALVVAGQAKARHPLSQIAESGTHRLLLKQWLKEEDLLARRVALREARLDGARKEIAFLYCAFFAFHAASILLLFLSASASTSAACRRSWIPCLVSLLSSLAMLWALRYKADTEAVLERLLAREREDALLLGKCVAELKRKGLEFDLLKEVDALRRAKSLRVEAKGGAGGERPKRWAARDLAVFLLFGAACGVLVLTRGSDVQNYLPWDKDFLLEQKIVMHYYQSVSGPGLSTSANFL

SEQ ID NO: 25835 - protein, 463 aa, Candida glabrata CBS 138
MASQPEIAKNLFASTTTLVDYPAKEEKKSHEDNVDTYLEQLFYKLKNDPEISKLPHNEAHLEIYNALKKRVDDINNETCEPGEENSFFVCDLGEIERLYANWWKELPRVQPFYAVKCNPDLKIIRKLADLGANFDCASKLEIDKVLSMDVNPERIIYANPCKAASFIRYAATNKVMKSTFDNVEELHKIKKFHPESQLFLRIATDDSTAQCRLSTKYGCEMERVDSLLECIKTLGLNLVGVSFHVGSGASDFSSLYKAVRDARIVFDKAVNDYGLPELKTLDVGGGFQLESFKESSAVLRLALDEYFPESSKVDIIAEPGRYLVASAFTLSANVIAKRKLNEAESMIYVNDGVYGNMNCILFDHQEPTPRTLWHDNNYHYDDFDSTSPNPITTCPYKVSMWGPTCDGLDCITKEYYMKHDLVVGDWLYFPRLGAYTSSAATPFNGFDQTADIIYINSENHDNI

SEQ ID NO: 25836 - protein, 399 aa, Pseudomonas syringae pv. phaseolicola 1448A
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPKRLVHAKAQGFEIADLSLDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADVVGVEVISLDDAPRGYGEFDSGVPKKFVIDPHRLFGAV

SEQ ID NO: 25837 - protein, 307 aa, Triticum aestivum
  misc_feature (232)..(232): Xaa can be any naturally occurring amino acid
  unsure (1)..(307): unsure at all Xaa locations
HYRTSLYKKAGWYRSGIPGISSTHASACTSSRSLHSQWKKGKLLGSGTFGQVYLGLNSEGDQMCAIREVKVIADDSELKECLRKLNQEMCILNQLSHPNIVQYYGSELSSETFSLYLEFVNGGSIHKLLREYGPFEEAVLRNYTAQILSGLAYLHRRNIVHRDIKGSNIFVNRNGDIRLADFSMTNHISEATSIQSFKGSPYWMAPEVIMNTNGDSLSVDIWSLGCTIIEMXATTRPPWNQYEGVAAIFKIANSKDIPDMPDHLSSEAKSFLKLCLQRDPAARPTAAQLIVHPWVKDQASVTKSPVK

SEQ ID NO: 25838 - protein, 402 aa, Prochlorococcus marinus str. AS9601
MSKLSLSSLDKTHLEGKKVLVRVDFNVPLNEDGQITDDTRIRAAIPTIEYLINHSAKVILAAHFGRPKGQVNEKMRLTPVAARLSELLGQNVALTNSCIGDEAVAQSNSLSNGDVLLLENVRFFGEEEKNDLEFAEKLASHADMYVNDAFGAAHRAHASTQGVTNYLSPSVAGFLLEKELKYLQGAVDSPNRPLAAIVGGSKVSSKIGVLDSLLDKCDKIMIGGGMIFTFYKARGLDVGKSLVEEDKLELAKDLEAKAKAKGVELLLPTDVVLADEFSPDANSKISQIDAISGNWMGLDIGPDSIKVFQNALAECKTIIWNGPMGVFEFDKFADGTNAIATTLADLSAFSEVCTIIGGGDSVAAVEKAGLAEKMSHISTGGGASLELLEGKTLPGVAALNDA

SEQ ID NO: 25839 - protein, 212 aa, Triticum aestivum
MPDLPCDGDGVCMVCRAAAPPEVELLRCATCATPWHSPCLSKPPALADAAAWACPDCSGEDASPSAAPAPAPTAAPGGAGGGSGLLAAIREIEADASLTEQEKAKRRQELLGGKTAVAGDDDEDEEEQDEDNALEIVGKNFSCVFCMKLPERPVTTPCGPHFCLKCFEKWVNSGKRTCGKCRGPIPSKNASPPRDYWVGCRFIRRARTGKKG

SEQ ID NO: 25840 - protein, 263 aa, Oryza sativa (japonica cultivar-group)
MDVEATKDVGHEQAAVPGRGRAARWLLVALNCGMLVVGTTGGPLISRLYFSKGGHRQWLSAWLQTAGWPLLLVPVAASYLSRRARDRRAPLFLTPTRVLLAGVGLGFLNGADDFIYAYGLAYLPVSTSAILISTQLAFTVFFACLIVRQRFTAATLNAVALLTIGAVVLGLHASKDRPAGVTSGKYWMGFFLTLGAAALYGLILPLVELAYKHAAGGGRAVTYALVMEMQLVMGFFATAFCTVGMVVNKDFQVFKFHPLHISP

SEQ ID NO: 25841 - protein, 439 aa, Coccidioides immitis RS
MAITKIHARSVYDSRGNPTVEVDVVTETGLHRAIVPSGASTGQHEACELRDGDKTHWLGKGVLKAVKNVNEVIGPAVIKENIDVKDQSKVDEFLNKLDGTANKSNLGANAILGVSLAIAKAGAAEKGVPLYAHVSDLAGTKKPYVLPVPFQNVLNGGSHAGGRLAFQEFMIVPSSAAPSFSEALRQGSEVYHKLKALAKSKYGQSAGNVGDEGGVAPDIQTPEEALDLIAEAIEQAGYTGKVKIALDVASSEFYKPEEKKYDLDFKNPNSDKSKWVTYEELSDLYKKLASKYDIVSIEDPFAEDDWEAWSYFFKTSNIQIVADDLTVTNPIRIKKAIDLKACNALLLKVNQIGTLTESIQAAKDSYADGWGVMVSHRSGETEDVTIADIVVGLRSGQIKTGAPARSERLAKLNQILRIEEELGSSAVYAGENFRTAVNL

SEQ ID NO: 25842 - protein, 624 aa, Oryza sativa (japonica cultivar-group)
MADIAEVLWRDYLNHNPTNPHWADRDRFVLSNGHGSMLIYSLLHLTGYDLPMSELENFRQLHSKTPGHPEYGYTPGVETTTGPLGQGIANAVGFAIAERTLAAQFNRPGHDIVDHHTYAFMGDGCMMEGISHEVCSLAGTMKLGKLTAFYDDNGISIDGHVEGWFTDDTAKRFEAYGWHVVRGVDGHDSDAIKAAIEEARRVTDKPSLLMCKTVIGFGSPNKAGTHDSHGAPLGEAEVAATREQLGWKYPAFEIPQDIYAQWDAKEAGQAKEAAWNDRFAAYAKAFPELAAEFKRRMNGELPANWQAEAKKVVEQLQANPANIASRKASQNALEAFGKLLPEFLGGSADLAPSNLTLWSGSTSLGDDLAGNYIHYGVREFGMTAITNGIALHGGMSKSAIAAPTCWVEASPCISGVRGPLAMLVAALVRHPASGRNPLALAAFPLGRSFAAATWVRFSARLLELLLLLPDSSHDAADADYLIALPNPHVIAELSAYASVADAVRQAPPPSSAPQHNGLIWELIRLAEEDRVAAERNIAARVHEMGERLATLTLADAVELVCVLRQVEESTSSPADWKWAGLDEAVVGEARRLRERAQEVVLRRTEQERRLVRRGTAREHVKALH

SEQ ID NO: 25843 - protein, 133 aa, Glycine max
  misc_feature (105)..(105): Xaa can be any naturally occurring amino acid
  unsure (1)..(133): unsure at all Xaa locations
MKNGVMECSVCHSKLVSPSSKTISRAYDRHKSRISSKQRALNVFLVVGDCVLVGFQPILVYMSKVDGKFNFSPISVNFLTEITKVFFAIVMLLLQARHQKVGGEXPLLSISTFMQAARNNVLLAVPALLYAIN

SEQ ID NO: 25844 - protein, 440 aa, Mycobacterium sp. MCS
MTSVVIVGSGFTGFECARHLARKLRKSEGTGSEPVEITIISPVDYMLYTPLLPDVAGGLVDARFVTIPLANSLRGVRAVRGRVDDVDFDQRTVTFTDPEQRVRSMPWDRLVLTPGSVTRLFDVPGLAEHARGLKSTAEALYLRDHVLEQLELADIDEDPTLAAARRTIVVVGASYSGTELAVQLRALADAAAQQMGFDPDSVRFVLLDLAEQVMPEVGEKLGAAAQRVLRGRGVDVRLGVTLKEVHDDHVLLTDDTRIDTRTVAWVTGVTGAPLIEKLGLPTEKGRLKVDADLQVPGHPHVFAAGDAAAVPDLTQSGAITPPTAQHATRQGKVLARNVAASLGHGTKKLYKHRNMGLVVDLGPRYAVANPLGVRLSGLPAKAVTRAYHLYAIPRFVNRWAVSLAYLTDVFFARSVVSIGLSSADDARFSASEGIPMPKGD

SEQ ID NO: 25845 - protein, 505 aa, Schizosaccharomyces pombe 972h-
MAILKSALVGFICFLHFFIVNASDNKSLLTEDIMASQVCNGMFAKKGKTSEITLKIDSYTSDFGGAIRLLIFNWKDVNAIGMEDDDGEKHYICNYEDIEAGVCKDDDYGLYLINQTAPHDSIYSAAVDAESMVSPLKYPVEQSGLYCVFTAPLEGSSEAYKITVTWENYFGNLDATDYPHLFLNPILLAINCLIGIWWSFIMFRYRHDLLQVQKYISGVVALSIVCTMVSTGYFYFANSKGYTTGSKVFAFFLSLAQSARQSYFGFLLLIVSLGYSIVVPSLGSLLRKCQILAGLQFVSSCFFLSSLFISPSNKESLVILFAAPVFLITLFAMFLWIVLALNNTIRDLRIRKQTVKAQMYTRLWIVICFGIVAYASIVAANAILIGIYGQMNYYLKYWKLLWFLNYGYTDILVLILMLTILYLWRPTENNRRFAMSEQVAQDVDEFEMTSSLSNDSLHLHHERPTSPANPHIIHGSADEHQALFAVDDESDDDASTLATSKQKPA

SEQ ID NO: 25846 - protein, 184 aa, Hordeum vulgare
KYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNSYYDMNARI

SEQ ID NO: 25847 - protein, 261 aa, Mycobacterium sp. MCS
MYLPVRDGVARCQLYRPRAAPADEQLPVIVYYHGGGFTVGVSEDCDFLARKLAFTNSALVVSANYRSAPEFMFPTPLDDAFDVYRWVTVNAELVGGDATRVAVAGDSAGSNFAAALALRARDEHARVPDAVVMLGAMPDFHFERWDSFRAQAPRGIVYDMAFAGFIRGAYVGPTPWDHPWVSPIEGDLTGYPLTVITAGTHDPIVDSARAFGERIRAAGGQTVEYFPAGMPHGYYFFPGVHAEEDVAYEIVAEVLAKPFRR

SEQ ID NO: 25848 - protein, 367 aa, Oryza sativa (indica cultivar-group)
MRAGLALVVVVVAVVVGDVGAALPRFAEAPEYRNGEGCPAAVAGAGVCDPGLVHIAMTLDAHYLRGSMAAIYSLLKHASCPESIFFHFLAAADGGEGGGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 25849 - protein, 402 aa, Rhodobacter sphaeroides 2.4.1
MTSSRLSSRLQAVQPSPTIAMTRLAAQLRREGKDIIGLSQGEPDFDTPVHIRQAAAAAIEAGQTRYTDVDGTPELKAAIVEKFRRENGLSYETNQISVGTGGKQVLYNALLATLDEGDEVIVPAPYWVSYPDMVRLAGGVPVTVSCPEEDDFLLTAPALRAAITPRTKWVILNSPSNPTGMGYSAAHLRALADVLLEFPHVLVMTDDMYEHLRYDGWEFATIAQVEPKLMDRVLTCNGVSKAFSMTGWRIGYAGGPADIIKAMATLQSQSTSNPSSVSQAAALAALTGPMEFLAERNEIFRQRRDLCLSALNQIEGLSCVRPNGAFYLFPSCAGMIGRTRPDGRKIETDTDFVMYLVEEAGVAAVPGSAFGLAPYFRISFATDTERLRTACERIRAASARLT

SEQ ID NO: 25850 - protein, 610 aa, Wolinella succinogenes DSM 1740
MCGIAGTLNSSCFSSKKLLAALAHRGPSGHGEFSHQGVNLFHARLSIQDLSPAGAQPMHRHHLSIVFNGEIYNHLELRAKVADYPFSTRSDTETILALFERFGERSLEWMDGMFALAILDQRTHKLFLARDRMGKKPLFYYQEGEEFLFASELNALLTLKPLQIDHAKLSAFLRCGFFPHDGAPYQGVQSLPQGSYAFIDLHHPRPLSPQRYFDLLSLYQAPKIEGFEASKEAVELALKESVKNRLESSDLEVGSFLSGGIDSSLITALASFFTPKLKTFTVAFEGAYDESSLAELVAKRYKTDHTTLHLNPSKLKEEVKGILACYGRPFMDSSAIPSYYVSQEAKKHLTVILNGDGADELFGGYRRYVPMSHGWLKLARPLSLLLPLLPLPKEKKSLYNYLHRLLAMSRKRGLDFYLSATIDSFEDAYAFSPNPHTQTLDQEITQILEDSSLSSLSKMLYLDSQNLLLSDLLPKMDIATMAHSLEGRSPFLGKSLLEVAPRIKDEYKIFGKSTKFILRELAKKYLPHALLEQPKRGFEVPLRAWVEGELKELIFDSLSKNCLSRELIESRFVDALLDKPQDFAPEKRAKMLWSLFSLEVWHEHYQKACE

SEQ ID NO: 25851 - protein, 527 aa, Streptococcus thermophilus LMG 18311
MQKERVIMTNISTLNDVQKIIVLDYGSQYNQLIARRIREFGVFSELKSHKITADEVRAINPIGIILSGGPNSVYAEDAFGIDEEIFELGIPILGICYGMQLLTHKLGGKVVPAGEAGNREYGQSTLRLRAQSELFAGTPEEQVVLMSHGDAVTEIPEGFHLVADSVDCPFAAMEDTKKNFYGIQFHPEVRHTVYGNDILKNFAFSICGAKGDWSMANFVDMQIAQIRETVGDRKVLLGLSGGVDSSVVGVLLQKAIGDQLTCIFVDHGLLRKGEGDQVMEMLGGKFGLNIIRVDASKRFLDLLAGVDDPEKKRKIIGNEFVHVFDDEASKLKGVDFLAQGTLYTDIIESGTETAQTIKSHHNVGGLPEDMQFELIEPLNTLFKDEVRALGTELGMPDEVVWRQPFPGPGLAIRIMGEITEEKLETVRESDAILREEIAKAGLDRDVWQYFTVNTGVRSVGVMGDGRTYDYTIAIRAITSIDGMTADFAKLPWEVLQKISVRIVNEVDHVNRIVYDITSKPPATVEWE

SEQ ID NO: 25852 - protein, 449 aa, marine gamma proteobacterium HTCC2143
MIGFLKPAAHRQPIADEDVDGQYARLRLQVFLGIFVGYAGYYLVRKNFTLAMPFLIEEGYSKTELGFALSGVAIAYGLSKFVMGSVSDRSDARNFMSLGLLGSALVMIFMGVTIGQLPVASSSVGIMFALLMLNGWFQGMGWPPSGRVMVHWFCPAERGTKMAIWNVAHNIGGGLVGVIAIVGMALFGDWHSVFYFHGLIAIMIAMFIWITVRDTPQSQGLPTIEHYKNSYPTAFEYQQSHETEFSARDIFLTYVLNNKLLWAIAIANAFVYLVRYGVLDWAPVYLNEVKGFSFDESSWAYAFYEWAGIPGTLLAGYLSDKVFKGHRSPVLIIFMGLTLICVLVYWLNPPGNPQLDIAMLIAIGFFVYGPVMLIGLFALDLVPKKAAGTAAGFTGLFGYVGGAVSANIVIGYAIDSSGWDAGFMIIVAACIISIILVSMTIKAEQHANR

SEQ ID NO: 25853 - protein, 448 aa, marine gamma proteobacterium HTCC2143
MQTDSHASDSIPHLKPIESGFFETLRIMKKSYNSPLEHCQTMQKEHGNAVMQKMGKLNYVHLFGADANHLAVMNPNQILSNKNSWDLIIGRIFTNGLMLRDGDDHRYHRRIMQAGFKAKAMKSYMATMVDLVPDAIADWPTGDGDIMLAYPAFKQLTLDLAATIFLGMDLGDEATKINKAFETCVAASMPKIPVAFPGTILWRGIKAREYMCSFFHSCIAEKRAGNGNDMFSLLCNAKDEEGNQYTDQEIVDHMIFLMMAAHDTTTSTLTSMTYALAKNPEWQERLYQEVQSLEIDQLNYENLDKMVETEWVMKEALRMYPPLSTLPKFSLKEFEYDGRLIPAGAMVITYPIHTHYMDEYWDKPTTFDPLRFSEERSEQKRHASSWIPYSGGAHMCIGLHFAVMQIKLVMFDMLKRYRWSVPADYDMPVQQSPISKPKDGLPISLELR

SEQ ID NO: 25854 - protein, 57 aa, Brassica napus
DWLVEVSEEYKLASDTLYLAVNLIDRFLSNNYIEKRRLQLLGVTCMLIASKYEEIYP

SEQ ID NO: 25855 - protein, 799 aa, Candida albicans SC5314
MDVLKTTYAHTDIEPIYVGGTSASISTSNGELLLATPLNEDVIITNLDTNEIIYKIPGDGEVITNLTITPDGSYLAMISQSQLLRIFDLNKGSVIKNFKLPSPVYISSVDSTSSLFAFGGSDGVITVWDIENGYVTHSLKGHGTTICSLTFHGELNSQDWRLASGDTMGTVKIWDLVKRRCIHTLKDHNTAVRGVGFDQDGDLFISGGRDNVVIIYNTKNFKTINTFPINEQIEAAGFVSLIDDRQYFYTGGSENVLKIWDIKSGEMIGRSPIPLKTNEELLIIDVIKLYNNNLYLVISDQTLIELDLQELTPGHGHGHGQDDEIVEFPIVKRIAGNQGIIADIKYVGPEFNLLAMATNSPALRIVDIEKPLELRVYEGHTDILNAVDVSTDGKWIATASKDNEARLWRWNGELQDFEPFARFQGHAGAITAISLSKSQNEPKFLVTGSTDLTIKKWKIPNTPNSIVKTSEYTRRAHDKDINSIDVSPNDEYFATASYDKLGKVWQTDSGETIGVLKGHKRGLWDINFYKFDKLIVTGSGDKTIKVWSLLDFSCKKTLEGHTNSVQRVKFFNREHPQLLSCGADGLIKLWDYKQGEIIKSLDNHDQRIWAMDLKNDGEYFTTADADGKLSFWTDNTEEEVKFKELQAKEKIEQEQSLSNYIKNKDWSNAFLLALTLDHSMRLYNVIKSSIETNEDKDSIIGSFSLENTISLLDDGQLVKLFKKIRDWNVNFKFFEISQKLLNVVLNNFAVDKLTEVPGLMKIMESIIPYNERHYNRIEEMVEQTYVLDYTVEQMNKLIA

SEQ ID NO: 25856 - protein, 584 aa, Candida albicans SC5314
MFRQSLIYMNRPKKSVKSIYFHRYMNTKIPITSFKPINPRPKPKPKPKPKLKFKLKPQGKFRPLVYGVAIVATGLGTAYYIDNHYYSSLMTRSVRAVYVLLWIAYAYGFNSNSYQNIDDLHEIASDKLLHLLTTNKGLYIKLGQAIANQGNLFPLAYQKKFPQLYDQAPVQSWQDIDRILKENLGDDYQIRLFETINHEPIASASIAQVHYGKLKNGEEVAIKVQHGYIEKQVVVDLMIYRFISKVYEKVFDIPLSMFTKYISEQLIKETDFVHEMQNSEKLKKFIDKDSSLKYDNIKLPKNYPHLTTKQVLTAEWINGIPLTNKQTLLDQNYDLTLIMKQYIKLFGRQIFEYGFIHSDPHPGNLLVRFDSKNKQQLVLIDHGLYITLSDSFRLQYCNLWRYLFSLNTKGIEQIGREWGISSIDLFATVVQLRPVLLSPEVQSNANANANANKNEDEDNRNISDLFRDFIGDQKKFPGELPFLSRTMRMIQNLNQSFGSPVNRINLLTKESINALLQEKDLKFGNYWDLVRIKITLLLSGFMFYIVRLRQILSGDRFGGKGKGLEDYIEMYMQNTAKSLGMEWI

SEQ ID NO: 25857 - protein, 63 aa, Brassica napus
MRGILADWLVEVSEEYTLVPDTLYLTVYLIDWFLHGNHIERQNLQLLGITCMLIASKYEEIYP

SEQ ID NO: 25858 - protein, 292 aa, Burkholderia pseudomallei K96243
MSTAVESAARARDRYAVIGNPIAHSKSPFIHSRFAEQTGEAIEYTHLLAPLDGFSATVRAFIAQGGRGVNVTVPFKLEAYALADALSPRAAAAGAVNTLRFDADGVFGDNTDGVGLVRDIEVNLGVSLTGARILLLGAGGAARGVVLPMLERGPASLTIVNRTASKAEELVGQFTQAAHDAGCVLAGGGPERIAREPYDVIVNATAGSLDAALPECDAAAFGPATLAYDMMYGARPTVFMEHAAALGARTADGLGMLVEQAAESFHVWRGVRPDSAPVLAALRAALAASAAH

SEQ ID NO: 25859 - protein, 409 aa, Yersinia pestis biovar Microtus str. 91001
MGSVMTDKLAVNRNTFDQVILPVYAPAQFIPVKGKGSRVWDQQGTEYIDFAGGIAVTALGHCHPALVSALHQQGETLWHTSNVFTNEPALRLAQKLIAATFADRVFFANSGAEANEAAFKLARHYAIERHSPYKTKIIAFHNAFHGCTLFTVSVGGQPKYSDGFGPKPADIIHVPFNDLAAVKAVMDDHTCAVVLEPIQGEGGITSATPEFLQGVRALCDQHNALLVFDEVQSGMGRSGKLFSYMHYGVTPDILTTAKALGGGFPISAMLTTEEIASVMTVGTHGTTYGGNPLACAVAEAALDVINTPEVLNGIEQRHGLFVQALQSINSKYDVFSDIRGMGLLIGAELTAKYRGQAREFLAAAAANGLMILNAGPDVLRLAPSLVIELEDIQQGMARLEKAMASVIKG

SEQ ID NO: 25860 - protein, 834 aa, Saccharomyces cerevisiae
MAHRKLQQEVDRVFKKINEGLEIFNSYYERHESCTNNPSQKDKLESDLKREVKKLQRLREQIKSWQSSPDIKDKDSLLDYRRSVEIAMEKYKAVEKASKEKAYSNNSLKKSETLDPQERERRDISEYLSQMIDELERQYDSLQVEIDKLLLLNKKKKTSSTTNDEKKEQYKRFQARYRWHQQQMELALRLLANEELDPQDVKNVQDDINYFVESNQDPDFVEDETIYDGLNLQSNEAIAHEVAQYFASQNAEDNNTSDANESLQDISKLSKKEQRKLEREAKKAAKLAAKNATGAAIPVAGPSSTPSPVIPVADASKETERSPSSSPIHNATKPEEAVKTSIKSPRSSADNLLPSLQKSPSSATPETPTNVHTHIHQTPNGITGATTLKPATLPAKPAGELKWAVAASQAVEKDRKVTSASSTISNTSTKTPTTAAATTTSSNANSRIGSALNTPKLSTSSLSLQPDNTGASSSAATAAAVLAAGAAAVHQNNQAFYRNMSSSHHPLVSLATNPKSEHEVATTVNQNGPENTTKKVMEQKEEESPEERNKLQVPTFGVFDDDFESDRDSETEPEEEEQPSTPKYLSLEQREAKTNEIKKEFVSDFETLLLPSGVQEFIMSSELYNSQIESKITYKRSRDMCEISRLVEVPQGVNPPSPLDAFRSTQQWDVMRCSLRDIIIGSERLKEDSSSIYAKILENFRTLEMFSLFYNYYFAITPLEREIACKILNERDWKVSKDGTMWFLRQGEVKFFNEICEVGDYKIFKLDDWTVIDKINFRLDYSFLQPPVDTASEVRDVSVDNNNVNDQSNVTLEQQKQEISHGKQLLETIETGKN

SEQ ID NO: 25861 - protein, 306 aa, Photobacterium sp. SKA34
MSKLVVLGSVNADHVLQVPSFPRPGETLHGRNYQVIPGGKGANQAVAAARLNADIGFIACVGDDAFGLLMHDNFIKDGIDVRGVKTEMGTPTGIAMIQVSDCGENSICLSAEANNKLTEQAIESDLDTIRQAEYLLMQLETPMCGIEKAAKVAKLASTTVILNPAPARELSDELLACVDVITPNETEAEVLTGVMVTDNQSAQQAADILHGKGIKTVMITLGAKGVWLSQNGSGDIISGFRVEATDTTAAGDTFNGALVTGLLEDLALESAIKFAHAAAAISVTRFGAQTSIPTREEVDLFLAQHA

SEQ ID NO: 25862 - protein, 409 aa, Zea mays subsp. parviglumis
MQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMSVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNI

SEQ ID NO: 25863 - protein, 615 aa, Yarrowia lipolytica CLIB122
MSTGRAYMTSRIANSPTRPKSPTQTSSVMSETKPVQAESISITSEAGQVTGQVEVMPSNAWQRFKYGFGPADTTDMDFTGLTPMEITALKTANSPLQRNLKGRHLQMIAIGGSIGTGLFIGSGSTLSQGGPAALLIAYGIIGVMLLLTMHALGELAVCFPVSGGFFTLFTRFIDPGWGFAMAWNYVMSWFVILPLELVAAAMTVNFWNEINGTSINTAAWIIIFWTLIVCINLFGVRGYGEAEFVFSIIKIAAICGFIIFGIIMAAGGGPSDGAFSSYQGGKLWKSPGTLANGFKGVCSVFVTAAFAFAGTELAGLAAAETENPRKMLPKATKQVFWRICLFYIVALTVVGLLVPYDNEMLLNGSSSADATASPFVIAIRLAGVKGLPSVMNVVIMIAVLSVGNAGVYAFSRTIAGMAEAGQAPKMFAYIDRQGRPIVGIAVVLIFSLFAFISAAGAEVRSAVFNWLLALSGLSSVVVWGSINLAHIRFRQALKYRGRDTGELTFSAGFGVYGSYVGLSLNILVLIAQFWIALFPLGGKPNAEDFFMAYLAAPVILAFVIGYKLVKRDGILKISEIDIDTGRREKDLEKLKAEIAQEEYDLSQRGFAYRVYNFWC

SEQ ID NO: 25864 - protein, 191 aa, Saccharomyces cerevisiae
MQTLKCVVVGDGAVGKTCLLISYTTNQFPADYVPTVFDNYAVTVMIGDEPYTLGLFDTAGQEDYDRLRPLSYPSTDVFLVCFSVISPPSFENVKEKWFPEVHHHCPGVPCLVVGTQIDLRDDKVIIEKLQRQRLRPITSEQGSRLARELKAVKYVECSALTQRGLKNVFDEAIVAALEPPVIKKSKKCTIL

SEQ ID NO: 25865 - protein, 187 aa, Ashbya gossypii ATCC 10895
MSINEYAKELKAALAQYPNFPKEGVLFEDFLPIFRSPQLFQKLIDAFKMHLAEAFPETKIDYLVGLESRGFLFGPSLALAIGAGFVPVRKAGKLPGQVVKTTYVKEYEEDVFEMQVDSIPVGATVVVVDDILATGGSAGAAGDLIKQLGATILEFIFVMELDFLKGREKLQAPVFTLLQGQEEALGN

SEQ ID NO: 25866 - protein, 1551 aa, Kluyveromyces lactis NRRL Y-1140
MSQNNDSRDEAYVREQFQRYTTKMASNKNSNTDSKCRSTSHLNSLASISSDTSNETLKGNLSAASPTFSSDSTLSTKKLPVLQTLPTSLPNGQHQQGQLFPASSSSSSAISSRKPSVSGSFGTQTPTTAQLKTITSPKLSGALSTRSRSNSLTSSKLFALNQSNDSPSSTSVYPVPPNVASLNSQTASSMSVSTSADQYFPAQQNGSTTTVNLTPTLSSPSIRSLNNSTTSTTKSFKPLQKQYVLNEQLYLSSMKNKKADDYYTRGITSSGNEDDDDFRVDGENDDVDNDLSKLNNGLGSAIFGNNIATTTDKGFHSIDDDELVLMNDKILLERMEWLRSVEPNNPLIENSLNLLNKTGGSTDSLESFSNIETQLALEQLSNNHLVRERLEWQTMLSSVLNGDIVKSEKTKLAKRKPDEILLNHNDLIWLELKAWLNGRTVEDQRKSLEYSKTTADEVFEEILNYKNEKEENPEVVIEEAKILLNKYYKVVGYWKNLPNMNLEKPVTKTSNFVSRIEALNSLINSYEGLQYEIEALKQWTQNDDLDVTFTKDSLDTEGIFKNDRSFAEQIMKEKDIEGIFQKKIFFKHAPWMFKSKLVFLKQQNSIHEMRLPLPVDKLHSLLTFPLRLIQEIISIRLEYARKLKKPTMMMIDQMIDDFSTYIKLSVQIKHTLMEYRSGWSLKVEISDAFDAKVVEAIEFLFKLLHLKLIDSSKNSFKTFKEPDILFAHWENLKNFGCYISGASKVIAQGFVNITIRLLNRLHLYIMEEQRNSVDLVTSDDARKWVVEVIENVGAFKRKTNRFSNVLTKAFQNSVLYNIKDHSMLLERLRNSGHFLIYTGGILEQNGIYLIASEELLGCSDDEIMDIIKSTKIGSDLIPKVEINNSLTIYNPPEDLTLPEAMFVQKERRNGVSYYHLKQDDLTQRVGIRGKGGSSTAPEEEGEELVQLENKLKMLGYVLVFCPTKPMVWNGEMYNLTSEEPLTMEEFGLSVEEDVIVMLNQGSTYALDYQVDRFQHFAGDAISIREKKCAINSIETALQRINKSYFRMTYIVLKNFGSVQKNVTLQTNESVFFNIAYLFVKDFAKNFLLLNVATPETKAIIIRLMIQISIDWLTFVLDECDPANPETFRWCVPAMEFAMRMTNGWNILGIEEKEFKLLKEKIARCMSLLISHFDITGARSREAERIDAQQTRPNFDIDDADDDMILAVNSEMRMNAITDMEKVVKVKRHYSVGKVIDDTDNQSKLLKSLASSISNLSIRWQKRSFIGSGSFGTVYSAVNLDTGDILAVKEIKIQDAKSMKQIFPSLKEEMRVMEILNHPNIVQYYGVEVHRDKVNIFMEFCEGSSLASLLEHGRIEDEMVTQVYTLQLLEGLACLHQSGVVHRDIKPENILLDRNGVIKYVDFGAAKLIAKNGSKRISLDANNKSTGGKDMIGTPMYMAPETVTGQGHGKFGSDDIWSLGCVVLEMVTGRRPWANLDNEWAIMYHVAAGHLPQFPTKSEISSAGRKFISRCLIQDANKRATAMELLLDPWISQIRNIAFGGNAESFNNETHN

SEQ ID NO: 25867 - protein, 242 aa, Zea mays
VLIGSNGTADQVEKIVKTLNEGNVPSSDVVEVVVSPPYVFLPVVKSQLRQEFQVAAQNCWVKKGGAFTGEISAEMLVNLGVPWVILGHSERRALLGESNEFVGDKVAFALSQGLKVIACVGETLEEREAGSTMDVVAAQTKAIAEKIKDWSNVVLAYEPVWAIGTGKVATPAQAQEVHASLRDWVKINVSPEVSESTRIIYGGSVTAANCKELAAQPDVDGFLVGGASLKPEFIDIINAAAV

SEQ ID NO: 25868 - protein, 166 aa, Schizosaccharomyces pombe 972h-
MASTQVVFIVTLFLYLLITRWRRKNEKSFIASEEPKQPEWRDYTPAELKEYNGSKNSLVFLAIKGTVYNVTMGSKFYGPQGPYSAFAGHDASRGLAKNSFDDEFIPDSDAEELDDCSDLNDEERQALNDWKAFFDQKYQAVGRLISPREARAAATISETEEKVAHN

SEQ ID NO: 25869 - protein, 430 aa, Prochlorococcus marinus str. AS9601
MKETIDFLIDTVEARQVLDSRGNPTVEAEVFLECGASGRAIVPSGASTGAHEAHELRDGGSKYMGKGVLNAVNKIHETISPALCGLSSLDQTAVDKLMIEIDGTPNKSNLGANSILAVSLATARASANALDIPLYRYLGDPLSNLLPVPLMNVINGGAHAPNSLDFQEFMLVPHGVNNFSESLRMGTEIFHSLKSLLDQKGLSTAVGDEGGFAPNLSSSVEAGDLLLEAIQKAGFKPGEQVSLALDAASTEFYRDGIYKYEGKSLNSSEMISYLSRLVSNYPIVSIEDGLAEDDWEGWSELNKELGNKVQLVGDDLFVTNTERLRKGIIEKSANSILIKVNQIGTLTETLEAIELAKMSGFTSVISHRSGETEDTTIADLSVATRSGQIKTGSLSRSERIAKYNRLLKIEEELGNQARFAGALGLGPKNI

SEQ ID NO: 25870 - protein, 129 aa, Glycine max
MASEKDAALAPVPNDNPTIFDKIIKKEIPSTVVYEDEKVLAFRDINPQAPTHIVIIPKVKDGLTGLSKAEERHVEILGCLLYAAKVIAKQEGLEDGYRIVINDGPSGCQSVYHIHVHLLGGRQMNWPPG

SEQ ID NO: 25871 - protein, 188 aa, Neisseria meningitidis MC58
MLVHPEAMSVGALADKIRKIENWPQKGILFHDITPVLQSAEYFRLLVDLLVYRYMDQKIDIVAGLDARGFIIGAALAYQLNVGFVPIRKKGKLPFETVSQSYALEYGEAAVEIHTDAVKLGSRVLLVDDLIATGGTMLAGLELIRKLGGEIVEAAAILEFTDLQGGKNIRASGAPLFTLLQNEGCMKG

SEQ ID NO: 25872 - protein, 522 aa, Gibberella zeae PH-1
MSDAFETAAPPHATYDLILRRLRSLGVYSEMLPCTQKIKDLGWKPVGVILSGGPSSVYADDAPGVDPLVFELGVPVLGVCYGNQLIAWRANPKSVARGVNREYGETQMAIHKIGTHGDRLFEGLGDSLIVVMSDFDKVVQLPDGFQTIATTKNSEFAGIAHETQPIFGIQFHPEISHTEKGTDIIANFATKICGARPDWKMDDFSAREIKRIRELVGDKAQVIGAVSGGVDSTVAAKLMKEAIGDRFHAILVDQGLMRLNDTWALTSLVVDGSELFLGRLAGVTEPEAKRKIIGGTFIDLFEIEALRIEKEAENTDRAGKVEWFLQGTLYADIVESLSFKGAASSTIKSHHNAGGLPARMQNGEAQLKLLEPLRELFKDEVRAFGRQLGIHEELIGRHPFPGPGLGIRIIGEVTPERVEIVRKADHIFISMIREAGIYDEVTQAYAALDSSRAVGVQGDARVYGYICILRAVTSLDMMSAEPYEFTWSLMKAISRRIVNEVDGIARVVYDTTSKPPGTIELE

SEQ ID NO: 25873 - protein, 550 aa, Haemophilus somnus 2336
MMQNINPTQTNAWKALEQHQKDLEQVTIQQLFEQEPTRFNDYSLKFAEQILVDYSKNNINQQTLSLLRQLAKECALNEATESMFNGEKINRTENRAVLHTALRNCANTPVYVDGKDVMPEVNAVLAKMKSFCQRVISGDWKGYTGKAITDVVNIGIGGSDLGPYMVTEALRPYKNHLTMHFVSNVDGTHIAETLKKVNPETTLFLVASKTFTTQETMTNAISARKWFLAAAQDESQIAKHFAALSTNVKEVEKFGIDTHNMFEFWDWVGGRYSLWSAIGLSIALSIGFDNFEQLLAGAHEMDKHFRTAPMEQNIPITLALIGIWNCNFLGAETEAMLPYDQYLHRFAAYFQQGNMESNGKYVDRSGQVINNYQTGPIIWGEPGTNGQHAFYQLIHQGTKIIPCDFIAPAQTHNVLSDHHNKLLSNFFAQTEALAFGKTQQEVEAEFIQAGKSLDEVKNIVPFKIFTGNKPTNSILVQKITPFTLGALIAMYEHKIFVQGVIFNIYSFDQWGVELGKQLANRILPELVGDEQINSHDSSTNGLINQFKSWR

SEQ ID NO: 25874 - protein, 450 aa, Schizosaccharomyces pombe 972h-
MPASKYAGWSRDQLISRILELDGKLQKNTNSLPNKEIEGKNEVIKNKNKLDNGNEIEPQHLSQELVLQHALQDASSLPKLKPVRPFQLEKTVFVAFKFAYCGWNYNGLAYQLEPTPLPTVEGKVFEALLRAHLITDPSSCSFSRCGRTDKGVSAMGQVISLNVRHSERRPIIYCDVLNRLLPADIRITGYAFPPEGFDARFSCKQRHYKYLFTKDYPGGSLDIDRMNEAAALYLGEHDFRNFCKIDASKQITNYHRRILSSKVICIDPSTGLYAFDLQGTAFLWHQVRCMMAILFLIGQKLEPASLINDLLDIKKVPTKPIYDMASEYPLILYDCDFDNIEWTLPTDSPTTAPRIAKHTYETIYHQWHSLRIREQIASFMLDIADHNVKRYGKSEESSSTMNVGEGLLKRTKKYIPILSRQRQESVEVVNERYKRKKGLKDSDVKSENIK

SEQ ID NO: 25875 - protein, 615 aa, Saccharomyces cerevisiae
  misc_feature (174)..(174): Xaa can be any naturally occurring amino acid
  misc_feature (177)..(177): Xaa can be any naturally occurring amino acid
  misc_feature (360)..(360): Xaa can be any naturally occurring amino acid
  misc_feature (367)..(367): Xaa can be any naturally occurring amino acid
  misc_feature (509)..(509): Xaa can be any naturally occurring amino acid
  misc_feature (574)..(574): Xaa can be any naturally occurring amino acid
  unsure (1)..(615): unsure at all Xaa locations
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPXRSXTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIXEWSSSSXHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVXGKILLYDLQSREVKTSRWAFRTSKINAISWKPAEKGANEEEIEEDLVATGSLDTNIFIYSVKRPXKIIKALNAHKDGVNNLLWETPSTLVSSGADACIKRWNVVLE

SEQ ID NO: 25876 - protein, 532 aa, Oryza sativa (japonica cultivar-group)
MAAAAAAMATATSATAAPPLRIRDAARRTRRRGHVRCAVASGAGRGARGARGPGCRRTASWWAAAISGLCTAQALATKHGVVDSGLKDDLVFGDPNAPRFVLWEGKLRPVPSKPGDLPFFDLMSIPGKLRAGLGALGVRAPPPVCVLSPLCILDSLVKFDCAERFRRRFQGREESVEDFVRRNLGAEVFERLIEPFCSGVYAGDPSKLSMKAAFGKVWRLEDTGGSIIGGTIKTIQERGKNPKPPRDPRLPTPKGQTVASFRKGLTMLPDAITSRLGSKVKLSWKLTSITKSDNKGYALVYETPEGVVSVQAKTVVMTIPSYVASDILRPLSISVVIEFGLVIYLSDAADALSIFYYPPVAAVTVSYPKEAIRKECLIDGELQGFGQLHPRSQGVETLGTIYSSSLFPNRAPAGRVLLLNYIGGSTNTGIVSKTESELVEAVDRDLRKMLINPKAVDPLVLGVRVWPQAIPQFLIGHLDHLEAAKSALGKGGYDGLFLGGNYVAGVALGRCVEGAYESASQISDYLTKYAYK

SEQ ID NO: 25877 - protein, 425 aa, Brassica napus
MSKTTNQNRRPSFTSSTESSMRKRHGPSSSSSAVKPISNTAVMVAKKRAPLGNITNQRKDSRIFPNSSSADSAHCPNKSAKLKLAAPTQPVCVNACETKSTCEEEVVPIERKAFSNLCITPSSDTTTNVMSETENKEEKFMNIDNKDDADPQLYATFACDIYNHLRAAEAKKQPAVDYMETVQKDVNSTMRGILVDWLVEVSEEYRLVPETLYLTVNYIDRYLSGNVISRQKLQLLGVACMMIAAKYEEVCAPQVEEFCYITDNTYLKDEVLDMESAVLNYLKFEMSAPTVKCFLRRLFSGCPRVHEAPCMQLECMASYIAELSLLEYTMLSHPPSLVAASAIFLAKYTLDPTRRPWNSTLRHYTQYEAMELRGCVMDLQRLCSNAHVSTLPAVRDKYSQHKYKFVAKKFCPSIIPPDFFKNSLY

SEQ ID NO: 25878 - protein, 325 aa, Pisum sativum
  misc_feature (319)..(319): Xaa can be any naturally occurring amino acid
  misc_feature (323)..(323): Xaa can be any naturally occurring amino acid
  unsure (1)..(325): unsure at all Xaa locations
MKNATLICVPIMGETVEKMVVDIQKAKLNGADLVEIRLDSLSTFNPHQDLNTFIQQHHSLPFLFTYRPIWEGGKYDGDENRRLDALRLAVELGADYVDIELKVAHEFYDSIRGKMFNKTKVIVSSHNYQYTPSVEDLGDLVARIQATGADIVKIATTAVEITDVARMFQILVHSQVPFIGLVMGDRGLVSRVLCAKFGGYLTFGTLESGVVSAPGQPTIKDLLHLYNFRQLGPETKVYGIIGKPVSHSKSPILFNEAFKTVGFNGVFVFLLVDDLANFLRTYSSTDFVGFSVTIPHKESALKCCDEVDPVAKSIGAVNXIVRXPT

SEQ ID NO: 25879 - protein, 430 aa, Triticum aestivum
  misc_feature (213)..(213): Xaa can be any naturally occurring amino acid
  misc_feature (223)..(223): Xaa can be any naturally occurring amino acid
  misc_feature (259)..(259): Xaa can be any naturally occurring amino acid
  unsure (1)..(430): unsure at all Xaa locations
MDVAVAKQLRRIRTLGRGASGAVVWLASDEASGELLAVKSAGAGGAAQLEREGSVLTGLCSPHIIPCLGSRAAECGEYQLFLEFAPGGSLADEAARSGGRLPEPAIRAYAGDVARGLEYLHARSLVHGDVKARNVVIGGDGRARLTDFGCARAVDSLLPMGGTPAFMAPEVARGEDQGPASDVWALGCTVVEMATGRAPWSDMNDLLAAVPRXIGYTAAVPGXPGWLSAEAKDFLGRCFRRQPSDRSTAGQLLDHPFVXASAAAGGDYKAGPAKQQLTSPQKPMEDALWDSDTDDEADEMSATPAERIGALACGNSALPDWNSDDGWIDVCEEVHRVPDSPPADAGYDLVWPEESDAEREPFAVAADDSNDIPRNAVVTDSSIWQDSYVRPVHLGSCRNQFHPFQSDGDENLRFDRRCNKDRVMEFIFLL

SEQ ID NO: 25880 - protein, 490 aa, Candida albicans SC5314
MSIRLYSKQSLNTFKKATFIPLTTTATTAITTTQFRYFHDTPNKQNVTVNNMMPRVTKPTPTNTFTTSPQLPSTEYLKAFNNKELISFFMIGLATLNKPILQLCIKLFPYVPMSIIKALVYRIYCGGETIDQVKKTGLRLHERGINNMMISLTIEACDGNDNVDPKYIVEETAKSIETILVPHTVAMIEQATDDINDIPPGYVALKPTGFAKDAANVLKNYNTTMIKEFDELVDKAIIVCQKIYDSNKELSQKYPERVSPFVVGVIDAEKHELQEGVYELQRRLYQKFNKLNQPISIVGTLQMYLSDSANLLTKEENLANENNYRLGLKLVRGAYIHSEKNRDIVIHKTKQDTDNNYNSGISYCIDSILNQNQNQNGSTIGHLVVASHNAESMRLASDKVYNPMNESNKNKTNVVLGQLLGMADNVTYDLITNNKIGNVIKYVPWGPPLETKEYLLRRLEENGDAVKNDNGWPLVKASFKMLTKRLFGSG

SEQ ID NO: 25881 - protein, 368 aa, Polaromonas sp. JS666
MKTKAAVAWKAGQPLTIETVDLEGPKFGEVLVEIKATGICHTDYYTLSGADPEGIFPAILGHEGAGIVVDVGPGVTTLKKGDHVIPLYTPECRQCKFCLSRKTNLCQLIRGTQGKGLMPDATSRFSLDCQPIFHYMGTSTFSNYTVAPGISLAKIREDAPFDKVCYIGCGVTTGIGAVIFTAKVEAGANVVIFGLGGIGLNVIQGAKMVGADKIIGVDINPARQEMARKFGMTHFINPKETDNVVDAIVQLTDGGADYSFECIGNTKVMRQALECTHKGWGRSIIIGVAEAGAEISTRPFQLVTGRKWEGSAFGGARGRTDVPKIVDWYMDGKINIDDLITHTMPLEDINKGFDLMKRGESIRGVVIY

SEQ ID NO: 25882 - protein, 473 aa, Pseudomonas syringae pv. phaseolicola 1448A
MSSSSTSAAADPQGRQSASPNRLIFISVLVATMGALAFGYDTGIIAGALPFMTLPTDQGGLGLDAYSEGMITASLIVGAAFGSLASGYISDRFGRRLTLRLLSVLFIAGALGTAIAPSIPFMVAARFLLGIAVGGGSATVPVFIAEIAGPSRRARLVSRNELMIVSGQLLAYVLSAVMAALLHTPGIWRYMLAIAMVPGVLLLVGTFFVPPSPRWLASKGRFDEAQDVLEQLRTNKQDAQREVDEMKAQDEEARHRPKARELLRQGWVIKLLLIGIGLGFTAQLTGVNAFMYYTPIILKNTGMGTNAALTATIGNGVVSVIATLLGIWAIGRYGRRHLLMTGLVMVILMQAALGCVLQFMPQNLTQSYTALACILVFLLFMQMCISPVYWLLMSELFPMQVRGLLTGTAVSMQWLFNASVAFTFPIAVDTIGNPTFFIFAAINVGSLIFVFLCLPETKGKSLEQIEKHLKKEL

SEQ ID NO: 25883 - protein, 355 aa, Arabidopsis thaliana
MVLIIGSVETKLISRFSRRSDATAFRKETFDIPNSGNVSAGKIREAMVKGTNAEQALAREEASSSRPKRQRVPSIVEEEGENGGGDVVVRSGTLFELDLLDCPICCNALTIPIFQCDKGHIACSSCCTNVSNKCPYCSLAIGNYRSRIMERVVEAFIVRCPIVQSLFLAKRQNGCTETFSYGNELVHEKKCSFALCYCPAPNCNYAGVYKDLYSHYAANHKKLWTRFSCGYSMHVCMDFESKSLVLQQYSDGPLVVLQCFKEPPQGLFWTVNCIAPSAPGVGKFSYELSYSTAGNTLTFRSSEMNRIQKVSFQTPEKDFMFIPEYILCPMGLYKGTYICIRSLEEEEEEEEDNED

SEQ ID NO: 25884 - protein, 1089 aa, Oryza sativa (indica cultivar-group)
MGVPEAVALEIPAAAEAEEEVEEEEGSPSPPVVARVPPRIRRRLLLRHRGGAPATAEEIEAKLRDADLRRQQFHEALSCKARCTVRYPSCPSQEEDPKKRLEAKLVAAEQKRLSLLAKEQSRLAKLDELRQAAKNDAELRFKKEREELGMKVESRVRQAEEKRTQLMHARSQRRAALEERTTKYLVQRVAWENKYRERAKRQRAEYLKQRGSTHSFTYTASVKNGDFLSRKLARCWRRFITSRKTTVVLARAFDMLRINEESVKPMPFEKLALCIESPTVLQTTRAFLDRLESRFTLSQSSSPSSPENIDHLLKHLGSPKRTLSKSGGRTRVTPTKAARNSDVSKLPRYSPRIVLCAYMILGHPSVVFNERGEREKLLVESAENFVKEFELLIKTILDGSSGACILKQPILDDLSPGSSNYQESSAVIADRKKFRSQLASFDKAWCAYLYHFVVWKAKDAKSLEEDLVRAACKLELSMMQTCKFTAEGQPENLNDNLKAIQKEVMVDQTLLREKVRHLGGEAGIERMEVALSEARTKFFEAKGNRSPLATTIKNVAATCSSGESPISDMKENSNINDKRPSQADQSMFRVPSSPSESNTAGITMSNPMTVSSTLSEKRPTENEQMVNEILHGFLADSSSNIGTVEGGFKEKVRETMEKAFWDVVVDSLRGDMPDYSYLVQLVKEVRDTLYEMVPKGWKEEIINNIDLEILLQVLESGTQDMQYLGQILQYSLGMLRKLSSLAKEDEMKRSHDKLLGELTEHSECNNSGSNSFVIAVIKGLRFTMEELKALKTEVSRARIQLLEPIIKGSGGVEYLQKAFADRYGFPSNASVALRSTAQWISTSKDTVEVEWNEHAQPLVATLRSGHGVPDQRQSTIPVSDDTGLPECTGQRLDQLIRIGLLQLISGIEGVQMQSVTETFKLNWLRLSMLVQRQVLATDDPNITPTELESATSQLFNTLAELLDKFPDVSTAKIMEVMLRSSSSSSSGSTTGSPSDERTESRKQILARVFLKSLQTDDPVFKKVSRSVYCAFRAITLGGSGARGRKLADAALRRIGATKLTDRVVRSAEILIRAASISQQVHGPWYNHLV

SEQ ID NO: 25885 - protein, 388 aa, Triticum aestivum
MASGTDEKAKMESLTSPAAFVEGGVQDACDDACSICLEAFCESDPSTLTGCKHEFHLQCILEWCQRSSQCPMCWQPVSMKDPTRQLLEAVERERNIRTNQTRNTTIFHHSALGDFEVRHLPVVANDAEIEERILQHLAAAAAMGRSHQHGRREGQRNRSGSHGSPQFLVFSAHPNTPAGSVSSSSAQGEGADDLRILVPRVGDLPPHANPIEEAGNQSPGVLTYDAEQDAVVSSGNSTPVSSPRFFNRRHSSGQSTPVGNDRAGPSDVQSFSDSLKLRLNAVSSKYKESITKSTRGWKERLFSRNSSVSDLGSEVRREVNNGIASVSRMMERLETRGSGRPSYSPTTSTSEVCLTTEPSNERVTESNSNTTTSTSNTSTPCVTMSGSN

SEQ ID NO: 25886 - protein, 693 aa, Polaromonas sp. JS666
MTASSLSLMANAIRALAIDAVERANSGHPGAPMGMADMAAALWTRHLKHNPSNPNWFNRDRFVLSNGHASALLYAVLHLTGYELSIEDIKNFRQIHSKTPGHPELGITPGIETTTGPLGQGLGNAVGMALSEKLLANEFNRPGYTVIDHNTYVFLGDGCLMEGISHEVAALAGAWKLNKLVALYDDNGISIDGKVEPWFPEDTAARFAAYGWNVLGPIDGHDGELVAETIRCARRSNTQPTLIICKTQIGKYSPNRANTPKVHGEPLGAEEIQLTRDAMEWTDKPFHIPADVYAAWNARDKGHTAESLWDAQFASYEAIYPDLGAELYRRMRGDLPNAFGKLAHEAIEKSCNRADSVASRRASQLALEEFTAKLPEMLGGSADLTSSNLTNTKSTSSLRFKTDGQVEACSNGKGVEVPGRHINYGVREFGMASIMNGIALHGGHIPYGGTFLTFSDYSRNALRMAALMKLRVIHVFTHDSIGLGEDGPTHQPVEHAASLRLIPNLDVWRPADTVEATVAWAVALQNKSQPTALLLSRQSLKFQPKTETDDVCKGGYVLKDPPETGVGRPLEAVLIATGSEVQLALRAQVLLADAGILTRVVSMPSTTTFDKQSSHYKSLVLPSRLPRIAVEMGVSHGWWKYGCSAVVAIDTYGESAPAEVLFNHFGFTPQGVASVVREVISKPQLSQLAPLTS

SEQ ID NO: 25887 - protein, 320 aa, Polaromonas sp. JS666
MNQLESLRQFTTVVVDTGDFNEISRFRPTDATTNPSLILKAVQQQEYRSLLDSTVSAEKKQPLDLVMDQLLVRFGCEILKLVPGRVSTEIDPRLSFDANATVARAERIIALYEANGIAPERVLIKIASTWEGIQAAAQLESRGIHTNLTLLFSLTQAVACSQAKVKLISPFVGRIYDWHRKQAGAAWNEGEGLGVTDPGVQVVRQIFHYYKKFAIPTEVMGASFRNLHQIRSLAGCDLLTISPQLLAQLESHDEPCSIHLAASDADDVALAPLACDEASFRFAMNEDAMVTEKLAEGIRLFCRDLQALEQIIAGTTSVPA

SEQ ID NO: 25888 - protein, 409 aa, Zea mays subsp. huehuetenangensis
MQFALALDTNSGPHQIRSCEGDGIDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 25889 - protein, 445 aa, Ashbya gossypii ATCC 10895
MVEDKSQVKVKFFTRSRTSRLHVLDAPLLLPVSLKRYGLSEIINHLLGLAEPVPFDFLIDGQLLRCSLQDYLTRKGLSSEAVLNVEYTRAVLPPSYLKSFSNEDWVSALDVGAERIVSGSYDGVVRTWNLSGKIEKQYSGHTGAVRAVKFISSTRLVSGGNDRTLRLWKTKNDDVKHVDELEGTEEAHTLAILEGHQAPVVSVDVQGDRILSASYDNSIGFWSTNHKDMTAVDPMDSLGDKASSAAKKRRKLTMKDGSVRRRAPLSLLESHKAPVEQVIFASNDSTVAYSVSQDHTIKTWDLVTSRCVDTKSTSYSLLSMVELPKLRLLACGSSARHITLHDPRADSSAKITQQQLLGHKNFVVALDTCPENEYMLCSASHDGTVKVWDIRSSSSIYTITREDQSVEKGINDKVFAVKWAKGVGIISGGQDKKIQFNKGDNIFKN

SEQ ID NO: 25890 - protein, 1154 aa, Ustilago maydis 521
MAKTIDFLASDGEDNFAARTISATSKPNRNDATASSSKPQKRARRSTKGSDDDGNDDFDIASSLLASAAEPAAVGMLSSSQQASQKAYASRVSAKDDDDDDARFIASVMQHANIKAGLEVAKKALSGKNKGKNKLGSGVVTGGGSFQSMGLHPSLLRSLLIRGFTTPTPIQRQAIPAIMSQPPRDVVGMARTGSGKTLAYLIPLINRLNGRHSPTFGIKSLILCPSRELAVQILRVGKEIARGWKADAGEGQDSRGEAIRWAIIVGGESLDEQFGIMSNNPDVVIATPGRMLHLTVEMNLDLKSVEYVVFDEADRLFEMGFAEQLEEMLLRLPPTRQTLLFSATLPKKLVEFTKAGLQANPKLVRLDADSKISADLRMAFFSVKPSEKEAALLVLLRDVIGVPLGEQAARDLDEEAQFNEDASDNQADGQRSRGYGNRRAEFKGKTKDKHLGNKRKRGGPGGALELLPHQTIIFCATKHHVEYLLLLLTTTGYACSHIYSSLDQATRGIQMSRFRRGQNSLLIVTDVAARGIDLPVLEHVVNFDFPPQPRTFVHRVGRTARAGRNGWAWSMCTNAELPYLCDLQLFLARPLVSSHTAIAALANGRDVASADALGLHDSLILGTLPREALDLETEFISSSLTNTSSSTAHDFPALRAVADRAQQKYEKSIAKASQESHRRAKEMVKLGSIEQINIRTASGREGQVPEWTLAGSPLEEMAVHDVVKRPEVYGLNRANKADAVTSALGSDRMDDKVKRGTDNALKEADEAAKRAALLAKVNAFRPQETVFEIGIRGDATPLGALMRSRRQTMQVKTKRAEALEARKRAIEGGGDAMEDDEEVTKPKVAARNKGKKKATAGKADNDEAVVGDAMVDMEQADEADILAAFDTTKPSKAQVQREALTDSETDASESDRDAASARHTKRARTKKAAPTSYRDPNFYLSYEQQGSTSERGYSLNNARSHTDSFIQQASAVSFDLAGDDATLGTQSQRPNVTRWDSKKKNFIQATVGADNKKMIRTESGVRLPASFRSGRYEDWKREKRIDMPKTGEIESNNHRVHERSPPETSVMGLKRFRHTKLSAPKTAGVFGNRRPGQPKRQAAKDEVKSARQIQKDRELKEKRREKNARPSKSDTNRRAKRGAARRGRGGHGPRGASR

SEQ ID NO: 25891 - protein, 615 aa, Saccharomyces cerevisiae
MSSISLKEIIPPQPSTQRNFTTHLSYDPTTNAIAYPCGKSAFVRCLDDGDSKVPPVVQFTGHGSSVVTTVKFSPIKGSQYLCSGDESGKVIVWGWTFDKESNSVEVNVKSEFQVLAGPISDISWDFEGRRLCVVGEGRDNFGVFISWDSGNSLGEVSGHSQRINACHLKQSRPMRSMTVGDDGSVVFYQGPPFKFSASDRTHHKQGSFVRDVEFSPDSGEFVITVGSDRKISCFDGKSGEFLKYIEDDQEPVQGGIFALSWLDSQKFATVGADATIRVWDVTTSKCVQKWTLDKQQLGNQQVGVVATGNGRIISLSLDGTLNFYELGHDEVLKTISGHNKGITALTVNPLISGSYDGRIMEWSSSSMHQDHSNLIVSLDNSKAQEYSSISWDDTLKVNGITKHEFGSQPKVASANNDGFTAVLTNDDDLLILQSFTGDIIKSVRLNSPGSAVSLSQNYVAVGLEEGNTIQVFKLSDLEVSFDLKTPLRAKPSYISISPSETYIAAGDVMGKILLYDLQSREVKTSRWAFRTSKINAISWKPAEKGANEEEIEEDLVATGSLDTNIFIYSVKRPMKIIKALNAHKDGVNNLLWETPSTLVSSGADACIKRWNVVLE

SEQ ID NO: 25892 - protein, 727 aa, delta proteobacterium MLMS-1
MRQQQHRYSRRSFLRLASATAASLPLTALTARAEFSWLDPEGESQRRVATLCGMCPAECLITVTVRDGKVVEIKGTDGNPLNGEQVCARGAAAFDLLYDPDRLKYPMKRVGPRGSGQWRRISWSEAIDTIAFKMDETLRRHGPGALALFAAGPSSGYIRELFAEFAVPQLNDSHYEHCHCNRDAAYIATLGFSPGAPGRLDYEQCRCLVLLGSHLGENMMLPEFGRFYAARQRGAKLLVADPRRGVMASRADQHLMLRPGSDTALLLGWINWLLREELYDREFIAAHASGLEELRQRVAAWTPELVAQATGLSVEQIVAGARLLAEQAPAVIIHPGRHSNRYGNEVPRLQAQAILSALLGAVGRPGGLLLPAPGPAGEPPAERYRQDLSRALQNRGGGRAAEIIGGLERGGIKLLGCWGQNPFHNTPNPYRTALAWRQADFIFTCDVLPSEAALQADIILPEATFLERHDRLRPRPEYEPQLLTARFPVLPPAFEAREPYDIVRELSIRLGRGRKLAAAEVGERLRQELAPFSVDLDYLQRHGAWARLPAQSAFLAEQPQADFRFPTLSGKIELAAADLAEAGHDRLPDFTPLPEPPSGYLRLLYGRSPLHTLSSTQNNRRLMREKGENELWLNQARAAELGLRQGQRVMLENQDGFSSLKPVALRLTDAIRPDCVYLVHGFGNRSPLLQTAFDQGISDNALMSRATINPVTGVGAGGNNFVRIRRE

SEQ ID NO: 25893 - protein, 301 aa, Zea mays subsp. huehuetenangensis
VPVGGCYRLIDIPMSNCFNSGINKIFVMSQFNSTSLNRHIHRTYLEGGINFADGSVQVLAATQMPEEPAGWFQGTADSIRKFIWVLEDYYSHKSIGNIVILSGDQLYRMNYMELVQKHVEDDADITISCAPVDESRASKNGLVKIDHSGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKDAFISDGCLLRECNI

SEQ ID NO: 25894 - protein, 485 aa, Pseudomonas aeruginosa PAO1
MAYGLQHVLTMYGGIVAVPLILGQAAGLAPGDIGLLIAASLFAGGLATLLQTLGVPFFGCQLPLVQGVSFAGVATMVAIIGSGGSGGIPAVLGAVMAASLIGLLITPIFSRITKFFPPLVTGIVITTIGLTLMPVAARWAMGGNSHAPDFGSMANIGLAAITLVIVLLLSKLGSASISRLSILLAMVIGTVIAVFLGMADFSKVTEGPLVAFPTPFHFGMPTFQVAAIISMCIVIMVTLVETSADILAVGEIIDTKVDSRRLGNGLRADMFSSMLAPIFGSFTQSAFAQNVGLVAVTGIKSRYVVATGGLFLVILGLLPVMGRVIAAVPTAVLGGAGIVLFGTVAASGIRTLSKVDYRNNMNLIIVATSIGFGMIPIAAPTFYDHFPSWFATIFHSGISSSAIMAILLNLAFNHFTAGNSDQQSVFVAASERTLRYQDIAALHEGDYFLDGKLYDAQGNEVPLAGDDSHGAPPRRRSETAEAGSA

SEQ ID NO: 25895 - protein, 409 aa, Zea diploperennis
MQFALALDTNSGPHQIRSCEGDGVDRLEQLSIGGRKQEKALRNRCFGGRVAATTQCILTSDACPETLHSQTQSSRKNYADANRVSAIILGGGTGSQLFPLTSTRATPAVPVGGCYRLIDIPMSNCFNSGINKIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVVDHSVQACIFTGYWEDVGTIKSFFDANLALTEQPSKFDFYDPKTPFFTAPRCLPPTQLDKCKMKNAFISDGCLLRECNI

SEQ ID NO: 25896 - protein, 274 aa, Bradyrhizobium sp. BTAi1
MPTIIITGASDGIGAAAARQLKANGHNVVLVGRSKAKTEALARELNAPFHLADYTQLADVQRLAGELLDHGRIDVLANNAGGIMGQRALTSDGFEMTFQVNHLAPFLLTRLLLERLIASRAKVIQTASAAANIFGRNFDVDDLNNERGYTPQGAYGYGKLENILFTRELDRRHRADGIAAVSFHPGIVRSNFANDTTHLMRLFYHSPLKYLITISPERSAQRLTWLAESAPGTDWQLGECYSGRKPMPVAFKDDGTAARRLWEHSETFVKPWLG
